United States Patent 7,745,391 (HUMAN THROMBOSPONDIN POLYPEPTIDE) - sequence listing, part 63

SEQ ID NO: 214615 - DNA, 687 bp, Homo sapiens
taatctcaagacaccttccgagcgtcagctcactccccttccaccctcagctccaccctcagcagatgataatatcaagacacctgccgagcgtctgcgggggccgcttccaccctcagcggatgataatctcaagacaccttctgagcgtcagctcactccccttccaccctcagctccaccctcagcagatgataatatcaagacacctgccgagcgtctgcgggggccgcttccaccctcagcggatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcattacccgaacccaagaggcggaggttgagctgagaagaggccagtgcactcaagcctgagcaataagaataaaaccgagtaga

SEQ ID NO: 214616 - DNA, 812 bp, Homo sapiens
tcaatgcagcggactcgtcagatgataatatcaagacacctgcccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcgggggcc

SEQ ID NO: 214617 - DNA, 503 bp, Homo sapiens
ggcactccatgctggctgttgacagcaccactctgcaagcccacacaagaggacccagatggaacgcgaaatgaaaaacacatcgggcagaggacacgctacaacgcaaaaaacaatggcggagatgtgtgcgctgtggcacgacatgcacagcggctgcaggaggggagctggagccaaccaggagacacttggggtctctctgaatttgcagcatgcacacacgcctctaagaggaaaagcccatggttggccagcctgtgctacatgaaaagatcaccaagaaactagagcagtaaaagcaggtgcagaacagctgatgggcgatcccactgtgtgaactgaaaagcaaacaggctgagcctgcagggtggggaggaccgggtgttcatgcacatctctggatctaagtgtctgcaggagcaagctcagggaactgtggccaattttgctttgttcaataggcttttctatatttataaaagaataaccttaatgctttt

SEQ ID NO: 214618 - DNA, 406 bp, Homo sapiens
ccactgcactccagcctgggcaacagagcgagactctgtctcaaaagccacaattagaagacaagttaatatttgtatgtgtacgtataaacgtccagaaggttatgcaccagattgttaataggaaacattgtcagaacgttaccctttgatgctgaagctaaaaaggatgagcattttttatccatatgcataacaagaaaggccagactaagcaacatagcaagatcctgtctctacaaaataaaaataaaaataattaactgagtgtggtggcatgcacctgtagtcccagctactcagaaggctgagtggaaggattgcttgagtccaggagctggaggctgcaataagttatgattgcaccattgcactccagcctgggcaacagagcaagcctctatct

SEQ ID NO: 214619 - DNA, 497 bp, Homo sapiens
taatagacttcatatgttgatgcagttgacatcagtatcaaactattttacatgtgatctggtgtatttcctgaggaaatctgcaagatatttattaagaactaataaaataaacctctccatgagtttttaggtagttttcaatttttcatgtctgtctcgtttcctcttatcaatgagttgctattttctctctctactctgaccatcgcaaaaggaaacaaaaataaatgttttaaactgttcctgaagggacagagagagaatagttctgccatgatgtatcagccgggactgtatttttagtgcagcattgtagaaactaaaaatatcctgttatagtagatcctttttataggtctgtgtgtgtgtgtgcgcgcgcgtgtgtgtgtgtttataatgtacgcacaagtgcctttgtgcatcagcagccactcttcacattacagctggactccattagtccttgaaaattaatgtaatcctagttaagaaaa

SEQ ID NO: 214620 - DNA, 338 bp, Homo sapiens
atgggctcccacaatgcctctgccatcctaggctgcaataaaagcccccacctggtgcctggcttgaggcctatggggacagacaggcaggcagacagcttcggctggggcacaaccctgcctatgtacctgctatggccctagtcctgcccgacacactaagtgtggttgctgggctggccacaggcctcacctcagaaggcactctgtgcttggccaggcgcggtggctcaggcctgtaatcccagcactttgggaggccaaggcgggtggatcacgaggtcaggagatcgagaccatcctagctaacagggtgaaaccccatctctgctaaaaat

SEQ ID NO: 214621 - DNA, 511 bp, Homo sapiens
gaacacagggatgtcctcgtgctgctgcccagccgggagcaactgcggctggccgtgggggtgaaggctactggccgcgagcttttccagcaagtgtgcaacgtggcgagcatcagagacgcgcagttctttggcctctgtgtggtcagaaacaatgagtatatatttatggatttggagcaaaagctcagcaagtacttctcaaaagattggaagaaagaaagaaatgaaggaaatgagaaacccagagcccccttcgtggccttcctccgagtgcagcactacgtggaaaacggaagggtcataaggtaacggcatgcggactgtaaggggtgtttcctggaatactgaaaatctgccgcatgacgtggaagtcccctgaaggccacacattacatttgagtttatccaaaaacaaaaaacaaacaaacaaccccactatatcggctgtttgctttggggttaacacaggaattctatttaatcgaaaggtatacagactgtgtcataa

SEQ ID NO: 214622 - DNA, 131 bp, Homo sapiens
cacgaatatttaaaatagcagaatgatggtatatccatgctacaaaatactatggaatatattaaaaagaatcaggtaaggccaggtgaggaggcttatgcagaaacagggtgggacatattcgcacgtga

SEQ ID NO: 214623 - DNA, 217 bp, Homo sapiens
cattaagaagccaacaatttttccccacatagagggaataatttagacttcttagaaaataataattattattattgagatggagtttcactccagcctgggcaactagagtgaaactctgtctccctgctgccaaaaaagaaaaaagaaatacctttcatgttccctccaagttctttgttaaaaaaaaataaaaaccaaacccaaaaaactcaca

SEQ ID NO: 214624 - DNA, 500 bp, Homo sapiens
aatgagcactcgaggctggaaaaatggtgccatagacttgcagggtcgattgagagcattgctacgaaccttcatcatgtaaaaaatgcaatgtctgaagcacaacaaagtgatgtgcaacaaaacaaggtatggctaattagatgagtctccatggaccactagtgtttctgtatatcttataagcagaggtactgactgcataatttttcaaggatgtttatatgatagagaagatagagatagtatctccctccaaaatgaagggcaggtatatttagagccttggaagatagagagtgcctctttctggaccaaacggcattataaaagctttatgttccctatgctcagggttcctttcctgtaatgcaaccatctgcacatacagatatcacctggtctttgcattgccctgtgggaactggggcttgggaaccagaacaagaaaatgttgatattttgactatttctgtgagtaataaagttctttgtctcta

SEQ ID NO: 214625 - DNA, 438 bp, Homo sapiens
attgacttttgtattgagcaataagtgaagtccaaaacatctgttgagtacctttcccgtatggggagcttcacctggtatggtgactgtatcagtcatttatgatagatgtaagtttgaaatcctgcactgctgattaataactgtgtaagtttgagcctttgtttactggtctgcaaattggggataataatatttaccaaagagggttgtactgtggattaaataagataatttagatggaatacctagcaaaattattagtaaatgctgttttcctttccttcatatgagaatcagaacaatcttttgaagaatcaaaacaatctttttgtgcgtgcgtgtgtgtgtgtgtgtgtgcctttattgtaatcctgtgaggtagaaaaggcagatgttaatgaagaaatcgaggcacaatcaagttatgtggttggc

SEQ ID NO: 214626 - DNA, 252 bp, Homo sapiens
tttgaaaattagtttgtgttttataaggtcaaatggcttctttaaattcatactgtgctattgtatctagcctggcatgtttctttactgtagttctttttctgaatttttaaacccctttgtgatttcacagagttagtaattatgttgggatgttggggcgtggactggatgtagctaaacatactcagatttgactcacattcaaatgtactcaaacattcaaatttaaagttgtctgccaaagcaaac

SEQ ID NO: 214627 - DNA, 495 bp, Homo sapiens
gaagctaggaagtcgtatctcattgtgcttttactttgcctttcgttcattatgaatgagattgaacatattttcatatgcctattgggcatttggataccactccaccgaagtgccttttgcccattttcttttgggttgtcaattttttctgattcataggagttcttcatatattccagttatgtatgttgcaaatattgatttaacaagattctttttttttttttttgagacggagtctcactctgtcacccaggctggagtgctgtggctcgatctcagctcactgcaagctccacctcctgtgttcacgccattctcctgcttcagcctcccgagtggctgggactacaggcgcccgccaccacgcccagctattttttacaaaatatttttagtagagatggggtttcaccgtgttagccaggatggtctccatctcctgacattgtgatctgcccgcctcggcctcccaaagtgctgggattacag

SEQ ID NO: 214628 - DNA, 524 bp, Homo sapiens
agaacaaagatcatcgcttttttcctgggtaattccaccaacccttctgctcagtgagcctgtgcccaggggtggacatgagaacctgctcttccccaagctgatcttagtaccaacagcttctcctgaggctcaaatgaagaaaaaggaggaaaactggctcagctggacttactagaggcagcatgctagtctctgccgtggtgctcacctaaaatattctcaggagcagttttaattaaatgagattttcacccagttactgctgaacgtagagcccacataacccgtatgtagactgtgattggctgtatacaaagctatgcagtctgcctttcacagtacaatgcctaggagctgggctctggagtcagagggcctggagtgtattctgggtccgtcatttattaactgtgtgatgctgggcaaatgactaagcttttctgtgcttcagttacttcatctttaaaatgggaataagaataatgcctataagattgctgtaaatgggttaatgactggat

SEQ ID NO: 214629 - DNA, 228 bp, Homo sapiens
ataaaaataatttggagcaaatttgcatactgtaatacattcaactttatgactaaatgatacatggtgatcacgcattccacaagagaatggccctcagacagtaaacatatttttgtcttaaaattagtgccactgggcaaggcggctcatatctgtaatcccagcactttgagaggctgcaggaggatcacttgagcctaggaatttgagaccagcctgggcaac

SEQ ID NO: 214630 - DNA, 963 bp, Homo sapiens
acgggtggatcacttgaagtcaggagtttgagaccagcctgaccaacatggagaaatcctgtctctactagaagtacaaaaattagccgggcatagtggcaggtgcctgtaatcccagctactcaagagggtgaggcaggagaatcacttaaaaacccccgggaggtggaggttgcagtgagctgagattgtgccactgtattccagcctgggccacagagtcagactgtctaaaaaataataataacaaataaaaaataaataataaaataaaaaaatgaaaaaagttaaaagtaggtgtgataggggaacaggaagaatcaggtatatatatccatgcctaaccatcagatgtggaggtcctatgtgatgaataacttttagtgaaaaacagatgagctgtttaatccaaacaagccttacattttgcttatcataattgaaagacacagaatttcatcaacatttaatgctaaaatatgatctaacagtacatttaatagagaaaaaatggaaatgagtattgcccccgaaaacttcatataagatcaaaacaccaattttttatgtcttttgcttcaaaaataaatttcttaattttcctttttccttcaataattaaacacacaatgagttcccaaatgaagcacttccggtacacttgacaagtaccttatttgtgccaatgacattgttaagagaccttctcattttatccctagaacccacactttcctttttccgttttccaaaggtgttttatagaacaagggtaaaaggctatgacatattataatactggcacacagagactgaaagctcctaagcaatccgctccattcaccaagtgaaatggttcctcctccgtgcagctgagggttgaccaggcgggtccaaggtccctctccttccttaaggaggggctgctgccaagattggtccttggctggcaactgggaagtt

SEQ ID NO: 214631 - DNA, 414 bp, Homo sapiens
aaatgcctcaccatctgggcagacacctttctctcgcttctcgaaaatcactgaggcagagcaatgtttctccatccattattctcctaccctggagggtgcaaagatgtgtttttaggagtccttgagaatatgtgtccttctaaagaagtaagttgcaccaaacacaaatcattaaggtaaatagttaaaggaaggcttatatttaaaacactaatgtttctagaacaaaaattctatcagtcattcacactatagaataatttagcttaatcagttgatttcttccctaatacacagctgagagactctgctctatgagaatctaagttttgctagaaagaagaagaaaaatattacttttatctgattaagctgctgctcttgttctccaaataggagtatctgggcacg

SEQ ID NO: 214632 - DNA, 198 bp, Homo sapiens
ttccctgctgtaaccactccctggccactgcctatgtttgctcaaggccttggggctctacaataaacaggtggaaaagccatccaggtctgtgcccttcccttcagggtggcaagttcccccaagccccaggtgggtccagagatgttgtctaggagtcagggactagagtaaaaaacctttgaagtctacctggca

SEQ ID NO: 214633 - DNA, 437 bp, Homo sapiens
tgtgtgggccaccccatacatcctgcttgtccttcaaaggcaaggctcagcctctacccaggaagttcctcccatcagctccactgtacaacggcctccttttctgcctgcccacagcaccttgtctcctctatcctcatcctcctcctggtcctgacacccccactcccttttactcattcaatgaaacaatgtagatgaaggaactctgggaacaataaagcatcatagcaagtgaagatacccactttttgtgtgcacaactcacagaattgcaatctaagtagggaacaaattaaaaaaaacagaaaaaagcataatcaaaaatgtttagggctgagcatggtggcttatgcctgtaataccagcactttgggaggccaaggcaggaggattgcttgagtccaggagtttgagaccagcctgggcaatatagt

SEQ ID NO: 214634 - DNA, 517 bp, Homo sapiens
cagagttttcaccatgttggccaggctggtctcaaactcctgacctcaggtgatctgcccgcctcagcctcccaaactgttgggattacaggcgtgagccaccgctcgcagcttaatttttgtttctaatgtcagtccctcctgcccaccccaaataacatctattgcttttgttaccaaaataatatgtctttgttatagaaaatagacaatctaaagatataattactcctaattttaccatccacatgtaatacctatacctttttttttaattgaagtgagactcataaaattaatgattttacagtgtacagttcagaggcatttaatagttgcagcattgtgcaaccatcacttctttttttttgaaacagagtttcgctctgtcacccaggctggagtgcagtggtgcgatctcagctcactgcaacctccgcctcccgggttcaagcgattctcctgcctcagcctcccaaagtagctgggattagagacgcgtgccaccacacccggg

SEQ ID NO: 214635 - DNA, 314 bp, Homo sapiens
ccagactcagctctgtcctcctccgtttcctcctctgttttgggccatagcacacaacacttccggtttgtcccttgcagatgatgtgtgccggctccttgagatcagcgagtatgcattagttttgtgtctgcagcatctcatgtggtgcattgcatcaataaatgctcaacaaatcagaaatcatactcaatacacgcttgttgaatgagcaaatcttcttttgactcttaggaaccttgggggcaagaaccccagccctgcagcgccccacagtcccttacagggtggcgtgtggggcggaggggagagga

SEQ ID NO: 214636 - DNA, 443 bp, Homo sapiens
cactctcccccatccaccctccttttacttacctccttttacttacttccactcctcactccactctcctggcaactgttccagaaaaaggagccgggagccacaagggggacccaggctggtctgtgtaagaacaggctgtgccaggttttcagatgcaattaattttcaagataagctctaaacttctgaaatgtctttgcaattgaaatgctgatacagtcgtcaaccactgcagtacataatcataaatcttgagcacagatagtttttgttggtaataatgaagtacaatatacatttaattagtgtgagatttaggaaacgtgcagtgtaataaaacaatattctaattagggttggggaaacgtttaaatactatttgtgcagtaccgttcaatgaaactcttacaaactacactcaaatctgctgtttctaagca

SEQ ID NO: 214637 - DNA, 275 bp, Homo sapiens
catcacaatgtatcaaaagatccccatacgctaatcctttctatctctgaaatgtccttcaaagcaatcctcatagcactctttctcctactgtatttatgcctttgtcatttcttacctgaataactcaaatttcctattctttattccttctgccagcctcccacattatcaaatctactctccatcttcctaaaatacatatctaaaaatgtagcttgtttgcttaaaaaccagaggacaacatctacatttttatggcatacaagactctg

SEQ ID NO: 214638 - DNA, 566 bp, Homo sapiens
ccctagacagcaagaccccccgcagtacagcaagacccaactctcttctttctcttcctcctcatcctactcaacatgaagatgacaaggatgaagaccttcatgatggtccacttcacttaatgaatagtaaatagtaaattttctcttcctcatgatgtttgaaataatattttcttttctctagcttattttattgtaacaatacagtatactatacacacacaaaatatgtgttaatcaactgtttatgttattggtaaggcttatggttaacagtgggctcttaatagctacactgtggtggagtcaaaagttatatacagggtctcgactgtctgggggtttggtgcccctaatctctgcattgttcaagggacaaccacagtgttatttctgttagacatgtgtcagcaccctatgctgttactgtgacttgctatttttttaaatctcccttgtaactgtaggataactctctgtataactctagtgaatccccagtaagtgcaaattaaaatggtgacctgtatctttaaagaaaattaaatctttatacatgctca

SEQ ID NO: 214639 - DNA, 757 bp, Homo sapiens
attccaaatttaatcttcaatggtaagaggccactaagcagagaatgaaatgaactggaaccctgataaactgtaaattgaaatgataattatcactaaaacagagggattcaatccagctgcctggggatgtttcattatataaattattattatctattccagtattggcagaggaagggctatgcgtctattagacttaggccaaatttggcatgctggtttctaccaatagcacatgctggtgattttacttttcagaactcacatatttatctcatttgatctcatcacaacctgagacacgagtcataatgaggactatggggctaattttatatccagtgaaccagccaagtttcatgcagttgagaaatggtaaactgtccagacatagtggctcacgcctgtaattccaacactttgggaggccgaggcaggcggatcacctgagtccaggagttggagaccagagtggccaatatgtagaaaccctgtctctacaaaaagtacaaaaattagctgggggtgttggcacacacttgtaattccagctaatccggaggctgaggcatgaggattgcttgagctcgggaggtggagtttgcagtgaggggagatgctgccactgcactccagccgtggtgacagaacgagactctggctaataaatttaattaaattatttattaggaaagggtacttttttagccactggtctgtctggttctggccacaactggttcctggtgggagc

SEQ ID NO: 214640 - DNA, 459 bp, Homo sapiens
aatcattagtcccattctactgatggtcagagttattaggtaacttgctcaagattacatagttaatgtaattagtagacctgtgattcaaattcaggctgtctggctccagagtctgatcttgaccgccacgctagtatttaggcaactgtacatacccagcctcttcagttttccttgaaattcacgtccatattcctgcttggcaactgttagctgggaatcagtagctgctgccccctttaggcagggcattgtaatacatttgttacggtccccactactctattctagagtttattttattactccctgttcactttactcattgatatttattttacctgtcagatcctgtaggtatttaagttttcagactctggcatgcaacattcattaccttgggcttgcaaaataaaaaagccacggagagaaaaatcacattaaattaaatattta

SEQ ID NO: 214641 - DNA, 428 bp, Homo sapiens
tgctttccccaaatctcccaaatccatggttttcaaatgtctttttcattgagtgacaatccacttatgctctgggtccccagacgtgggggtgcaggcctcttgggattatccctaaagaaataggacgcctaatttcaagatggtttatttttaaaaattagaaatgttgactccttgtaatacagtgattttgtttaaatctggaagcgtcagtggctgccacctcatagtgagcaccaagacctgttcacagaaaactgctggaacagcttgtccagggtgccggttccctaactcttagagctccagtctcttctgccataaagtggggagaatggaaccagcccgtgagggtgtgggggatgagggttggttgcaaagaggccagtcccggtggggactctgcaatggtgaagcactctcaa

SEQ ID NO: 214642 - DNA, 369 bp, Homo sapiens
ctcttccactaaaatagcaatttaaatccctaacgtttaaactggataaaacgcttaagctgtaaaggttggggggaaaaatagaaatttacttgaaaaggaaaatgaaacagagtatctctgggggaaaccttgactatgttttgacccaactgggatatacatgtcgatttaaatgccaggtcgatttcaaggccagattccaggtatttgaaggcatttgctatgtatcttttctgttgttgtaaagttatggttggacacattctggttgtattgatctcagagtaaaaatgctcctagtaataagaaagtggggattctgattccgaggacccagaatcatttatgtattaaaggaggaaatct

SEQ ID NO: 214643 - DNA, 412 bp, Homo sapiens
caaatttctctactattttgagggaacatgtcctattgtagaaagataaaccttttacaattgttcgtcataagaggaaatctgctttaaaaatatttcatagggctgtcttactcttattcctaaaaaaagttattactgtagaactagttagcaagagttactctgttctgggttacttgggattcactgttagcaaagactaacaattagtttgtatatccgtatatggatgtaggtggtcacagtaatttcctgcttgattttttttgaattccaattaatataggaagtttctgaatttctaggtatttcaggatttgcatatacttagagttcaattatgttttaaacacattatctgtgcaagtgactgtcctaaatgttgtggctaaagaggaggaagcataaa

SEQ ID NO: 214644 - DNA, 228 bp, Homo sapiens
ggtggaaaatccctctcccctttcttccacactttctttccttctaaactatgtctcataaagtcagaccacagaaccctttcaaatacagttagggcagacagagaccactacagagagccccagtgtttccttcctcgcttgaaaaggcaagaccttctcaaaaagtagaggtaggccttggtaagggcctcctttggaggaaagaaaaggcaaaagtaaggcatg

SEQ ID NO: 214645 - DNA, 483 bp, Homo sapiens
atacgcagtgagattagtcccattttttggttttgaacggaagctataagcagtttgtaaacctgtctacggccacaaatatggttgtggaacctagattcacattcagcaattataactccagatcccgtgctgtttctgttttctatttgcaaaccacctctctaattaactggctaactttgttatgtaattaacaggttgatgggcattgtattctggtaatagcaacctttgcactttgttctatgtaacatattttcctgaacagtcacatgtgaagtgactttttccctatttaaattccctcggttggccaggtgcggcggctcacggttgtgatcctagcaccttgggaggcctcggcgggttgatcacttaaggctggtctcaaacccctgacctcgtgatccgcccacctcagcctcccaaagtgctgggattacatgcatgagccaccccacctggcactgtttcactttc

SEQ ID NO: 214646 - DNA, 452 bp, Homo sapiens
aggaaaaagaacttggaagacactgcttcattatgataccttggtaataaatgcagaggatctaaaaaggtgatgaatttcaagagaaagagtatttacattctcaaagtagttctggaacaaaagctaaataaacctcacatagccatatcctaggatcacagctgaaataaaagggccagatgtggtggctcacacctgcaatcacagcactttgggagactgaggcaggaggatcacttgaggccagtagtttgaaacaagccttggcagcatggtgagaccccagctctatcaaaaaattaaaaaaattagccaggtgtggtggccaatctggaggccaacgcaggaggatcacttgagcccaggagttggaggctgtagtgagctatgattgtgccactgccctgggcaacagagggagactcggtctctaaaaataatgattgact

SEQ ID NO: 214647 - DNA, 1401 bp, Homo sapiens
agaaagaccttatgagtgtagtgaatgtgggaaattttttagagatagctacaaactcattattcatcagagagttcatactggagaaaagccttatgaatgcagcaactgtgggaagtttcttagataccgctctacattcattaaacatcataaagtttgcactggggagaagcctcatgagtgcagtaaatgtagggaattgtttaggactaaatcgagccttattatacatcagcagtctcacactggagaaagtccttttaagttaagggaatgtgggaaagacttcaacaaatgtaatactggtcagcgccaaaaaactcacactggagaaaggtcttatgagtgtggtgaatccagcaaagtgtttaaatacaactccagcctcattaaacatcagataattcatactggaaaaaggccttagtggagtgaatgcaggaaagtcaccaaaactgtcacctcattcagcaccaaaaggttcacatcggaccaagaacctattaatatatgtaaatctaatgttgaaagagttcagatggaaatctgcgaggatttcctgctgggaactacattaaaaacatttatgtccaggcgtggtggctcacgcctgtaatcccagcactttgggaggcagaggtgggtggatcacctgaggtcaggagtttgagaccagccgggccaacatggtgaagccccatctctactaaaaatacaaaaattagctgggcatggtggcaggtgcctgtaatcccagctattcaggggactgaggcagggagcatcacttgaacctgggaggcggaggttgcagtgaactgagattgttccattgcactccagcctgggtgacagggcgagactctgtctcaaaaagaaaaaaattataattgtggcaaattacaggtaacttaaaatctaccatcttaacccatatttaactgtactgttcagtagtgttaagtcattcgcattgttgtcaattaatatccagaagttttttcaacttaatgaaactaaaacattataccctttaaaccaggggtccacaacccccaggctgcaaactggtaccagtctgtggcctgttaggaaccgggccagcatcactacctgagcttcacctcctgtcagatgagcagcattagattctcatagcagcctgagccctattgtgaactgtgcctgtgagggatctaggttgtgtgctccttatgagaatctaactaatacctgatgatctgaggtgggacagttttattctgaaactgtctgccccctcctctgtccctgatgcgtggaaaaattggcttccatgaaaccagtccctggtgccaaagaggttggggaccgctgctttaaactactcctcttcctcattccctacgccaaccagcc

SEQ ID NO: 214648 - DNA, 455 bp, Homo sapiens
ctaaaccaaagggaatatcagtgtatctagtacacagcagaatgaatgaaaaaagacccataccaagatacagcatcataaaatttcggagagaaaaagttcctaaatcattccaaagagaataaacgggtcacatgcaaatgaatcaaaatcagaaagaaatacaactcagtggccacactagatgccagaaaactatggcagaaatctttcaaaagtatataattattttaaacctagaatgtaatacatagccagacatgtaggagggtggaataaagatattttcagacacatagaacccaaaacattttatttcatgcagtagggatgaagaagttaatagaagttgtgttgcagcaaaacaaaggagtaaatcaagacagaaagcgatttgagattcaggatactaggagtccaacacaggggaatagtgacaattattaatttctaga

SEQ ID NO: 214649 - DNA, 276 bp, Homo sapiens
ggatggagagagaagaagagagagagatgtctggagagatactgcagaaaccaatactgctgttttgggagtgaagaaatcgaaaagctgagtgcgagatgtaagaagaagatttacattgcattatctttctgttctatttgaatttgaatttttctttctttttttttttttttttttttttgagacggagtctggctctgtcgcccaggctggagtgcagtggcgcgatctcggctcactgcaagctccgcctcccgggttcacgccattctc

SEQ ID NO: 214650 - DNA, 1236 bp, Homo sapiens
  misc_feature (173)..(173): n is a, c, g, or t
gccgaggtcgggccattgtactccagcctgggcaacaagagcgaaaccctgtctcaaaaacaataataataataataataataataataataatatcaatagtaattgtgccaagcgtggtggctcacacccgtaatcccaggacttgaggaggcagaggcaggaggattgcntgagtccaggagttcaagaccaatcctggcaacatagcaagacccatctctgaaaaaaatttaaaaattagctggatatggtggtgtgcccctgtagttccaggtacttgggaagctaaggtggaaggatcacttgatctcaggaggaatacctgagccatggttgtgccactgcactcctaggtgacagagcaagacctgtctcaaaaaaaaaaaaaaaaaaattgtaacacgacttttgcagctatacaaaatatttaaaatctcaagtattcaccctagatagagttattatctaagcattttatcttatccatcttaataattgcaaatatgaaatctagatctttattcctatgttacttttgggaaatctgttaacatttttgagccttacttttcctgtttgtgacatgaagggtgtggggatgacagagatggcattgttagatgggttaaataaaacaatgtatataaagtggccaataaagagcttggcacacaatgggatgccaaacagatgttaaaatatgtactcatagattttagaattagatgtttaacagatgctattattaaaattcttcattttccaaaggctgtgccttttgtattcttgtgtaattaccccttggaaagccttgagtaaagataccagatgtagtgtaatttcattaatgaaggagagtaaaatagcatagattataacaagaggacaaaactgaagagctcattccagaaactacctggaatagtgaatagaggatggcagagccaagcaacctggggtttttaattctgtcatttactggctattgtgacattgagcaagtggcttaatgttcccatcttatttataaaatgagcttaataatccctcttctgttttgtttttgatgatttgagatagcatttgtaaagcttagtacagtatctggcacttagtaggcattcaatggccaaaaaatatatgaaaaaatgctcaacatcactaatgatcagagaaatgcaaatcaaaaccacaatgcagtaccaccttactcctgcaagaatggccgtaatc

SEQ ID NO: 214651 - DNA, 569 bp, Homo sapiens
taagaaaaacagaagccacaggaaaaagggagctccggaaacaacatacggtgcaaaaccctttaagtttcagctgctcccagttagaggacactcaactgctccaggcaagagcccgacaaggggccagttgaccagggaattaatgagcaacaggaacacgactcccttgggaatgttctctgcaaaccagggacatagacggctccagggaccagctgcccctctctcccctacattggcctctttttcttcctgtccttatttcctcctgcccactcccctcctcttctcactgttgcttcctcctgtcccattatttccttcttctcctttgtcagttctttagtcctcttaggggacatccctcaagcattgcagactgtgtgccatttaaggccaaatacatccctgtctaagacaaagagaagaataattagttacaacgggctgggcatgatggctcatgcctgtaatcccagcactttcggaggccaaggtgggtggatcacctgaggtcagaagttcgagaccagcctggccaacatggtaaaactccgtctctagta

SEQ ID NO: 214652 - DNA, 397 bp, Homo sapiens
cctgtgtagaatcaaatatattagaacttagtcttgttacttggtctgaattggaaacatttccagtgcctaccagttgcacacatcattatccactcataattagttgtttaatctgaaaagagcaagttctgctccatcacctaacatctgttcacttttactcttagctctgttcaaccaaatcccattattgtcaggagaggctctggcagacttgtatcatttacgaatggtttctatttctttgtagatttctaattctttgttctcgtagctgctacattctctgataataaataacattatgcagttatttttcggaacttgtgcttgttttcaaaataacaagactaagaactaaagatttatttgtctgaagtcacacagtgcctca

SEQ ID NO: 214653 - DNA, 997 bp, Homo sapiens
gtaaatcaaccagacgttctgtcattcaccagcaatatctctccatagtattctacacccatgtgccttcatgaaatatttcattatgctggtggaagaaatattcaaatgaatgtgctttttcagggatggtgacaccagaatgttttaaatctgttcattaccacaacaaggataaatggcgtttctgccaaagacttttgataacgggtgcagtaatgcatgccagcactttctgaaattaaaggttctaccctgagaggtttcacatgcttacccaggaatgctccttgaaaagataatctcctcagacataagcctggccacagaaaagtctctctaaggtcagcagtttctagagtgacgaagtgagaattcgattcttatctgttcacagactctacaaatctcaaaacaccttcctgaagaacaccctgggggaaaaatacaaaaaacctcatggatttagccatagatcatatatattttgaattgtcactctttcactcaacaaataaatatctcctatgtgccaaatcatgagctagaggttggaacagcacattgcatagagaacttggtccctagcctgagggattcagaatcttgggcaccatcatttctgttttcatcattgttgtcatcagtgtcttttgagacattcttattttgatctcctttgatttttatatattatgattatttccaatataattttaaaataagaattttatacttatggaaaaatatatttcatctaatttgaaaaaataaggaaacagtgctttgctttccctagccttccttctcatttactgtaagataataatttttctttttcagggttcgtttcaattttttgcaaaggatttagcaatgaaacactaaaatctcaggcattttcattaagctcattttttactttcctcatatatagcctatatgctttatttaatctttattctttacattaaattaaaattatttttaaaatgac

SEQ ID NO: 214654 - DNA, 1097 bp, Homo sapiens
gtaaatcaaccagacgttctgtcattcaccagcaatatctctccatagtattctacacccatgtgccttcatgaaatatttcattatgctggtggaagaaatattcaaatgaatgtgctttttcagggatggtgacaccagaatgttttaaatctgttcattaccacaacaaggataaatggcgtttctgccaaagacttttgataacgggtgcagtaatgcatgccagcactttctgaaattaaaggttctaccctgagaggtttcacatgcttacccaggaatgctccttgaaaagataatctcctcagacataagcctggccacagaaaagtctctctaaggtcagcagtttctagagtgacgaagtgagaattcgattcttatctgttcacagactctacaaatctcaaaacaccttcctgaagaacaccctgggggaaaaatacaaaaaacctcatggatttagccatagatcatatatattttgaattgtcactctttcactcaacaaataaatatctcctatgtgccaaatcatgagctagaggttggaacagcacattgcatagagaacttggtccctagcctgagggattcagaatcttgggcaccatggtgtcagatttcattaatggtgggaacagtagctaattgagacaggtgtatatgtgattcacaatgaatttctataatatgggtgtatggccaatttatttttgaattaaaaatacataactgtgggagagtataatcgatactgtatcaaagaaaaaaatagttttggctgcatgggatgagaagagaggtttttgtagcattatagtcatattaaggtatattatgaggaggtcctataatgatttgtaggactcggaggatatgcttttatgtttaatatagtggattttcaaaggagccatatgggtataatccaatgcgtggataatagagaaaaatataattactaggtggccaatgagctccgtctttttgtcgttacttgtggcattctactgatctgttccggcttggaatgttatagatttgttttaattcatggtggacactaaaaaacagggggctcgctatgcccg

SEQ ID NO: 214655 - DNA, 187 bp, Homo sapiens
aggttccggtgccagcgtcccgtttgttctgcctacctgtcaagcgcaggatgccagtttagaggagactgacattgcttatgaaatcagatgtacaccatgcacccccggcaccctgatacatgtgcctttgtcctttttaaaaatctggttaataaaaatgcatacgttttcatgtctcattgaa

SEQ ID NO: 214656 - DNA, 560 bp, Homo sapiens
aagtactttagaacaaggcctgtttcttttctgccatccaatgagagcagagaatctccaatgaaactgactagatttatgaatgttttttatatgtagagaggggcagaaacatgttcattttcccatgaaggaacaagtcccaagggtttatcatctgcctgaaggcactgctaacgaatttgtcaaatcctttatccagcacagctttaccaagcagctgcacagtcaggcctttgcacttctcattctcataggtccagtttaagatctcattcagtcctgaactgcttcggtcctttgcattcctgctgtcttggcctccacctagaccaagtcggcagtctccctacattaccctacattcagctgcatcctatgctccaaggcctttcaccaggggccagaaatgctcccacaaccctcaatggtctcactacaacagttccgaatcttattccaaatgctatagtatctgaaacggttcaccaatagggataatgtttctccaactggagaccttcaataaaacacttcaataggtgctttaatttctgtca

SEQ ID NO: 214657 - DNA, 511 bp, Homo sapiens
aatacaggtatgctccaacttaatcaaatattcaaatttcatatacaagaaagactagccagtgatgattccctttgtcaaagaatgtgccattgaatgtctgtaaatagctcatctatgacagaatatggcttctccataaaatcatggatgtctagtaactgctttcttcttcttttttcaattaacaaatggtattgccaatagtatcacattgagttgctatcttttcttctgaagatgccaaagctgccacatctgtgacctttttccatactttttcagtggatttggtagtttaacacctctttaccacaatgttatttctttttagtgataggggaactgagggagtaatagacttgacagcaatcacaaaacgagattatagcaaaactggagcttactcttgatctgtccaactaggaaatgtagtttaaaaaaaacttcatcctgactggccacatataatatttaaaaagaaaaataaagaagtaatatagtcattaat

SEQ ID NO: 214658 - DNA, 381 bp, Homo sapiens
ctgaactgcaagccatctctaagacttacactctaaggggaaagaaaaaggaaaaaaaatggttgggaatactgagtttgagattttgaagtcccagcctgatacggcttggctgtgtccccacacaaatctcatcttgaattgtagctcccctaatccccatatgttgtgggagggacctggtgggaggtaactggatcacgggggtggatctttcccatgctgttctcatgatggtgaataagtctcatgagatctgatggatgtataaagaggagttcccctgcacaagtcctctcttgcctgccatgatgtaagaagtctttttgctcttccttcatcttccaccatgattatgaggcctccccagccacgtggaac

SEQ ID NO: 214659 - DNA, 374 bp, Homo sapiens
tttttttgtctgcttataatctatcaataactgacaggtatgcttcaaaactcccattatgacagtgagtgtatgtctttctccttatggttctgccaatctttgttttctgtgtttggaagctatgttatcaggagcatacaaattcaaaattgttttctcttcctggtgtactaaacagtacaaatacttatgacctctaacctcacgcagggcttttgctctgaagtctctagtcaggaggaaggagtctaatatgactaaaactacctatcagtttttgttcggtaatgtatcttaaacagctctcctgaggtataactctcatacgataaactttatatatttcaggccgggtgcagtggctcacgcct

SEQ ID NO: 214660 - DNA, 506 bp, Homo sapiens
ctcctgagtagctgggactatgggcatgccccaccacacccagctaattttgtatttttagtagagacagcgtttcgccatgttggccagtctgatcttgaactcctgattttaagtgatccacctgcctcagcctcccaaagtgctgggattacaggtgtgagccactgcgcctggccaattctgaacctttctattagatacttcaaccttctgccacttgtctcccaccctcccaatcccttttacttgtttattttttagaaaaccatagcacacaccattttctaatatatacacgaattacttaaagtttaatgattgtttccttgtttgtctctgcagagtataagccccacaagggcaggaatctttgtcagtgctgttatctgatttatcccaaatgcctgggacagtatcttacacatagtaggttcccaataaatgtgtgtattaggctatgagctgggatgtttttggctctcttcccataatatctgagttat

SEQ ID NO: 214661 - DNA, 373 bp, Homo sapiens
ttaagtgagtaaaatggattcatataggaatagaatatggtagaatatgggttagtttagtaaagcatttttttttagtgtaaagttaaacttatattccttgaagttctaataagattttcaaggcctcttctagtttaattcttcttattgattagagtccgagtttagatgaataccgtttgtaaaaatgataccgtattctaagtattaacttttccatctccccaaatgccaaaaactgctctgttccctctctgtgtcactgctgaacctgaactttgacccttctcgtattttccctcctgcttaccttcagagtagctgggactaaagccatgtgccaccacacctagctcatttttaaattaaa

SEQ ID NO: 214662 - DNA, 242 bp, Homo sapiens
gaaaggaaatctctgaatgtttgtgaaggtgttgacccatggatactaaggtatgtgaaaataactcacacatctcaggtgtttaatgaggatcaataacaatttgtgggcccatcagctctacagtcctatcacctcaaatcacacacaggaaccctgcttctgaaaagtggcacttgggagagagaatggcagagtgaaatccaattagcaagatctgcaaaagaggcacatgtgccaga

SEQ ID NO: 214663 - DNA, 625 bp, Homo sapiens
agaggttcttgtaacatactacatgcattagatggctgtgattctgaatttcagatactgatgtgtttaggctgcctcagacagggacaactctcgttagaatactaccgagggaactgtaatagaaatttactttacttaatgatggctacctatctcccaagtcccaagtcatactcattagaaataagtatcttgagtgcaaagctagcattctagttcagaaccagaacacaggagctatacagaactagcctacttagttatatctctatataagctatatatctatttatatttttagtattttttcattacaaaaaaagtgttttaagacatctcaggctaaactagaataaagacaattaagtgtttcacaagtttattgtaatgagaaactcactatatgtcattcagtatttattatatatattttatttgtaagtgtgtctatgtttactatttctacgttactctatttttaatagaaaatacatttctcaatgctttttaattgctttgattaataagtatataatagtgccatccaaatattaacattcattacagctaatatataaacctgaactgattgggacacactagaatgtctataccatgtgac

SEQ ID NO: 214664 - DNA, 501 bp, Homo sapiens
agctgccacccccggccaaaataaaatgtaagcctttctaatcagtgatcaacttccaaattctcaacttcatcctgtctggtacatcatttgccatcaacagcacaaagcctgccctgctttcccaaacacttcccctgcttagaatttattcatcatcatttctcttgtccttcaaaagcccatctcctctgaggcctatgagacagagctacaaaacctgctattcctgattactacagttatcttgtcatctccaaactgcatcctttcatcccttggagatcttagtgcctgattcattaactactttcactccactactattccttgatcactgccagtgagttcaacatccacaggccagttccttgacccctgcatttccgacaatcttttcttcaacagaccttagccactcaattccatagtcataccgttgaccttataattgccaataaaatcaccacttccagactacaactgtaagccttccaccct

SEQ ID NO: 214665 - DNA, 385 bp, Homo sapiens
ccatgctacataaatattacaatcattatgtatcagttaaaaaaaattaagtaataaaaaatttaaatgaagtattcaagaagaagaaaaatgacataaagaaacttataaacaaagaatggaaaggcatcagaaaataaatcaaggaaggtaaaatataatctttaatattttaatacataattgatttaagggataatatacagttaaagcaatgaattgggtgcttatagtatatataaaagtgaaattaatggtagcaatttcacaaagaggaaaaaaattggaacaattccattatatttgtgctaaacataacgtgacctgatactatttgaaggaagaaatacaatatttaaaaatatagtagaccccacaacagcca

SEQ ID NO: 214666 - DNA, 438 bp, Homo sapiens
tactctttatgaagcagggaaatacaggcacagatgtcaacttaatgtgtgaaagaaataccagaatgataaactagaaactattgaaactggtttcttacagggaatacatgagaatggggtagaaagattgggagtaatgggaataagatagtagggatagggagcagcacttctctgactatagttttttatatgactttgactctcagaaccctggtaattttttacgtagtctccagaaataacataaaataacttagatgttggcaagtgtggagaaaggagcccaaaatgtaatgcaagcactaacagatgaacaatattaacttgatttatgaagtcaatgaataacactgacttgagtggggaagaaaagaactaagtaactttggaaaacagtattttgattaggcattctaaagctaaacacaagac

SEQ ID NO: 214667 - DNA, 435 bp, Homo sapiens
taaaattctagcatgctctctttcctgtcagaattaactgagttggattccctacaaaatctagtaccttagtattacttaacaggaaacttctcctaaggaacttgtatagccagagcaaggagccataagaaatggaacagaaatgtcagctttgaatttttgtgtcatagtaagctatctaccacaaatcttgccagaggaaggaggaaagaccagcctctctctttcatttgttttcttccattatttgtatgagccactaagaatgactaaatactcccagtatctgaaagtcattggagattactattgattgtcaagtatttaggaatgattccattcacctttatataagaatgggacagcagcctgactggagaattttcttccttataagtgatccagaaggtatccttattatcttctatttta

SEQ ID NO: 214668 - DNA, 338 bp, Homo sapiens
gatgtgtttaaagagctgtgtccgtgtgattggagcgtgaggtaccatagggggtgttgtgagagatgagaggtaggccccaggggaatcaagatactgagggaatttttatgcctggctaaggagttttcaattttatctgacaaccactgggtgtaattttatccaaaggagctgcattatcagatgtacgctctgaaagatttctctggaggccatgttgaggctggattgcaggtccgcagggatgggaaggagaccagttagtaagagaaaagataggttttagaagattaagtccctgggatggccagctgatgggaggagaaataaaaaag

SEQ ID NO: 214669 - DNA, 518 bp, Homo sapiens
agagtccctcagttcttcctaagcagtctgtacagctgagagcaaggtcagcagtttctctgtcaggcctttgacttcattcatcagactggatgcttattaaacatctactacatgcaaagttctgtaccagatgaagttgaaggcaggttacactgccccggtgtggcttataattgacctggaaatatttccagagttaggtaacagacagaataccttcctcattctcagctgttattttggaacagagaactttacaaaagctttgtctttgtaaataataaaatgttacacactgataaaaagtattccagaaaccaaacacataacaccattttttaattttagaaaactgccattgctcttacttagaatgccagtgttttctgaaggttcaaaacactgaagttacagacgattaaaacattgcactgttacaactgctgctttccacatggttcttgttcatacagttttttagagcaaagtaaaaatgttctcttgagcatagcaaa

SEQ ID NO: 214670 - DNA, 272 bp, Homo sapiens
ttctcaaattagtaagaaattatttctgtaataagggtaagcttcaatcacagatgagttttcgaatttgaaaattcaaaatacatactacatgtagaattcttataaattaatttaaaatatttaacaccacagtagaaaatggaacaacttggctgggcgtggtgcctcacacctataatcccagtactttgtgaggccaaggcgggaagattgccaacagccaggagtttgagacaaggctgggcaatatagcgagaccccatctctac

SEQ ID NO: 214671 - DNA, 518 bp, Homo sapiens
agcactgtgatacagagaaagtccagctcaccaccaagatggctactgagccgctggtgggcgcggagtgtggtgtctgcagcgtgaacatgccgggcaaaggaataatgcatgtcagggataaggtggagaaggactgtgccaggcttcatcactctactcagaatggcacacagtttagaatttataaatgatttatttctggagtgatccactgcatattttcagacggtggttgatcgtggataactgaaagcaaaacctgactgaaaggggctgctgtgttcatgtcagcaatgctgatgccctcgaggccagaagagtaaccaccaatctggtacctgagcacctggctgtaagtccaccctccatttctggccagggccgaggaattctctcttcttctctttattttcctcttgatttgagaaggtcaactctgagcatgctctaaacacaaatcagcatctctacacttcttcggcaccaggtgttgctactgtctttctgattagaaa

SEQ ID NO: 214672 - DNA, 650 bp, Homo sapiens
ggctctgaccagcaccatggcagttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcatctgttctgtgttggttttactaaaaaacgcaacaatcagatacagaagacctcttatgctcagcaccaacaggtccgccaaatccagaagaagatgatggaaatcatgacctgagaggtgcacgacaatgacttgaagaagtcgtcaacaaattgattccagacagcattggaaaagacatagaaaaggcttgccaatctatttatcctctccatgatgtcttcgt

SEQ ID NO: 214673 - DNA, 428 bp, Homo sapiens
ccatcttttcaggggagattcgttgagtgtcctctaccatttgacttcgtaaacctttgtttcccaatgtgtggcctgggtgctaactatactagaaccatcctgggaatgcctattaaaaattcaggtattaagccaggcatggtggctcttgccttcagtcccagcactttgggagaccaaggcaggtggatggatcacttgaggacaagagttcgaaaatagcctggccaacaaagtgaacgtctctactaaaaatacaaaaattagtgggacatggtagcgtatatctgtagtgccagctacttgggaggctgaggcacaaggatctcttgagcccgggaggcagaggttgcagtgagtcaagatcgtgccactgcattccagcttgggtaactgagagatcctgtctcaaaacaaaacaaaac

SEQ ID NO: 214674 - DNA, 476 bp, Homo sapiens
gaggtgtaatctagcccattacctatttttgtaaatatagttttactgggatataaccaggtccatttctcttaccaggtatctgcggctgttgtactgaaatggcagagttcagtagttgtgacagagactgtattgacaacagactcttaaatatgtcctatctggccctttatagaaaaagtttgctggctgggcgaggtggctcatgcctgtaatcctagcactttgggaggccgaggcgggtgtatcacgaggtcaggagatcgagaccatcctggctaacacggtgaaaccccgtctctactaaaagtacaaaaaattagccgggcgtggtggtgggcgcctgtagtcccagctacttgggaggctgaggcgggagaatggcgtgaacctgggaggcggagcttgcagtgagccaagatcgctccactgcactccagcctgggtgacagagcgagactccatctcacaaa

SEQ ID NO: 214675 - DNA, 335 bp, Homo sapiens
ctgtgctgctgtcatgacagtgagtctcaaggtctgatgtgtattataagggggagttttcatacacaaactctctttgcctgctgccatccatgtaagacatgacttgctcctctttgccttccaccatgattgtgagacttccccagccacgtggaactgtaagtcccattaaacctctttcttttgtaaattgcccagtctctggtttgtctttatcatacaggtagggggccttaggtaggaaaaagcaatacagtaaataatcttcctctttgtagtggtaagccacataaaatggagaaacccttttgccgaaaacagctacaaatgcc

SEQ ID NO: 214676 - DNA, 402 bp, Homo sapiens
atgtttctgagaggaaagatgtaggtcaatgttcataaagatgggggcaggaggtgagagaaaagtttaaaattaaaattctggttggtattgaaaataataaaaggggctgggtatggtggatcacacctgtaatcccggcactttgggagaccgaggcaggtggatcatttgagttcagaagttcaagaccagcctggccaacatggtgaaaccctgtctccactaaaaacacaaaaattggctggtggtagtggcacacctctgtaatccccggtactcaggaggctgaggcaggaaaattgcttgagcctgggaggcggaagttgcggtaagccaagatcgtgccactgcactccagcctgggtgacagcgagattccgtctcaaaaaacaaacaaac

SEQ ID NO: 214677 - DNA, 414 bp, Homo sapiens
actgagctatgattgccactgcacttcagcctgggagacagaggaagaccctgtatctgttccccccgaaatttagcgattgtattcctttacatcatacagtagagagttgatgtttgtgttcactccactaacctcattccacgttcccctgccagtatacttcagaatatctcagatccaattcaaaatttcatcttaaaaggtagaattattttcacagtttcacagtttagttttgattactgaaagcatttctttcattttgtctaattgaacaaatttatgcaaagaattggggacttattcctcattagtattgttcatctacaggtggaaataagttcaagtatgtgttgcagtattaattaaaggcaaagtgacctacttgtattatattctgaataaataatg

SEQ ID NO: 214678 - DNA, 509 bp, Homo sapiens
tgtagaatggggatgataatgatatctatctgagagggctagtgtacagttcaaatgtgagctacatctgtgagtggcttgccaataatatagtgctaaaggaatatgttaaaataattggttgagaggccattaggctgaggcagctccagcactctgggttctatctaagcaagttgaaacctgattcactggaaatagtaacacaaaacttaagcttaaccagtcagaagctgccaaataagctctcaataggaactttccacttgaatgattcaaataaggccactgctccacttcaaccagtgaaatattttctttgccttgtttccacattcaccctgtaaaagcctgtaactcatactcctgttggtggaacccccaaccacctgtggtctggaattgcctgatttataaattgctgttagctcaaagaaactgtttgtattttaatgtgcttcagtttatcttttaacagtaaaatataatctttaatattttactatgta

SEQ ID NO: 214679 - DNA, 497 bp, Homo sapiens
ggaaatcgcagctgcctacatccacatgatgcccaacgccgttccccccggggaccgggaggtggacaacgatgaggagaaggagagtcctttcgatcgcatgtcccagatctatcagacatccccagatggtgaccctgttgcagagtctgtctgagagctggactgcgagggggagatttctttagacaaaataacacctttcaccccaaatggattccattaaactgcattaagaaaccccctcatggatctgcataaccacacagacattgacaagcatgcacacacaagcaaatacatggctttccagtactgctccctttatcatgtgtttctgtgtagtagctggtgtgcttagaaacctcaccccattgattgatagttcaaagaattggcagaagcagttgcaataaactcagtcaaatgtacccagcctaccagagatggaacaatgatcctgtgagagaagagagtatggtgctggctccttaaaa

SEQ ID NO: 214680 - DNA, 128 bp, Homo sapiens
cagtatatggagctccaagaatatgaaacaaacttgagattccataatacatcatgaatctttgatggtagatttaattagcagtcagcagtaacagtgttttagcttgaacctctgggctataagat

SEQ ID NO: 214681 - DNA, 389 bp, Homo sapiens
ggaacacagatgagctgggaagaggctgatactctcagatgccgtggagttgggagtgtgaggacccgggaaggactgggatcctgcagagcctggccttgcaggccctgctggggagtgtgttcagtcctggagacatgggagctgtaggatattttgaaccaggagggtttcagaattcctcttcaaggccatctgggtacgtggactgcaaagcacctggcagctccctgtgcccacgaagttactgtgctccatgttgtgcatggctcttctcctcacctgtcatccaggggtgtcataggtatgctgccctgttcctcagactgtaaactggcttcttgattaccctcatggctccttttccttcacatgagattttatggttt

SEQ ID NO: 214682 - DNA, 384 bp, Homo sapiens
agctaaaaggaaaagtcaagctggaaactgctcagggcaaacctgccttccattctatgcaaagtcaccgtctgttcactaagacagatgtatattctgattgcttcttttggaaagacttatcagaaactcaaatgaatgcaaccatttttctctcagctacttgtgacctggaagccagttccctgcttctgttgtccccatctttctggaagaagctaatatacttcttacatatattgattgatgtctcatatctctctacaatgtataaaactaagctgttcccctaccaacttgggcacatgtcatcaggacttcctgaggttgtgtcatggatgtacgtcctaaatcttggcaaaataaactttctaaattaaacca

SEQ ID NO: 214683 - DNA, 182 bp, Homo sapiens
ctgggttagtgccaaggcatgttcactgcattacacaaattgattagagaagtcatagtccctcacacttgctaagctgacgattcagcctgtcaaggtgccattgtgcagtcgggtgggaaggtcaccttggccataaatcctggaagccacctggctgagagctctctgtaaacagcttt

SEQ ID NO: 214684 - DNA, 238 bp, Homo sapiens
tggtgtcaatgaattttatgaaatacttaatcattggattcataagtccaggtgaagcaccacagagtatgtttacaaaatggcaataggcatgcgcatgtatatctttttttgttaacacctttgttgactttgtggtttggcaaaggtgaccaaccctgcttttattctctatcaccttacatacactcatgtaattctaacttctttttattccctaaaagtattcacttaaata

SEQ ID NO: 214685 - DNA, 359 bp, Homo sapiens
ttttttttttttgagagagtctctgtcgcccaggctggagtgcagtggcacaatctcggctcactgcaacctccacctctggggttcaagcagttctcctccctcagcctcccaagtagctgggattacaggtgtgcaccaccacacctggctaatttttgtatttttggtagagacggggtttcaccatgttggccaggctggcctgagactcctgacctcaggcgatccggccatctcgacctcccaaagtgctgggattacaggcgtgagccaccacacccagcctcctcaccaacttttgatattactagtttttttcttttcagcccttctgtcgtcttctcgcccccgtatag

SEQ ID NO: 214686 - DNA, 417 bp, Homo sapiens
ggcctcatcctcattcttcaaagccaggcatgtagcatcttccggctcctctctctcgctctgaccttcctgcctctctgttacaaggatccacttttgtggctaaaatgggtccatcctccccagcctgaatgtgaagaccccctcctccacggcaccccattgcccaggacaaggatggggcccatcactgctgcccagaggatagggagaccctctccaggtttcctgggaaggcatcaagatgttcgcaaggctcaaagaaaaaagaaatggctgggcatggtggctcatgcctgtgatccgagctctttgggagaccaaggcaggagaaccacttgagcccaggagtttgaaaccagcttggacagtgatgggcaaaccccatctctacaaaaaataaaaaagttagctgga

SEQ ID NO: 214687 - DNA, 434 bp, Homo sapiens
aggggaacagaaaaggggagaggtagacttgaaatggattctggataaagtcttaaaacctgcaacttgtttttcatgctaacactgcgtggcccagattagtcttaaatgttcattcccctttcctggtggcaaggagaaagttccctaagtcagctcgagcctctggctcgtcctcattgcctctgggcaaaccttaaggtcagtgtttccttgaaactagataaactgaccctgcagtgcccagcccggccccgcgggcgccccgcgtgacggcgctcgggcggcaggaccggcctggggacgcgcggggcggcgcggttgcccttttgaatgcctcctgcggctcggagcgctggcgggcgctggagtgtgagtgaatgtagccccgcggagccaatgagctgggaccggatgcgatatatcctctggga

SEQ ID NO: 214688 - DNA, 637 bp, Homo sapiens
cctcaagtgatctgcccaccttggcctcccaaagtgctaggattacaggcgtgaaccatcgcacctggccggatgtttatattttactattctgaaagagttttccatacacttaagtatgaaatataagccctttgctattatgttacagttgcgtatgtgtactcaatttaccttaatttttgcccagtattttttatggaagtacaattgttttataaacagttaattagaattgcttaattctatcaattttttgttcagcgtttctatctttgatatcatactataaagtcttacctaagtcaaatttcttctaatgctttatcatttctttttaatacattttatctaaaaattactttagtgtaaggtatttgataggaatctaaatttgttttttaaatggttatataatttactgactattacttttcaggattggacgtggtgactctgacgttcgtatgggctgatgcctgaacgatactagccaactttttttttttttttttttttgagacggattttcactccagccagggtgacagagcgaggcaccatctcataataaaacgaatatgacagctattctccctggttcggccccccacccccagataccagctgcttttgt

SEQ ID NO: 214689 - DNA, 141 bp, Homo sapiens
tgcctgtctctctcactctctctctctgtgtgtctctctctctctttctgtttctctctgtctctctgtccgtctctgtctttctctgtctgtctctttgtctgtctgtctttgtctttccttctctctgtctctgtctct

SEQ ID NO: 214690 - DNA, 457 bp, Homo sapiens
acaagagcgaaactcagtcaagaaggagggagggaggaagggagggagggagagaaggaaggagggagggaagggaaggaaggctaattcaaaactagtacttatcatcatggccacatctgccaggcaccgatcccacttcctgtcaagcctccactccaacatctccccacccatggctccctatctcatttaatttattgaatattacactgaaagtgaaaaacagaatggttttatgggtactcaaagtatggtttctgctgactgcatcacttttgcaccattgtaaagttgaaaaattgttaagttgaaccatcataagtcacagactgtattttattccttttgatgctatttcaaatggaattgttttgtgtattttatttttggaaagttcattgctagtgaatagaaataaaattgacttatgttgctcttgtattcttcaaaaaag

SEQ ID NO: 214691 - DNA, 461 bp, Homo sapiens
cagaccctaccgggtgtcccccctaacacagggtcccatgtgaggttgcagctcccatgccaccacccccagtgtccttgagggcgagttgggttgcccttctggaggccattagtgcttgtcacagcagcgtgttgggagatggagtctgagggccgtgatctgtgctccctctgggagtgtggtctggaagggacagaggaaagaggagcagaaggagccagaaaccaagcaggcgcggtggctcatgtctgggattataggcgtgagccaccacgccaggccagacctggctaattaaaaaaaaaaatactcccaaagcactgggctgacaggtgtgacctgtttaattcttttgtttgtttctttacttcttattgtctgcctctcttcagaagctaattcccattagagcaggtgctgtattctttgccaccacgccaggccagacctggctaatt

SEQ ID NO: 214692 - DNA, 456 bp, Homo sapiens
actgccacttacctattcacttcttgtgctggttagacataagttcaccatagtgcttcttttaatgttttattttctttctaaagaaaaaagtacagaaaaaatgaggtttaagttcattaaacagcccaaatgttcatcaacaagtttatagttcagataaacttctagttaatgccaactaatctatagtgacagaaagcagagcagtgaaatctgagtacagggcaggaaacaaaagagaggaaggaattagaaagtgtcatgagaaattcggggaagtgtatgtgtggtcattatgtttcatgggcgtttatatgtcaaaacttgttaaactgcacactttatatatgtgtagtttatatgtaaattacacttcaataaaactgtaaaaaataaaaatttataagttttatttttaagaaaaggagaccgccaacaaggtctcagaaagtg

SEQ ID NO: 214693 - DNA, 477 bp, Homo sapiens
cacactcccaccaacttccaggcccacctcaatatcctgatgtgatgctctccttagacctcttgtggttcttcagccaggagatggagagagtggggttgctaggagccaggcagtgaaagttggttgtggtggccagcatggctggcagtttcctgtccatccactggggcaaagtccaggaaggggtctctgctggtggaagcacacatgaaggccatagctgaggtgaggaacagagacccatctgaccagacccccgattcaagatcaccctgcccactccgagtctcatgtttttctcctgtgtagggagagtgttgacatttcaaggacatctacttgggctgaatgaggctcccaggagcttcaacacaatgtccccacccagtcatgctcagagctggcaatgtgtgcctttctattccctctgcttcccccaagtggctgctcctgctgagaggctggggttcttca

SEQ ID NO: 214694 - DNA, 331 bp, Homo sapiens
ccaagttttctgtaatgagtttacaaaatttttctgattgacaaaaataatgacctttttttaaatgcttgataccattctttctatgggatttgtctctgtccccatcccttttctcacccctctccccacaaaaagtagaaaattccacagatattattgttctgttactcatcagcatgtaaataacaagaggctttaagtatataaaatatggccaggagtatgcaatttgaacaggaaatggcgtgaaccgaggaggcagaacttgcagtgagccgagatcgctccactgcactccagcctaggggacagagtgagactccaactc

SEQ ID NO: 214695 - DNA, 502 bp, Homo sapiens
aacctgataccctgaaaatgactgggaaaaagatgaacagatccatattgggttattggctcccaaaataagaaagcaaaaaacaacatatgtccactgtcgaatagttcgtaccccaaaaaatctattgtgaagcctaagaaaactataagacaacattcccagcaaaattaaatatagtcaagtgaacattttatgatataaaacaaagaaattaaggaactgagaacaaagtggacaaacaggaagggctggaaagaagtgattgaactcagaaaatggaagaaaatgacagttatctgagaaatgaggagtaattacagggtgcccaagggagaatacacccgaaaaattaataagggacattaaagaaacaaaggaaaatgaagaggatgaaaataagataaagaattatttgaaaaagttagagataaaacagtggaaatggaagacagatccaaaaggcataacatttgtatatgtgtccttgaagaacaaaaac

SEQ ID NO: 214696 - DNA, 449 bp, Homo sapiens
tgccttgaattaggaattaaggcttttccgttctatgtgtcgtatcttttgtcaagactgggaatggtagggtttacttaaggcattgaggaagaccccagggggctagaactttgggcaaaataaggtcactgggggcaggtgatgaggatggggatgttagctgctattgcagttgctgagataaaacccagccaggtaggctgcagtaattagaagtaccacagactgtgtgacagatactagtcaaagaaaatagaatcaggcagatcagtgagagatcacgcgagtatgctagaaggctgttatgtgtagctataaagacttactacgggccaatatgcaaacatccacacagtcaggaagtctgagagcatcttgaggcttggcctcaaggacgaaaactcttccaaccctgaagctgaggttctcaaacttgagcacgtcag

SEQ ID NO: 214697 - DNA, 428 bp, Homo sapiens
ggtcacagaaaaggaggtcagacagatgttcccactggcctagaagaaggccaaaatccatgttgtgaactgcccacaggggccactcctggggtaaataactccaaaatcctctagttactgagagaggtccctggctaatacctagaaagataatggacactcacagtcctaaaactacaaggaaatgaattctgacaacaataagtgagtttagaagaagactccaagcccagatgagaacctcaggcctaggtgacatgttaatttcatcctaatgagaccctgagcagagaatccagtcacaaacactggacacttgacctccaaaaaaaaagtaagataaaaaatactgttgttttgtgcctctaagtttgtggtaatttgctatgcagtgagagaaaaataatacaattggaaagagatga

SEQ ID NO: 214698 - DNA, 413 bp, Homo sapiens
atgattcatgtcccagtgggatggagtgggaaggtgtaaaatttcatcatactcctcagactggcacataatttaaaacctaagtattatttatgtctggaagtctttatttaatatttcagatcacagttgaccttggaaagcaaaactgaagataaggaaagactactctattctcattgctgggcaaagtccctcatacttagtaagtgatgtctttccttaatgaagtcacagacctaattttatgttttagcccttccacttataagatatacatccaaaaaaaggacaaagcactccaaaggggaaatgtatctttttgtcaagtcagggaatacttagtaaggagaagacaatttgagttatcagtgtcaagagagaagttggattgcaggaacaaagttgatgcc

SEQ ID NO: 214699 - DNA, 429 bp, Homo sapiens
actggagagacgcctgtgacatcccagcaggtgccactggggaggccggggcagctgggtacttcagctctctctcttctgcgtctccaggccccctcagctgcagcagctcccccgattttacttagtccgtgttcctagggtcacattccctgaggcagcacctgtggcgcggcgtgcgttcctagtaaacacgcaccgagagcacggtgtgcgttcctagtaaacgtgcaccgagacaaggctggggcttgtgcttctggtcacctgcatcccaacgagccctgggaagatggtctggaaggaaagagtatgtgtttgtgatattagggagtgagagtcttggactcgagagatgttcgtttattcttggttaattttctgattgaatagaaagtcctaggtaggcatcaatttaaccgactaaaa

SEQ ID NO: 214700 - DNA, 415 bp, Homo sapiens
agaggagtttagttccaagtctaagtctgaaacaaagatgtcttcctgagacaaactccttcctatcttggggatcagatctccttagcaaagctaacaaattaggtgcgagattggaaattatggctcaggagccatgcagccagaagccacatgattcctaagctccccaactgtgcctgtatataagattattggtgtcaaacctaagattggtgttcaaggtatttttcagaccctgccttatgatggactagctggcacacccagaccggtaaactggctcatctggtcctgtggcccccactcagggactgactcagtgcagtaaacaagctctgacactgtgatttcatccccaacccaaccaatcagctttgcacattccctagccccttgcctgccaaactatcca

SEQ ID NO: 214701 - DNA, 565 bp, Homo sapiens
atgtggtaggagctttgcttttaagggaggagggctagagggcagattggatccagtcccagttctgtccctaaccagtggtggctccttggacagattattccctgaaaaagggggataccttgggtgactgccagagtctcctccagttctgacattctatgttccctgaataactactagacctaacttaccagtggccccctactgttttgtaggacttgccaagaccatttagtcattcagttaacacatacttattagcacctagtttgtacccatagatggtggtaaggaaaacacaatgggaactggatatgaggtgagcaaaaacagatgaagtccctgcccttcagtgttttcagtctagtaggggccacggatattatatttcattaattctgagactcatatttgaacatttgtcaagtcaggatgcatcttcaaattgacaggatattataatttaattggcagcatttgttttttattcatgccaaatagaaaaataatataatcaggattatacaaataactataaaattctaatggataattgccgaag

SEQ ID NO: 214702 - DNA, 1302 bp, Homo sapiens
ggcaaattcatatgctggagtttcatttttaaagcagttgaatcaacaaggtatgccttcattaattatatttattaggtgtttttaataatctgaggaatcttgtaaattgaatgctgtattacagtaaagtgaactttttttatttagacaaatgatctaacccagttaagcatgcgtagaagaaagcctggaagaaaaaaaacactaaaattttatagtagcatggttgtagtttttatctaccttgttttcaacagtgagaatgtattccttctgtaatcaactgatttagcttttctctatggcatttttgagaatttattcatttaaattgaatacacaataactacgtgtaaagtaaagctttgtgttctaagattgtgtctacacttagttttcatcctaaacatttagagaaattgattagaggaatgataataattatattaattgatttggacaattcagttagaggactaatttataattttttgtgctgctttataacttaacaaagcgtaacctatgaactaagctattattatcatcatttcaaattggaggatactgaggctcagaatttgggacttaggttttatagttaggaaattaaaaaaccaatataaattcatggttaaaaaaattcatacaatgctagtgaagtcttctttctgctttaggccctcatttgctttcccagaggcagccattcttgccagtttcttgtgtgaatttccagtaatagtctgtgtatatgcgaataaatatatatgtatactgtatatgtatattcttttgtgtaagctgtttattgtttcacagtttgttgttatattatttttagcttaactgatttaggagattgctctataacatcacatatagatctcccttattgttttcaaaacctcagggtatttctatatgtgaacttactgttatttattttactggccacctaatgctggacatttattttgttttcaatcttttgttacaactatgctgcagtggatactcttttacatgtttttgtgcacatgtgtgagcatatggattaatttctagtaggtgtaatttttgggccagaggatacttttaatctgcatagatactgctaatttggggtaggcatagtggctcaggcctataattccagtgctttgggaggctgaggcggaaggattgattgaagccaagagttcaaggcctgggtaacatagtgaaatccatctgggacaaaaaaaaaattttttttaattagctgggcatggtggtgtgtgcccgtagtcctagcag

SEQ ID NO: 214703 - DNA, 650 bp, Homo sapiens
ggcaaattcatatgctggagtttcatttttaaagcagttgaatcaacaaggtatgccttcattaattatatttattaggtgtttttaataatctgaggaatcttgtaaattgaatgctgtattacagtaaagtgaactttttttatttagacaaatgatctaacccagttaagcatgcgtagaagaaagcctggaagaaaaaaaacactaaaattttatagtagcatggttgtagtttttatctaccttgttttcaacagtgagaatgtattccttctgtaatcaactgatttagcttttctctatggcatttttgagaatttattcatttaaattgaatacacaataactacgtgtaaagtaaagctttgtgttctaagattgtgtctacacttagttttcatcctaaacatttagagaaattgattagaggaatgataataattatattaattgatttggacaattcagttagaggactaatttataattttttgtgctgctttataacttaacaaagcgtaacctatgaactaagctattattatcatcatttcaaattggaggatactgaggctcagaatttgggacttaggttttatagttaggaaattaaaaacccttttattcttgggaaaaaatctaccagg

SEQ ID NO: 214704 - DNA, 715 bp, Homo sapiens
tgctttcaagtatcacttaaccaatctgtatatggcttcatgtttggatgacacagagaatggtacaatgttccagaatactagatataatttgaattgagcaaattcacatgcaatccattttgataccatggatctaatttggtctaattctgtcctgtattgcctgcgacctcctcccctcccaccagttccaaagctaactggaggggtggagagactgtccaggcccctgcagggagacagaaagaggcagcaagcttggctctgtacaaaagtctgaaacccagcactttaggagactgaggcacagagagtgcttggagccaggagtttaagaccagcctgggcaacacagaaaaacccccatctctacaacaaaaatagaaacacttagctggcgatggtagcacatgcctgtagtccctctactatagaagctgaggcgtgaaggttactcgagcccaggagttctaggtcacagtgagctgtgattgcgccactgaactctagcctgggctatgaaggaagacttgtctcaaaaaaaaaaaaaaaaagtctgcacctggatcaggaggggagctggcacctagcaaacatctgttgactgactggcataaacatttatttataaaaaatttacttccaaagacatttccctctttgcttttagagatcaacttggaggctgaaatgacttcacaggagaaggctt

SEQ ID NO: 214705 - DNA, 431 bp, Homo sapiens
tcttactttgtaattaaaaatgaatgcactgcaagtaaaagaaaatggtgcagctctggaaagctgcacactaagctgttgacaatggggactaggctgagggttctgtcactttatacatacacactctggactgtttgaatttgtctcaagaggtacttttctttttcttttttttgagacagatctgggcaacaagagggaaattccgccttaaaaaaaaaaaaaagttttcccagcaccatttcttgaagagactatcctttccccagtgagtgttcttggcacctttgtcaaaaatcagttggctaagccggggcagtggcgcacacctgtaatcccagcactttgggcggctgaggtgggcggatcaccttaggtcaggggttcaaaaccagtctggccaacatggtgaaactccgactctacta

SEQ ID NO: 214706 - DNA, 580 bp, Homo sapiens
tgattcagtgccatcatcagcagaagcgagcagctgtgtgaaaccactgcttctctgagcctgggatgtgttaacgatatattctcagaagtaaataatccttttgctaacaagacgaaccctatttactcactttcattcccttgaggtttgaattcagcccggtgaccgtgtcataaatatcattctgacctccaagggggctgttcctgaatctgagttcttttgcacgtgtccttctcggaggttaaactgtccacccagccatgttgccttatattcgtcatattttttaaaggaaccaaaggggttaattggtttcttcagtaaagagacttttgccgaagaaagcaatttagaaaaaaaaaaaaaaaaaaaagaaagcaattttaggttagtttgtgtagtagccagggaaatgtactgaaaggggtggaccatgtttctgttgtgcagataacctacatactgctttagaaatgtgtgatttccagcgtgtgctaaaataagaagtggttgtttgatttatctcccacaatggtatggcattctcttcctaagtggcatttcattcgcaagc

SEQ ID NO: 214707 - DNA, 591 bp, Homo sapiens
ttataatcaaatttccgtgctaaatgacattcctgcgagcaccatgacagttgacaatcaccatgacaatgacagaagaaaccataaaatgacaaaaaggaaggcggcaactctggttctgagttttctgcccatttccagaaaagatgtgaatattcttctctttgcttttaatgcctgaccctgtcattagagatattctgtatctgtgacttcctggttttcataagctgagaaggtgatttgtgagccaatctcctggttctcaatttcatggccattgaatgaagctggtactgcttgatactcactttctgttctgtgtattggcttcctggcactgaagagggaaagacctatttaatggggtgggggcgggggggaccagctttatcagtaacagaaagttaggacagtcattccttttcaagacacctcttcatcctcaaagattaaacagctctttcttaatgtcataacaatcaaaatttggaataaagctccttatggatcacgggtgagagtgaatttgctctttgaaagaacagatgtcacaatatatgaacatattttcattttattaaacatgct

SEQ ID NO: 214708 - DNA, 469 bp, Homo sapiens
aaagatttaaaggtcattcagagatgtatatttaggattagaattgctgggttacaggctgttcccgtgtgtgacttgactaggtttgtcagattgttttctaaaagtttttagtgtacattctcacccacagaagatgagcgttcccattgctgagcaccctcagcaactctgggaggggtgaaatactagctcattgtgttttaaattggcctttccctgattactcaaaaaactgagcatcttttcgggttaattgaccattcttgtgtgctttctgtgaaatatctgttcaagagaaagaaatatctgttcactatctatattagtctgttttcacactgctgataaagacatacctgagactgggctggtctcaaactcctgacctcaggcatgagtcaccacacctggcctgctctgttactctatgagcatataagaattattttaggagagctgctactta

SEQ ID NO: 214709 - DNA, 587 bp, Homo sapiens
tggaagctggcaccctctccatgacttcaggctcatgaacgcacttcgtgaaagatctggcactgcaggatgagcttcccacctctcgctgggaccgaggctggcacgttctgggaaccctgctttcgagtgtgtcacctggggcggatgtggcactcaccgatcttgtttcagggaactcacatcacttttgaaaagcgggagacagattccatgacttgtttttgttttgttttaatacattttaattgtgagaacgattatcccctttccaaaactaaagttttgagcctctcagagtaaatttctagatacgcttaaaaaaaagtaatgtttttcatcactgttactgctcagttgtcaaaataagacttgtgagtctttgggaagaagaggattatacttgtacttacaaaattattctaacaatgcctgtggctaagaggaccctcaaaatgagtaaggaactgtaacagctcacaagggaccacaggctctgcagagtggcttcggaatccaagactctgaagcacacctgggtgtcctgccaggaactgcagctgcgcgccacatgcgccctgtcagat

SEQ ID NO: 214710 - DNA, 456 bp, Homo sapiens
agaaagttgattgtgcagttactatgagactcagttcactgatggagaaactaagagagcacagttaattatgataattccctatatttaacatttggatttgtttgctttgtgttttttgttgtgtttgttggttttgagatggagtctcactctgtcaccctggctggagtgcagtggtatgatctcggctcactgcaacctctgcctcccggattcaagcaattctcctgcctcagccttctgagtagctgggattacagacatgtgccaccacaaccggctaattatttgtattttttttgtagagacagggtttctccatgttgctcaggctggtctcgaactcctgtcctcaaataatccacctgcctcggcctctcaaagtgctgggattacagccgtgagccactgcacctggcctgacatttggtatgtatccttctgattatactt

SEQ ID NO: 214711 - DNA, 290 bp, Homo sapiens
tcatcttatttaatccttcagaggattctgaggtagaaatcaaagcctcagataggatttaaaaaataaaaataaaaataagaccaggcacagtggctcacacctgtaatcccagcactttgggagactgaggcgggtggatcacctgaggtcatgagttcgagaccagcctggctaacatggtgaaaccccatctctactaaaaatacaaaaattagctgggtgtggtggcagatgcctgtaatctcagctacttgggagactgaggcaggagaattgctggaacccgc

SEQ ID NO: 214712 - DNA, 660 bp, Homo sapiens
tctccagccacatacagaagtatagaagaatctcacaagtacaatttgagttaaaaacaaaaacccagacctaaagatatacatactctgtgactccaaatttaataattgctcatagaagtcaaatagaggttaccctgtaagaatgggttggtgactagagtgagcacacccagattctggggtcctagtcatgctctgtgtcttgacctaagtatacaggtacatgtaagtttgtgaaaatgtaacaagctgtatgatacgatttttctaatattgctcatctgtgtttgaaacatatacttcagaaaatgttaaggaaaaaatagaaaaggaaaagaaaaatagaaaacctaaataatctagtacttattaaagacttgaacccgtcataaaaagcctttccacaaattaaatactaagccaagcagacttactaaattctaccaaaagctaagaagctatgtcaattttatacaaacttttcaactaatttatgagcattaatttgatacccaaacctggaaggggactatataggaaaggaaaatgataaagtcagtcttaattatgactatagattgcaagaacccttaccaaaataggagcaaattgaatcaaacaatttttttaataaggcaaaatgtaacaaccaagttg

SEQ ID NO: 214713 - DNA, 592 bp, Homo sapiens
ctgtggcttgttgcttcaaccctgggaggcccacggagttctggatgtttggggggtgcactcataagcagaaaatccaagcctctagtctggctcccctggttctggctgttaccccattacagcttccggacttcagcagagaagagcgaattctttcctctccccttacactctctggctcaggaagcagtggaaagatgtaggggtcccagaacctccctcaactggtccagtattcctgcgactgccgaccagacataaactcaccaagttttttacaagcttgtcccttcctggtgagaagctccccagatataacaacagaaacagacctatcaggttctgccaggaagaaagagccatgcgtaagtcagaccttgtggctccttcaaacactcggaggcaacattaatctggattcttggatgaaaggtctagcttgccttgccagttcatttgtaaactggacagccagaaagcacctccgagcgtggagacccactgctccactgaagcttttagggcggcaaggccttcttcagtagtctttctgtctttctttcagctgcaaattcagcagcagcattta

SEQ ID NO: 214714 - DNA, 378 bp, Homo sapiens
ggtactgcagcactgaagtagtaaagggtcacaaataggctctgaggttgtaatttgggccttcatcctggctccaccatcttcttgctgagactttgggcaagttccttaacttctctaagcctcagtgcctagtacgtaaaaagtggtggaaaaatgttggtgctatgattattcttttcagctggggcagtacctaccaattttggataaagatggtatctcctgctcattatgtcctctccatacatggggctttttattaagtcactggctcagtatttgtagggtggacccatcaaagaacccgttgtatccacaccttccagtggtttagctttaaagaaaaccctcctcctgcttatatttgtatgaggt

SEQ ID NO: 214715 - DNA, 259 bp, Homo sapiens
tcctccccactcctccccaccccaggaatctggatgctcaaggcttgactatttcctccattctcccctcactcaagccccgtgttcagaagcaatcagataaactcattcattctgaaaagtttaatgtgtgactcttccaaggacagtttgttttaacagaaaatcaagtttcagaacaaatgtccaacaggtcccaaatttaactcactatactcaagagtgtgaaaatcaaaaaagtaaatttttgtttcccatg

SEQ ID NO: 214716 - DNA, 528 bp, Homo sapiens
ctgtgagctgctgcggggctgcataagacaggtgcctgtgtggtgttcctgctcggttcgtttcctgttagctgtttcctttgatatatatactcagaggaggaatatgagggtccacgatgtcgtaggaaccagaacacaccggcatccgccagaggctgttaatcttatgtaatcaatcacagcaatgaccttggcgagcatttgccctaaacgtgactgggctcctgccaacagaaaagatattggcagtcattcctcatgggtcagtgcaatcaaagatgatagcttggcaaaaagcctcaaggatggagtggtccttgctgattcacaaataaactattttattttattttttaattcttctgagttttctgctgaaagatccagatgctattttcaaggatggtgcttcttggaagaggaagaagcaaatgatgggggatccaggcctttggcatggagacaaagtaatggaatgaaagaacaccacctgttacgtactactgtaaatctttctcccagata

SEQ ID NO: 214717 - DNA, 1200 bp, Homo sapiens
gctgctgctatttgttggcatagtgaccttccaggactattcaatagtctttattccctgtactgtacaaccactaaagtctctgctcagttaacttagtggtcagctaatgattcgacagacatttccttaaattctgtgaatcaataaatattccattctttgctgagaagctctagatgtatccatgtgtgttaagacatgccctcaacattcaggcagcttagaactctgccttagccttcacttcctacttgcacagaaactccaatcagccagaggtgaaagagtagggccctctcaggtctttcccaggcatgcacacagcttttcacatttatgcaaccttttaggtccccaggaatgtatcagagcttttcaaagaccctgtggactgcttgttccccagatttttttttcaagttttgaccaggctcttgtttgtcccatctggtatcacagtgtcaaaccacagaagtgaaaataaccaatgtgggagaaattttaggtaaatattcaataaacctttgtgttaggatatggtgccaagaaaagtgaggagacagaaatgatgctgagcctcctgtgtcattctccctgacctaactgcattatgttcatttggagaagtgggcaattcactagcagaatggactctgcttgagaaacaggctctcttcctttactcaggatgaactcccaatgccccacttaccatcatgcactaccatcaagcaaatttttcttgaactgatttccacacagttttactgtgattcagaagaaaaaattacttggcatgagatgttaagccttaaatacaatataatacaaacccttctgcacatccaagaagaagatagattacatattgaagactaaatctggatcatttttctactggacagtggggctgaggaaggaaatcaggcttcatgaccattccatactgtaattttaactcacagaatctgcactaaaaattccttaagcacttacactgttaacaagttctattgctacaacacacctgcacataaaagaaatgtttacccatagtttcacctatggcaagtgaaaacagctgttttatgatggatatgatataaaaaaaaacctactccagaatttaaatttacacaacttaaactacataatatagcatcagtatactcaacatatagtcacagacaggagcag

SEQ ID NO: 214718 - DNA, 221 bp, Homo sapiens
gtgaccacagtgaggaaactgtcaaattgaaggggagggaaaccccttctgctgctaggtcaaagcagtacctcctaaaatgtttctgtttccaggtatgtgctcttcccagcgcaggattagttgtgggcttgtatctcttcttttacagcatctggtgtgtcatcagctgtcaggatattctcagtttctgctctctctccatgagaatcttcatattg

SEQ ID NO: 214719 - DNA, 1675 bp, Homo sapiens
gaagctatatccagctgctggcagagttcctgtcaagggatcaagtcttccaacagaatggttatggtttaactcagcagaatttgttgaacaactacgacatgctggggatcatggcatggaatgcaacttgcaaaaactggctggcagcagaggctgccctggaaaagtactacctttccattttttatgggattgagttcgttgtgggagtccttggaaataccattgttgtttacggctacatcttctctctgaagaactggaacagcagtaatatttatctctttaacctctctgtctctgacttagcttttctgtgcaccctccccatgctgataaggagttatgccaatggaaactggatatatggagacgtgctctgcataagcaaccgatatgtgcttcatgccaacctctataccagcattctctttctcacttttatcagcatagatcgatacttgataattaagtatcctttccgagaacaccttctgcaaaagaaagagtttgctattttaatctccttggccatttgggttttagtaaccttagagttactacccatacttccccttataaatcctgttataactgacaatggcaccacctgtaatgattttgcaagttctggagaccccaactacaacctcatttacagcatgtgtctaacactgttggggttccttattcctctttttgtgatgtgtttcttttattacaagattgctctcttcctaaagcagaggaataggcaggttgctactgctctgccccttgaaaagcctctcaacttggtcatcatggcagtggtaatcttctctgtgctttttacaccctatcacgtcatgcggaatgtgaggatcgcttcacgcctggggagttggaagcagtatcagtgcactcaggtcgtcatcaactccttttacattgtgacacggcctttggcctttctgaacagtgtcatcaaccctgtcttctattttcttttgggagatcacttcagggacatgctgatgaatcaactgagacacaacttcaaatcccttacatcctttagcagatgggctcatgaactcctactttcattcagagaaaagtgaggggcttgtgaaacagattgttctacagatgaatctgtaagccagttacagtttgccttaactcatagacatcaatcagagagtgtcacagatttaaccttgatctaaagacaagttgtacccagagtatgtgaaaagaatgggacgacaagaatgtactggtttcttcctctaagaattgaaaggagttgaactgccttatgtttgggcatgtaactccaaaatactaggtagtataaggctttctcaatcagtgcaaaaatggaagatatataaagcaacaagttgtctgcatttgatcactggtcagattgtaaaaaaaaaaaaaattgttttggcaacattctctatgttattcttattcacatgatcctagaactttatgtgagaactgaatagcagaagatatattattaaatagtttttggaagttgtgctgttaagcaaatgtaaagtcaacagtaacaatgattaagaaaggaatataatgagttcaaagatatctatctgatatattttttatattcatcatgaatcggggtagtcttgtaatttatctaacctttttg

SEQ ID NO: 214720 - DNA, 361 bp, Homo sapiens
  misc_feature (4)..(4): n is a, c, g, or t
ctanctagaggatcccgccacggtaattttctgattggcaattggttgagttattatctaaagacctggaatcaagagaaaggagtgtctgggttaagatgaggggttgtgagcaaggtttttttttgtttttttttgagatggagtcttgctctgtcgcccaggttggagtgcagtggtgcgatctcagctcactacaacctccatctcccggattcaagcgattctcctgactcagcctcccaaagtgctgagattacaggcctaagccactgcacctggccacaggacaacttttaaagacattgttagatcactgccgaatttaggatgaactcaccttcccctgtggatgaaaaat

SEQ ID NO: 214721 - DNA, 831 bp, Homo sapiens
ccctttcagaagcccctctctctcacaggagagagagctgttctcctctctctttcttttgcctattaaacctcccctcctaaattcactcctcatatgtgtcagtgtccgtgatcttcttggcatgagatgacaaacccagggtatttaccccagacaacaatgccgcttcactttgagcctcacattatccatccataaaatgagacagtaacatttgcgtcagatgccggaggctttcaactaatagagtcaaactctgtaaaatatttaaagagattaatcctgagccaaatatgagaaccgtgacccatgacacagccccatggggtcctgagaacatgtgcccaaggttgtcgggctacaacctggcttcatacattttagggagacaaaggcatcaatcaatacatgcaagatgtacactggtttggtctggaaaggcaaaacaactcaaacagggagggcgcttctgggtcataggtaaattcaaagattttctgattggcaattggttgagttattatctaaagacctggaatcaagagaaaggagtgtctgggttaagatgaggggttgtgagcaaggtttttttttgtttttttttgagatggagtcttgctctgtcgcccaggttggagtgcagtggtgcgatctcagctcactacaacctccatctcccggattcaagcgattctcctgactcagcctcccaaagtgctgagattacaggcctaagccactgcacctggccacaggacaacttttaaagacattgttagatcactgccgaatttaggatgaactcaccttcccctgtggatgaaaaat

SEQ ID NO: 214722 - DNA, 324 bp, Homo sapiens
cctattggatgtaaagcagggaaaacacaaatatatgaagatgtctccagcatactgttatgatgtatattttttaattaatggaaaatcggatctcaccgtttcattctgcaaagcttaaaagtgaccttttgctaatgataaatgacaatatggttgacatatgaatagggctgaaatagagcacccccatccaaatacatacactttacaagtgtatgtaatgaaactaggttctcttttcagctgtagaagaaacatctttagccagctgaaaattcagatgaaaatccaaaaactgcaaagatgaaagaattggaacac

SEQ ID NO: 214723 - DNA, 431 bp, Homo sapiens
tctgtcactgaggttggagtgcagtggtgcaaccatagctcattgtaacctcaaactcctgggctcaagtgatcgtcccaccttggcctcccaaagtgctcggattataggtgtgagccagcattcctgatctaatatccccacttaagagaagagtcttctgagacatagagaagttcaccatttgcccatggaaatacagttagtaagtggaacagttggattttttttttaaaccctccaacttctggactcaagaaatcctcctgcctcagcctcctgagtagctaagactacagttgtgtgccaccacacccagctaacaggtgtttttaaaatacgttttaattattttgaaagagtttcaaagtttcagaaaaaatacaagaaaaacacaataaactctcacatacccttcactcaaactcctc

SEQ ID NO: 214724 - DNA, 634 bp, Homo sapiens
caccacaccataccacaccacactcattcaaggccacctctgagttgggctgaaatgcattggaattatataatacatccaatataatacatccaatttcaatattcccatttttgagcctttgacctgcatttttctcacaacatgtcatggaaatttgggcatttctacttaatgtgggccatcactatttccaagcttctaaaagtcattccagcaacatattaaaactggccatactagtgtataattcccttggaacaggtcctgtggaagataagatttgtcttgtaaggctctgttgaggtccctgatgatttcaagcaagcagagcaggaagttactttctaataagaaggaatataccagttatacacatccagagcattcagcacattctgagacttcagggtccaagtggctcttcccacatatctccaactaacttagcatcgcactttgtttctgtcagggcctttgatgtaggggatttggtaggtctcagaacccaaccatctcttaagttgtaaggttcctctgatcttacacttagatcctgagatttgctttgaatgtgtgaataaccaccatagtttccttttctttcttcaaagcattaataaagtagaagcag

SEQ ID NO: 214725 - DNA, 444 bp, Homo sapiens
tggttgggaggaaaatagatcaagcaggtgacaacctgcatattggggattttcctatgctgaaaattgttattctgttgcagcactccaccctcccttcacagccccaaaaaagagaagtacgagtgctgctgatgttcagggtttgaatatgttttggtttaagatgttcagtggaattagagagaatttcatcctgggcagtgcagtcaggctggaggagtattttggtttcatattactaaaccttgttttcccatcccagctgcttgtgtgctatcttggggccactgagaacctggctgggctctgcggggtgggagtgttgtcccggggctgagtccagccaggggtgaggtcgtcttggtgcacatcttgcacgttgcatgaagctcagagcccagcttggctcttgtgaacttcccctgtggggacacaccctcc

SEQ ID NO: 214726 - DNA, 462 bp, Homo sapiens
tggtgactcacgcctataatcccagcactctgggcagctgaagcatgtagatcacctgaggtcaggagttcgagaccagcctggccaatatggtgagaccctgtctctgccacaaatacaaaaattagccaggcatggtggcacacacctgtaatctgagctactcgggaggctgaggcacaagaatcacttgaactcgggaggcagaggttgcagtgagccgagatcataccactgcactacagcctggacaaaagagccagactccatctcaaaaaaaaaaaaacaaaaaaaaattcaaaaatacttataaatgcctttttttaaaactgtaaatcaagcttctcgcttttaaaagaaatccacaattggataagggaaaagcagcagcaaatattattaagcacttacatgataggtaccatgcttaccacttcatactttttgtttaatcttcataac

SEQ ID NO: 214727 - DNA, 510 bp, Homo sapiens
attgtacctttcactcttttcctgtatacaccagactcttccatgaggtggtcggcttcctttgcccgtaaggtatctacttcgatccagttctcctagaccaccctgacgtggctaagattggggctctggagtcaggcagccaagactaacaggcagcccagactccacatttccctggtgtgggaccctgggcctgttagctaacctcactcagttttctgagctgtaaagcaggaaaactaatagaaacatctttcttatatggctgacataaagaataaatgagcgaatacctgtaagagacttgatcagtacttagcacacgggaagcactcagtaaatgctggctgctgttgctaccattgttatcattattccagttcacagcaaactttctctgtgctttaaactcctttagtacatatttgcatttggcactgatcacacactgctttgtgctattactcgtcatcttacacatatggcttctctcaactaggctacaag

SEQ ID NO: 214728 - DNA, 403 bp, Homo sapiens
tggagagctgctacttttaggcccacctgtgttgtttagtccctgagcttggtcacgtgttaatggtttgcgtacttttgtcattttgcaaatcaactttatcctttcagcttaaaggaaaaagtgagttctaaaaattagtaatagagaacatagcatggatactgtgtttatttttatttacattcagtctcatcgggaagaacatagtaacattcatattcttttaaaaataagtcaaattactacttattgaaaatattttctgctgggcttggtggttcatgcctataatcccagcactttgggaggccagggtggggagatcactttagcccaggagttcaagaccagcctgggtaacatggtgaaaccccaacatggcgaaaccctgtctctaaaa

SEQ ID NO: 214729 - DNA, 113 bp, Homo sapiens
ttccaagtcagaatttctaatgaggacaatgggttccaagcactcctcctatgttctaaagagaaacacaagccacagcaaacagggcagggacaagatgaaaaatctcgagc

SEQ ID NO: 214730 - DNA, 433 bp, Homo sapiens
ggctcacaggctgggtggggatctttccactgtaccacactgcctctccttgccactccctccctggctcccctccttacaatgtcctccttttcttcttgacagtcagcaccttgttagggatccgggcaatgtgagctatgaaaagaaactttatagctctgtgctgttatgatcatattttggggggcggggtggcgagagcaggcaggaaggagccaagcaggcttgcctgcatgactgctctgtattttaatgggatccctgctggtcacaccctctcccaggctcccacaccccgagggccacatcgcggtcactgagcagtcagggaaatgaaaacagtaatcttagagtctagagcggagcagaaggcaagaccctccccactgcccccacccagaggctcagacaaggcatcaaagaagaggaa

SEQ ID NO: 214731 - DNA, 360 bp, Homo sapiens
atctccctggagctatgctaggcgctgtgatgggcagtgtttcctttaagattcacaaatgggccagagagagattagaatgcttttgtctatttgataaagaaattgaagttgtaggagatgaagtgatttgttcaggtttactcagcgagttagaggaaggcaaggattagaacacgtgtgcacacacatacacatacattttagattctaagtcttgtgagctttttttcttttaatacaactgctctgtttccatttctaaaatatggttcacatcttgctgggtttttaaaaactgagtaagtcttttctctgtttgtaactccttagcaccccaattccattaaacaaatgcac

SEQ ID NO: 214732 - DNA, 422 bp, Homo sapiens
tagagaaaaattaaaccatttatattattttctgaagctgagtaagaatggatcacatgataacatgttctcccagcaaatagcagtacatcttttgattttcttccctcccctcatgtattccaaatcaaaatctgcctattctaaatcactgtcgcagcaaaatgacaaacagaaaaagaaaagagcaaaagatgaaaataattccttttctatactgaattcaatggctcttatgtcactttggacaaattagttcagatttttctcccaattcctacctattaaaaaggtgatttctgccagggtgtggtggcttatgtctgtagtctcagcactttgggaggctgaggtaggcaaattgcttgagaccaggaggtcaagaccaacctgggcaacatggtgaaaccccatctcttaaa

SEQ ID NO: 214733 - DNA, 604 bp, Homo sapiens
agatgaataaggggcggtttctcctgttaagcaaaatgttgctttccattttccctgatgctctgtgaatgcctctcatccccatgggctcctgagtgatgtgcatgtttaaaaggatccccagctgcgagaggttttggaacctggggggttgaacagctcttaagttgttcagtgaacgaagaacagaatcatctgttggagtagaaagaactcaaaccagtcaggaggaactcttgttatagaagaccttgggaaactgttctggggttggggaacattggttataggaagtgtatggtttctttgtgggattctttgttgttggctgaaatcatttaagcttcttgactacagtctgactcacgttaaccattccttttctgatatggacattgctttcctggtcctttcttactggagatctttcgcagtctttccattgattttggtgagatgttcttagctcaaagactactgatgagttgaatggtgtagtcttgattttcgaatctggaaacttcacgtaattggaacttctttataatctctggttgctcagatcactgtttttagcaaaataaacacattttgagtcacgaga

SEQ ID NO: 214734 - DNA, 474 bp, Homo sapiens
tggatggagagaaaatatcagtttccactccagactaaaagataactttgtggcggggactatggccaataggaagtgattaatctgcgcttgtaaaggctggaaggatcagagaggaggaagtggcatactcttggaagcttcgtggttaagcatgtgcagtcagattatctgggttaaaatcacagctccaccacttgcaggctgtgtgactttgggcaagaggcttaatctctctgtgtctcaatttccttattcataaaatgggaataatctagcttgtagtatttttgtgagtctttggtgaatgaatacatgttggtccttagaaaagtccctagaatagaaagcactcaataagggccaatgagttattgttatctcaggtttccagcttgtgcatttgctatgatttgggcaggaaaccttggctccaactgcctgcagcctttagatcaaacccatcacacagat

SEQ ID NO: 214735 - DNA, 460 bp, Homo sapiens
cagacaagaaggtgtggatacaaaaactagcagttagaagaaataatagaaaatgaactccaactacttctgaaaaaaaagtaatgagggcaattaatacattgaagaaagcctcaataagtacaacagtgtagtactgacttatatatagaaaaaacctgatcagtggaaccaaatcctcagaattagacataagtgcatatgagaattttgtatgtgataaaggttgtatgttaacgtattaagtaaaagacggactattcaacaaatgggattggtacaactgggtgaccatctaaaataacatcatgttgaaaacatactgtatatattacggtaggacaaattccaaatatgctaaatatttataaacaaataaggtgataataataatattaacattatctggtgaatccatgggaggtcattatgctaagtgaaatcattcaggaacagaaag

SEQ ID NO: 214736 - DNA, 495 bp, Homo sapiens
caaaattttgaaaaaatgcagatgtttggctgactccacatctatcagattgcaatttctagtggtagtgtccaagctcctatatattttgtaccaactacctgggtaatttgatgggttttcagaactactcaactatataaaccaaagaacctcaaaccttaacatatatatgatcatgtgggaccttgttaaaatgcagattctgagtcaggagctctgggtgtgacctgagattttccagttccagcgagctccatgtgatgtccgtgctgatggtgtgtgatccacactttgaacaataaggctataaataataaccatctacattttaaaagatttcctttttttttttcatttaagtgtggtgtatctgtttcctactcttgcttattctataagagaagtgtaatgggctttagatccagtctaaaatagttttggtttggatattgtcttccattaaagtttcagtacgcagaggaaaaaaaaaaa

SEQ ID NO: 214737 - DNA, 329 bp, Homo sapiens
gaaaatgtcatggggtgaaaaaacaaaaggtagagcagggtacaagggaaataggggcatctgtagtgggggttgggggtaatgcattacactgttaagaatggccagagtaggtctcattgagaagataacatttacatgaatatttgaaagaagtagggaatggattaaccacagaaatatctgggttaggggcaatataggcagagagaactggcagtggaaaagccctaatgttggaaacaagggtggctggagtgaagtgagaaagaaggagagtaaaaggtgaggacaggagagcagtcaggataggtaggggcagagcaggg

SEQ ID NO: 214738 - DNA, 178 bp, Homo sapiens
cattttctttccctaaatgcttcatctccctacccctcctgcagtgaacctaatgtcctcgatgactcccagggcctggccgccgagggcagcctctctaggtacagtgtcaatgctacctgtctattggtgtctgtgctgggaaactagctgttccctgtctcctctgtctctctgt

SEQ ID NO: 214739 - DNA, 299 bp, Homo sapiens
tttttgtgtgttttttgtagagacagggcttcaccatgttgaccaagctggtcttgaactcctgggctcaattgattcacctgcctcggtctcctaaagtgctgggattagggacatgagccatcacacccaaccaaatgttacagttttttgtgaattagttttacatcacatagcatagtctcattcaaatatcccctctttaaaaaaagttaaaagacactatatgggaaaaaattatgttgaaatgaagtggaacaaagaggaaattatcatctaatgtatgcattaagatcatc

SEQ ID NO: 214740 - DNA, 459 bp, Homo sapiens
atcagaaatcctgggggtggagcttagcaatttgtggtttaattatccctccaagttagtctgatacatgcctaattttgagaaactctgatagagaagaaataatgcttgtcttaagatgaaatagaccatgattctagacaactcttgttaacagggtggctttggatcagatacttcatattagttgctctgtcttttaaaacttaagagtagctaccttacagtgttggtgagtattagataagtcatgtgtattcaaaagcattttgtacacagaaagctttcaaggtatgtgttctcaccacacacaaacaaaataagtatgtgaagtaatgcttatgttaattggatctatttagccattccacaatgtatatatatttaaaacaaaattttatacgcgataaatatatacaatttttatttgtgaattaaaataaaaaaattgtaaaaggc

SEQ ID NO: 214741 - DNA, 538 bp, Homo sapiens
tgcatgccacttctttacctcctgggaatgaatgcacagggctctgttgacaaatctgcgggaagtagaaaattttaccaagctcaaggttttaaggaatgacacgttccacatcaatcacagacatggcagaatgcttgggaaacatctgttgagcctaactccaatgagactgagatggtcagtggtacacactgggtcagcaagaaggatggttcagattctggtcccagaattccctgctgatgtggcatagcccaagctctggggagtggagcccatttagggatgtgtcccccaatagcaagctattgccagagactgattggaggcagaggatagggtgtttttaaagtgcacacaaggaagattctcaattgtattacattgtgaacacaaaaatttaggactccccgtgttgattgcagcttgtgtctgaggggagcttatttaaggaagacaacctgatagtcttactccttagaaggaactttaaagaatatttggttgatcatatagtcctgataagcaggaagaa

SEQ ID NO: 214742 - DNA, 515 bp, Homo sapiens
cattaattttaaccttattggacatcagagctaagtaaacttttaaaaagctgttctaagtaatgtgttcaaaatctagttgcagtcttaatcttcacaaagtgtaaatccagttaagatacttaagtaagtacctccagttagttactcttagtgagtgttttcttgtattaccactacagagaaaaatatcacttaaactggttattttgctgggggcgggggttgtgccacgcatggtggctcatgcctgtaatctcagcactttgggaggccaaggcaggcagatgtagcgaagccctgcctctacaaaaattataaaaattagccgagcgtggtgacatgtgctaatagtcccagctactcaggaggctgagataggaggatggcttgagcctgagaggcaaaggttgcagtgagctgagattgcaccaccgcactccagcccgggtgacaagagtacgaccccgtctcaaaaaaaatttgttttcatttcaattattgactttactagg

SEQ ID NO: 214743 - DNA, 412 bp, Homo sapiens
agaaattacagtcttcattctattttcttctttcaaggagcacggtaagatccatgttcacatgagagagaataagtggaaacattttacacactgtaaatgcttgagagatgttcgctgttatgttgaaagttgagtgaggggaaattctgagtggactcagagtttgaaaaccagggaacaagagcactgttctgctggaactctcttgagagtccaggggcggccgtctccccaggaaagcagggtagcgtccaagaatcatgcagcggtcagaggaactcagagactgacatttgtcacctgtccctggagagctgcagaaccataagccttacaaagatgattagcagcccacgagaccacagacagctcttccaaccagcaaacagagttggcactcttgcacaat

SEQ ID NO: 214744 - DNA, 475 bp, Homo sapiens
  misc_feature (378)..(378): n is a, c, g, or t
  misc_feature (408)..(408): n is a, c, g, or t
  misc_feature (450)..(450): n is a, c, g, or t
ttgtgatgcagttagtacttgttccttctcacatatacagatttaaatatcatctttatgttggtgaatttttatttttattttttaaaaattttatttatttatgtatttatttttgcgacggagtctcaccctgtcgcccaggctggaacgcagtggcgcaatctcggctcactacaacctccgcttcctgggttcaagcgattctcatgtctcagcctcccgcgtagttggggattacaggcacacgccaccatgcccagctaacttttggatttttagtagagatggggtttcaccatgttgagcaggctggtctcgaactcctgacctcagatgatccacccgcctcggcctcccaaaatgctgggatttagnggtgtgagccactgcaccgggcctatattnttttatatcaaagtgcataacatttacattccattcaatatntataataaagccttctagctctgtc

SEQ ID NO: 214745 - DNA, 195 bp, Homo sapiens
atgcatgctacacaacgggggtgagccacaaaacagtatgccaggtgagagctaggcacaaaaggtcaaacacactgccatacgagaggctgggcattccatttccacgaaatgtccagacagggaaatcacaggaaactactggctgcccaggtgctgaggggagggagggacggggagagagtgcttaaaggg

SEQ ID NO: 214746 - DNA, 285 bp, Homo sapiens
aactcccaaactttctcctttcagtttcttataaatttagaaaatcaaatcagttcttaaaactcagtgagaatggaactgattttggcttaaaatgcctaaaactttatttatttacttttatcttctcattcatatgtttctatcaggcaggcatactcagattacattttacatttctggtaaataaccacagtcaagtaaagggaaatataccctgaagtcataaaaagaaagaaaaaaataaaaacttattaatatgcacttacatgcaaaaacagatct

SEQ ID NO: 214747 - DNA, 1527 bp, Homo sapiens
gtctctctctctctttgtatctctgtctctttctctctccgtgtgtgtctctgtccctctctctctctctgtgtctctctccctctgtatctctctatctctctgtgtgtctctctctctgtatctctctatctctctgtgtctctccacttctctcgcccactcccctctgacctctcacccagaagtggttctaccctctcagcggagctcagcctcccttgccatgtctgctccatctcagctcctgggcagggccatgatttgctgatggaaagattcaaaaccttaggaagcaatgaccatatcttctagaacattctatttaggcttccaggggactgttccaaggcagttaaggaaaagcaaccccaagcaaatggcctgaaaccaggcaggctgtttgggttggagcttgtccgccccaggctggggctgtgcagagccttggctgcctgttcttcctgggcagggccaggagaggcgcatggctgcagcctcccagagcacctttcccggtgtcctgggccttgctcctctccaacggccttattttcctaaatttccacctcatgttcatagttgttgttgttgtttttgagacagagtctccttgctctgtctcccaggctggagtgcagtggtgtgattttggctcactgcagcctttgcctcctgggttcaagcaattctcctgtctcagtctcctgagtagctgggattacagctatgcgccaccacacccagctcatttttgtatttttagtagaggtagggtttctccatgttggccaggctggtcttgaacttgtgacctcaggtgatccacccacctcggcctcccaaagtgctgagattacaggtgtgagccaccttaaatggaaaacaaaaacacagaacaacaaggatgagaagttctgtggtccgtacctttgggttagaatatcaaacaggagctcttgggggtttgagtgccccccaccccaggcccgtggtctctcttgtctaacctgctcatgtcacctccctcctttcaacaggagtctccagccatccagtggagaggggagcttttcttgggatttcccttgtaatactacctcactctttgcccttcaccgcagacttaaccatggcctccttcctgcagagttcttgatgtgagataaaattgcttgtctttcactggaaactcccagaaagaaaggctggtgcctggtctctcctcatttccctgtcatgaacacctcgcccagcacatggagggtgacttgcgatgatatatttaaaaaataactcccagttctgagaagagccataggagtgttggctcttattatctgtcctgatttccatatgttggttgttttctattgcaaaagtaatatagtgtaatatagttcaattatagaaaacatggaaaaatactgaaagggtttaaagaagaaaataaaaatgacttaccatatctctactcaacttaacatttcagtgcaaatccttcctgtcattttatgcaaattaaaa

SEQ ID NO: 214748 - DNA, 364 bp, Homo sapiens
ctagagtatcccgttggtcgatcactgtactatatgcctgtttttcaatctacctgagcaattgtggtatttttttaatctactttttttttttttaagaggtgagggtcttgctatattgctcaggctgacatcaaactcctggactcaagcactctttctgcctcagcctcctcagtagctgggtattatggtatgtgtacatatatacttttagagacagggtctcgttctgttgtccaggctggactacagtggtataatcatggctcactgcagcctccaacactggggctcaagcaatcctcccacctcagcctcctgagtagctagggactacaggcgtgtgccaccatgcctaatc

SEQ ID NO: 214749 - DNA, 441 bp, Homo sapiens
aggtgatgtgtctgcttcccctttgccttctgccataatgtaagtttcctgagggcccctccagaagctgagcagatactagcatcgtgattcctgtacagcctgcataaccgtgagccaattccacctctttgctttatacattacccagccatggatatttctttatagcaatgcaagaatggcctaacacaatataatataatttttcctgggaaagaatttccagtgtttttttctatgaattccaagggcatatgcttacacggccagaaaagaacaataaaatcagcaaaatgcaaaatttacaaccatttctacatttctgaaagtcctgacagtaaaaaaaaaagttctattccaaaaagcaacaaaaaagctaacaatttcaaaataactgttagcaagataagtgtaggttctttaaataaaaatttaaaa

SEQ ID NO: 214750 - DNA, 524 bp, Homo sapiens
  misc_feature (262)..(262): n is a, c, g, or t
ttcatacctgttctgacatcttcttatccatagagagatgtctgaaattgtatgaagaaagagttgacgaacactatgactgggtggtggaatttttaatctgtatttgaaaaaatatataacagtatacattttaacacatataatgaagtcattattgttaaaacattgatattaaactttattattacatattacaaaaaataaaatatagtaagactttttgtttgtttaccacaatggtatttgtgctgtttttttntgcactataattcaatctttcattaggagttaaggaaataggcagtcatacactgctgattttagtgtaaattagcaaattttggggggaagaaaatttggcaaaatgtatcaaaaatgtcaatgattttcatttcactcattaattccatttaggaattttacccatggaaataatccccccaaatttattaataatattatgattgttaatagttgtaaatatgtgaatcaattcaacagaacatcaataagagctcaga

SEQ ID NO: 214751 - DNA, 354 bp, Homo sapiens
ttttatgattattataagtgtaccaggactctaaaagaaacttgtttgtataatgctattctatccaaggtatgtagcccaggaaataaccaacctgatgtgtgttatgacccattttaagcctcccatgatcacagtttttaaaataaaattaaggactggtccttttctaggtgacacaagtaaggtaacagctagaacagaagaaagaggggtcccaaaaatgtaaccttaaaatttgatgcttgtgccactattgatagtaagcagcatagaataggatgcggttctctaaattggaaaaaaaagttacacagtaaaaaaaaataagtatatctgtcaagaatcatattt

SEQ ID NO: 214752 - DNA, 339 bp, Homo sapiens
tggagaatatactgaaatttatctattctcacttctttttttggcattttcttgtaaaccagtctgtgcatgtataagggtctttgggcagaaggaagggagagagacaaaaaacagaaaacaaaacaaaacaaagaaaaccacaatcatttgaattaagccaaggatgttctaggctaaggtcaggctaagaactgaacagaggcttcctttctgccatgcctgtgggatgatattcttattgttccattttttaggaagaaccttttgtttatgtgaacctgatcatatgaatctaagaatatgtaactcttacaaataaaaaacagctagtaatta

SEQ ID NO: 214753 - DNA, 327 bp, Homo sapiens
tcaagatccacagcttgaaaaaactggactagactgtgcttgagtgcagagaccatgacatattcatctttctgttactaagtgctagagcaggtgctcagtagatatttgaataaattggtaattgagaagaggagtaagaagtgaaatcagagttgtaaaaggaatagatgtttttgacaatgaagttcttggatataataaaggcagtcgaggtaaagcactgtggtacttatggttggtatgaaatttgtttgtttgcaggaaatagaaaccagtgttagctgaagcaaagaagaatatattaaaaggattcagggtatctca

SEQ ID NO: 214754 - DNA, 288 bp, Homo sapiens
ggctggctggtacttctcaagcaagcgggatctactatgtcaagttttctactgtagctgcttgatgtaacctttatgatgtggtcaagtgacacagaaaccaggaatcacttcctactcatcagagttacttattgtccaagcccacatggagtgatgttgcctgttttaaactgggatgtggtcctccttgatgccggtggtgggcaggaacatccgtaactggcacttacacagtaagcctggcttcctttcttcactgtgtgttgctcacctctatccccaagc

SEQ ID NO: 214755 - DNA, 470 bp, Homo sapiens
ggttaaaatttgtatttgcaaatcctttgacccaccagcaatcacattacaaaaagaaaaaagaaggccgggcatggttgctcacacctgtaatcccagcacttgggaggctgagacagatgggtggatcacctggggtcaggagttcgataccagcctggccaacatggtgaaaccccatctctactaaaaatacaaaaattagctgggtatggtggcaggcatctgtaatcccacctacttgggaggctgaggcaggagaatcacttaaacctgggggcggaggttgcagtgagctgagatcgtgccaccgtacttcagcctggggtgacagagtgagactatctcagaaaaaaaaaatacatttttaaaaaagaaaaaggcagccctatttcatatgtaattgaaaacaatgtcaaggtctgttaatagcataagatggtattctatgaactggaagagaggaggga

SEQ ID NO: 214756 - DNA, 357 bp, Homo sapiens
tctcccttcccctccttctttctgtctctctctcactttctttctcttcaggtcatcactcaccctggtggaacccaaaatgtcacatggtgagacactgaagcctcctgccaatagtcacatgagtgagtctggaagtgaatctttcagcaccatcagatgactgtatcactggcttacagttttactgcaacctcatgagaaaccagagcccaaaccacacagctaagcagctcctgaattcctgactctcagaaattgctattttatcctgctaagttttggagaaattggttatacaacattggataacagacatggctaaagaaagaataagctggaagatagagctaagta

SEQ ID NO: 214757 - DNA, 82 bp, Homo sapiens
tgggtctgtgcacatagccctgtggcaatactgtaaaagtccattgtcctcctatgtaaaggcaaactgttcctggctctct

SEQ ID NO: 214758 - DNA, 435 bp, Homo sapiens
ttttgtctgttcctgaccccagagagggtcagctgcctgaaggcaagtgccttctttcactttatatgctgcagagccctagcccagagccacgaggaccagagatatgtgagcagcaggggctggatctcactgaatgcccgtggcttctgctggcaattggactcctcccgtgtcaagctagagacacagaatcaagacctcagggccctgtgcctcgcagcccctgtggccaggacattgagaagtgagggacttgctggcttgtccactctcggccttcctgactccccctgaaccgaagtagccccaactctgcaggcctctggcatcactcacacccaccacctaccgagacctaaaatcagcatctgccaagttcaacccagccctgcacgggaagctgcaatggaccaggcgagtttgacataggca

SEQ ID NO: 214759 - DNA, 430 bp, Homo sapiens
agggcacgggatcaggttgtcgtacacaaagcgggttcctgatagaaaactagctccaagagggggggtttttaggggccacatcacactgggccttgccgaccatggtaggaagttggagggtgttaaggtagaggtaacatgagcttatttataattttttaagatgagccacctcacccagccagaaactagtcttatggttaagtaaagttacttagatttttcttgttctgtttttttttttaatttagtgctttaaaattatttgataaaatacagaattcagtgggaaggacatattaaaaagatattgtataatcttttgacagtattggcaaagagtgaatgattctttttttaaacatttcattaagctgatagataataacagacaaaaataaaatgtttgttgtgaatttctggagtt

SEQ ID NO: 214760 - DNA, 435 bp, Homo sapiens
ttaggatcactactgcatttctacatgcaaataatgcaagttaattgaaccttaataatctgagcctgcttgccattttgaaataacagtgcctatgcaaagactgagaggggagctcactataagcaccatccatactttggatattggggaccccttgtggacaattcagacagagcgagggctctctgagattgcctgtcaaaagcaagtaaccaaaattcacacatgaaaaactgaatggaaagccacacagatgtggcactcacgtcgttcaggaaaagcagtttctctgctgttgtcatgtgagacaatcaaattagtctataagtttaatacaatcctaataaaatcttaatagggttttaaaattggaattggagaattctgattctcttttggaagagaaatgttcaataacagccaaaaaaaaaa

SEQ ID NO: 214761 - DNA, 724 bp, Homo sapiens
agcgttttggggctagaagttgcggactagtagctgaggcggcacgggagtgtaggcgcgcggggtcgttgccgggggcacagagtgagaacaagcaagggagccctgctgaattgcagcttaggaagccctgaatcctggagatatgttcctgacccttccttcttgaagggacagctgtgtaaccattcaaccatctggccatcagtttccacatctgtgaaatcaacttctgcctcatggagccgtgagttcccaagtgaaggcagtgaggggctgtggtgtgatccaggaggctgagaattatgcagtgggtgctgtcaccttgaagacatcagcgtgatcaggcagatcatcatggtactgcatttcctggacacgatcttaattttcttaatacctccaccgacatttcaaatagcgtctctaatgccccagagacttttatgcccctaaggtagttttctttcttttgtgaagcagaagaagggaaattgttaaagggaatattttaactaaatttatttccataaaactatctttgtctttatatctcatggaaagtgttaggtagcctcaggattatatctccgttggaaaactgtagatgtaaaccttcttgctatctacatacttacatatttttctgttgttatttacttatgaatagcattttgattatagcagaaataaaatacattaaatgactaagctcagaaataag

SEQ ID NO: 214762 - DNA, 503 bp, Homo sapiens
cactgtcattcacacccatccgtattgttcgtatcgacacttgcttgatgtggacaaagtaaaaccacttacacagcacctcctaaaagagtaagtttccagttttcccagaaaaatctagaacttgggataagggctgaggagacttctcccattaggaacaggattctaaccgtctccttctcccctctcacttcgccagaaagcctctacttgcaccagttttatataatgggccttgacattagatttttgttggatggaaagggttttttcaggcaccatcctgaagagcgaaagctgcttttcatcgtgtcttgtgcacagcaggcgctaaggaagtggctgatgcctttaacttttgctggagtcgtggggttttgttctagtgatgttaggtagcttatgccactaattaaaggagattttttttcttctctcagtcacatagtgtaatttacctatagagtcttgacaagtcttggaagcagatttctgtttaa

SEQ ID NO: 214763 - DNA, 585 bp, Homo sapiens
  misc_feature (93)..(94): n is a, c, g, or t
ggaacagctatataggaaaagctattaccacgaactcgcgtattagcaggaaccagagtatgacccgggaacacgctttgatcatgaaacgtnntttaactagagacggggtttaaccgtgtaagccaggatgttcttgatctgaccttgcgatccacttgcctcggcctcccaaagtgctgggatcacaggcatgagccaccgtgcccggcccattatttgtttctaatactgaaaatttttaattgaaatataaaggcttttctttcttctctcaaactcctggtctgaagcaatactcccgcctcagcctcccaaaatgctgggattacagaggtgagccatggtgcccagccccatttctctctttcttgtactaaattattttctttggacaagttgttaagaaattcattttcaagtctgcagctttctgtttacatcagtgcttactgttattcaaaaaacatataccaggtaaagctcaatattttccattatttggcaaataagttggttcttaaaaacaaaataattataaagagtgccactaatcctcctgctgctgtcattaccactactaac

SEQ ID NO: 214764 - DNA, 518 bp, Homo sapiens
aagggagccagcgtaaagtgagcatccattactgtatgtctgtaagggcctaagtgcttagagatgttccaaagccacagaaaatgacatgagatcaagtgttgtttactccaaaaaaaaaaaaaaagaagaaagaaaaaatttaaaaaagcttaacaataagcgattaatctatgttaacttctatctaaaaaaagaaaaaagacactgttttcaaggtgggctatcaattacatgttacttgaaaatatttcctaaacatttttgatatctttaaccccgaagaaaaatgttcataggggaatttgctacatcttttgtagtcacaataaaaaagccaatcttgtagtctgttggaattttacattggagaaagggctttatgatattctttgacaacctttaatgctagcaattggcattttactttctatacttactttgatactttgcaaaatgtaggtcatgttctgcttctttccagtaaatcccaggaaatcaataaatgatatatgttt

SEQ ID NO: 214765 - DNA, 445 bp, Homo sapiens
gagacggagtttggctcaggatggagtgcaatggcatcatcttggctctgtgcaacctccacctcccgggttcaaggcacggtggctcacagctgtaatcccagcactttcgcagtcgaaggtgggcggatcacttgaggtcaggagttcaagaccagcctggccaacacggtaaaaccctgtctctattaaaatgcaaaaatagctgggcatggtggtgggcacctgtaatcccagccacttgggaggctgaggcaggagaatcacttaaacctgggaggtggaggttgcagtgagccgagattgcgccactgcactccagcctgggcgacagagcaagactctgtctcaaaaaaaataaaataaagagtaaaaaagaaatgaaagaacatgtcctataaaggtgacagtgtttgaaattatgcatttggggccattggaatat

SEQ ID NO: 214766 - DNA, 445 bp, Homo sapiens
ggccaacatagtgaaaccccatctctactaaatatataaaaaattagccaggtatggtggtgtgcgcctgtaatcccagctacttgggaggctgaggcaggagaatcgcatgaacccgggaggcggagtttgctatgagctgagattgcactccagcgcgggtgacagtgtgagactctgtctcaaaaaaaaaaaaaaaaaaaaaagctccctggtcatgttgctctagaagttgtaagcacattagcttgaagctagaagccactttaagatccttttattgctgcctgtgttcctctatagacgttttagctcaacttctacacatggtcttagcttttttgtattacagaacctagtacctaatttgcatttttacttctttcattcttaatgaaccactgtgtgaggacatgctttcttttttatggacagttcagctagg

SEQ ID NO: 214767 - DNA, 563 bp, Homo sapiens
tgagaggctgaggtggttggatcacttgaggccaggagttcgagaccagcctggccaacatggtgaacccgtgtctctactataaatacaaagtaattatccggttgtggttgtgggcacctgttcatccagcactcacaggccccagaggcctgctgcttaaaagaggtactagttacccataggacctatagcaatggtatcagaacggtttctacctccaccactgtggtctccatccatgggagaagatcccaataaacagtaatctgggccaggcgtggtggctcacacctgtaatcccagcactttgggaggccgaggtgggcggatcacttgaggtcagtagtttgagaccagcctggccaacatggcaaaaccccgtctctactaaaaatacaaaaattagccaggcacagtggtgtgcagctgtaatcccagctacttgggaggctgaggcaggagaattgcttgaacccaggaggtggaggttgcagtgagcagagatggtgccactgcactccagcctgggtgacacagtaagactccatctcaaaaataaa

SEQ ID NO: 214768 - DNA, 195 bp, Homo sapiens
tagttgcaggaaaaacccaggtccaaatgacacccacagttgaccacagttttacctaattaagtaaaaaactttttttaaaaaaataatttattttgttatcctgttaccagtactttcaaatacttaagaaaaaaatcaatattaaagtatcagttttgcaatccagaggatatttgtactttttcaaaaaaa

SEQ ID NO: 214769 - DNA, 426 bp, Homo sapiens
gcgtggtcgcggccgaggtacagtgacaccatctcggctcattgcaaactccacttcctgggttcaagcaattcttctgcctcagcctcctgagtagctcggactacaggcacacactaccgtgcctgactaattatttaaaatttgtttgtggtctcactgtgttgcccaagctggtctcaaactcctagccttaagcaatcctcctgcctcagcctcccaaatctctgggattactaacatgggccacagtgtctagcttctttcttctttcttttactttttttctctttattttcttccttcctccctccctccctcctttctctctctttctttctttttttcttcctttcctttcctttcctctcctttcctttgctttcctttctcttcctttcctttcttttttgtattttgggtctt

SEQ ID NO: 214770 - DNA, 824 bp, Homo sapiens
gttttcatttttatttatcttaaaattcaaagaaagaaagaaatataagaataatgaatgcataataacacatcaagcctgggttatattcatctttagaccaatgcagttgtaaaacaaaatgctaatttttttatggagaaagggtttctgaagacaaaaatgtctagggcccctaagtcataacacagcccagaccaggaggcaggacaagtagaggcatggccctgggtgtcacgttgagcacttggggcaggtgcacaaagaggtttggtaagtaccaaggatctgggctcctgaatgctgggctggcctcccattccccaaacccttctcctcccccagtgctgaagagcttccctggataaaggagagaggcctagagcccccacagagcagacaacctctgcacagggtctttggcatcctagaaggccctggttcctcaccctctggcttttccactcaccaatcccaccaggaaatgaggttaaccttgaggggggctgagacagatgcctccaaagaagccagtcctgaccccatgcaagctgctcacccccaccatagggacagtccttcccccacgaaacctgctcatccccaccgtaagggacagtcctgaccccacacaagctgcctatccccaccataagggaccatacggcacttcatcttcttagctaatggcaaataacagcatcttagagatcacctacaaaaccccctcatttcacagatggggaaactgaggtcccatggggaaaggaactcagtcaagaggaggcgtctctgcatttctagaagaccctctcctttcatat

SEQ ID NO: 214771 - DNA, 386 bp, Homo sapiens
tctatttaaatattttccaaattttcttggttatttttgaacatttttatattaacccagtgttgataattcaaggagctgtggtatgacgctgctgtcttcttgtttcttcttgctctcattcatggtgccttatctccctatgtggttttgtgagatttgaccatgtgcaactccattatttgaggttctttgactctggaaattctctgcagcctaaggtgaagctcagatcgtccaggagaaccacaccaaccacagactgaggtctttttaccactaacataatttgaagcctagctctaaaactgtctgaagagtggcttctacttaagaattctcgaggaattttcttcttctacacagcacgaaagtcaaggcaggca

SEQ ID NO: 214772 - DNA, 509 bp, Homo sapiens
tttcattaagaaaattattaatgatggtggtataacagtaattgattgcagagcaccacaggataacgcgatgccgaaaacccatgtttcatgaacatctgaggctttttctggttacgttctattaatattttgaggagtgagcaatttattattcctttcctaggaatctatgattgtaaaaatggctgctttttaaaaaccacagttttgattcaaattgtcatttctaaggggttcttaaggtcaagacaagtgaccccactagtgactgtgttatttaaaatagagctgtctgttgcaaattgcagaatggcagcaacttctgcaaatagtgagccttgtgtcatttccatttcttactatgcatttactgtttttactgttatgttagtgatttattgatgttatttcaatctgagtctgggtgtactgaatagtttattgtctttagttattactactatatgctatatgatgtgaaaaatacatttgtttttatatcagca

SEQ ID NO: 214773 - DNA, 615 bp, Homo sapiens
atttctccatgaaaggttctctactattccaagccatctctctatgtggtagctcattaaccacaagtcatttgtttccttctgttagatatttgtaaatatcttttgtgtcaactcatcaagggacagggtccatgtttcagacttcttttttttttttttttttgagacaaggtatcactccattgcccaggatggagcacagtggcacgaccacagcttactgcagcctcgacctcctgggcttaaggtatcctctcagctcagcctcccatgtagctaagactgcaggcatgcaccagcaacccggataatttttggtattttttgtagagatggggtttcaccatgttgcccaggttggtctcaaactcctgagctcaagcaatctgcctaccttggcctcccaaagttctgggattgcaggtgtgaaccaccacacctggtctagacttctttatatcacttcataagtttcaataaacatttaattaattatttatctaattatagtttacaacagagagatcctagaaaatctagatgaacaagagtaacaatgagctaaatgctcctctattcctagtaacagaatcattatctcaccaaacctca

SEQ ID NO: 214774 - DNA, 168 bp, Homo sapiens
ttcagaattagttgccgaggtgggtgcaaagaaagcctattaatatgtgtagactgcccattcccagaataaaccacatttcctcaatatattactttcatggcattttacaatattttcaagtttagttggacataattccagagatatgacaagtcaataggtgga

SEQ ID NO: 214775 - DNA, 383 bp, Homo sapiens
cacacactcattttccaatctatcattttgtctaagttcctacttgtctttaaatactcagcttaatacatcatcttctctgtgaagcctattctgttaatcttccaactctaaactagatatccctcctctatgctcttagaggtccctttcaagtatttatcataaagcttatcacttgcctaatgaattactatgtgagtcctcagaattctgagaatggctgctcatctgtacagtggctaataatatctacactgaaggactattataaggataaatacatgaagtgcctagcacttaaaaaagttccagtaaatgatggctatactatattattagcatttttctcaaaagtaagcaccctaatattcactttacta

SEQ ID NO: 214776 - DNA, 486 bp, Homo sapiens
cggcatggggggagacctggggatcccaaacaaaggcagagcctgggaagcacccactcgacctacctcccattatctggacccaggtttctacaaaacatgagagctctctgcaaagaagaaaagaaaaatggacggaactcgaacttaaatccaaccttgtggttacaattacggaggcccacccaggccagcactgtgcgggccccttcaggcttctctcaggctctcccgagacacaccggcaggctgcagtgctaccactgtggtaaaggacaaggaaactgaggctctgtgggattccgggacttgcccaaggtcacaccatccttgaggggtcgagccaggactggaacctcagtccggccactacaacttcataaataccatcgccctgagatgctgaaatcccaggggccccccaccctcagaccaggtgccggtattgtcagcatcgagaaaacaaagtgccagtgaattatcaac

SEQ ID NO: 214777 - DNA, 460 bp, Homo sapiens
ttgttataatcaatcagtgaacctacactgacatactgttatcacctggtgtccatagtttacattagggttcactccgggtgttatacattttatgggttttgacaaatacgtcatgacacgtatccatcattatagtatcatgcagattagtttcatcaccgtaagagtcctctgtactttgtctgttcatccctcccccacttactcctggcaaccactgctctttttactgccttcataattttgctttttccagaatgtcatatagttggaaccatatagtatgtagcccctatgcatgactttttaatatatgcatttattgtttgtaatatactaggtcactgagttatacagatcttgcaaatattgacactttttattatactatataatatccagtcatgcagcctctcaaaaaactccactgtatacatgtggtcttagtagtattatg

SEQ ID NO: 214778 - DNA, 285 bp, Homo sapiens
caaaagctcccatcagcagatcctgataattatttcttttgcagagattaagaattcagtgtccagcagatcagcagccgaaaaggaagatataaagcgtgtcaaaagcctggtggttcaacacaatgaacatgaagaccagcacagcctagatttgggtatgaaataatgcttttacctatactcgtaggggcatcccagatccaggtttagagtggacaagaagcaagtaaattttaacataaaatattccttcctggtaaccttatctatttcctgaaacgc

SEQ ID NO: 214779 - DNA, 519 bp, Homo sapiens
cggctcagtctgagggacagagaggagtggttttgttttgatcactttcatttgtggcagtctatgcctgcctcttgctctttcaacaaatccatgagattcctcattctcctctttcctcttttttaaaatcttaatttcctagtcatttcaaatttgctgtttttcgattttctcctccacctgtccttcaccttaatcctctaatcccattcgagcaaagtagtaagttcttttctttgttttctccccgtagttttctattttttatttatttctttttatatcttgggaagtttaccctttttgccaaatgtgaattatgctcatttggacatttaagaattcattttctagttttgatgaggctaaaatactacggttttttcacttttttttttttttttctaaatcactaaacttcttgaaagaggtctacacttgctctatacttagtgtctttacatttcattaattcctcaacccaatactgtctggcttccaccaacaccactcaat

SEQ ID NO: 214780 - DNA, 375 bp, Homo sapiens
ctcctgcgctgagaggctgcagtgcacagcacatacctatgttctatatatgttagatttatacctaagtgtttcattttttgagggattttaaatggtattgtatttttaatgtcagtgcccatgtgtttgttgctagcatgtagaaatagaattgacttttgatcgtttatcttatgtcttgcgaccttgttaaactcacttattagttctaggagggcttttttgagggtagattccttggaattttctatgcagagacaatcatgttatctgtaaatgagggcagttttgtttcttcctttcctgtctgtgtgccttttatttccttttcttgcctattgcactgcagccttaacggtagggctcgatctt

SEQ ID NO: 214781 - DNA, 557 bp, Homo sapiens
caggaagaagactgccatctgcaaatcaggaagacaatcatcatcaagaacttaccatgctggcaccccgaacttgggcttctgttgtttaagccacccagtctgatattttcttatagcagcccaagctgactaagacaggcagtcaagaattaaaatctgcttggaggagcaccaacatacccattttaaaaaccttattatgtgaaatggctacagttatttaaactcaagaagaacatggaacaagaaagagaaataaagtcagtgagatgaatggactaaaataacctagcagttaatggaataaataggaatgaagccccttttccagtgttagggtcagcctgggatttatcaaggctctaaacaaaaggaattgatcatgagaggttagcagagacatacgggaagcactgcgagagtattcagcactagttggagatttgaattctaactttaaaattctgagacttttgatctattaatttatccattttcattgttcttttgctttgactataaagaaacaaaataaggcacaatcaagtgaaatc

SEQ ID NO: 214782 - DNA, 1100 bp, Homo sapiens
actaggttctccggctccagctcctgcgccgcctgttgctcgctcctccgggcggtcgcttcccgcccggtgcccaggggtaggcggcccgagagcgcgcaggcagccagcctcccgccttcgtcccctccccgtaccgcaggagccggtccgaggggtccggagcgtccctgagagcgcggaccccggcgagcagcccagtgcacccgggactgcgcgccgagacccccggcgccgcgcggcgatgaacgcgaccttcctgaaccacagcggcttggaggaggtggacggcgtgggcggcggcgccggggccgccctgggaaaccgcacccacgggctgggcacgtggctgggctgctgtccagggggcgcaccgctggccgccagcgacggggtccccgcggggctggcgcccgacgagcgcagcctgtgggtgtcgcgggtggcgcagatcgccgtgctctgcgtgctgtcgcttaccgtggtcttcggcgtcttcttcctgggctgcaacctgctcatcaagtccgagagcatgatcaactttctggtgcaggagcgccggccctccaaggacgtgggcgcagccatcctggggctgtactgagcgccatctgggtccgccctcgccagcgctgctgcaagaaggaccccggagacccggaccctcgccccgctctctgcgctctgccgccgcctccgggcgggcagctacgtgcctggggcgcccgggcggggacgcggcgagactgtcggcgggggcgcgggaagggacttggacgcccggctctgtcctgtgtgcgctgcagcgttgcggggtgggagaatgtggggtgagggttcttaccagttttttttttgtttgtttgttttttaagacgttcggggcagggtgggagtgggtatggagatgcaatttgggactgcggtcgctcgcgtgggagttttgtgtgtacgttggtgcgggtgggttcggaacacggtgcgagtgggtgaagatgtgaagcgtcagagtcgctgagcttgttggcctgatcttgcgtttggaaagaaatcttgtaataaaactgcagccgtagggcttcaggcagcttcccacc

SEQ ID NO: 214783 - DNA, 461 bp, Homo sapiens
taaggacatgaatagacagttctcaaaagaagatatacaaatggccaacaaacgtatggaaaaatgctcaacatcgcaaaccaaaaccacaatgagataccaacttactcctgcaagaatggccataataaaaaaattaaaaaataatagatgttggtgtggacgtggtgaaaagggaacacttttacactgttggtgggagtgtaaactcgtacaaccactatggaaaaccgtggagattccttaaagaattaaaagtggatctactgtttgatccagcaatcccactactaggtatctacccagaggaaaagaagtcattatacaaaaaagatacctgcacacggatgtttatagcagcacaattcgcaattgcaaaaatgtggaaccaacccaaatgcccatcaatcaacgagtggataaagaaaatggtatatataccgtggaatataactcagccg

SEQ ID NO: 214784 - DNA, 271 bp, Homo sapiens
ccagggcgggcgggtccctgagtcagaacccgcgacccacaggcggcatcgatctgaggcattcgtttttcatttttccacctttggtttgatgtcattggaaaagaaagaaagaaaaaagcatgaaacggaaactgggtggagagaaaagattaaaatctctgctgctgccgatagctccccacagcaagatgctattgctcagggtttcagagcctagtttgtcgaaacccatccccctcgcctccgttttaagacaaaagtaaaaaat

SEQ ID NO: 214785 - DNA, 455 bp, Homo sapiens
caaggatagcaccagtcaatgaggaatccacatctatgatctaatcacctttcaccaggccccacctccaacattaggaattacattttaatatgagattggggggacaaatatccaacctatatcagatggtttataatatgcaaatcaataaatgtggtacgttaacacaatcaggtacaaaaaacatatgaccattacaatagatgcagaaatagcatttcataaattcaacatcccatcatgataaaaactttcaatcaattaggtatagcaggaatataactcaacctaataaagacatgcaaatggccagtagatatttgacaaataatgattagcatcaccaatcatcatggaaatacaaatcaagaccacagcgagatattacctcatacctgttagaatggctattatcaaaaagacaaaaaataacaaatgctggtgaggatgaa

SEQ ID NO: 214786 - DNA, 252 bp, Homo sapiens
tgaggtagatggtgctttaacaaataatctctaagaactattcaactgttagaatctacacttaggtcttcgcagttccataagcaccattttgatgtgaagaggtatttcagggaagaagtgtgtgtcttttctctctgggggcacaaagacctattgacaatatgttgtaaaatccaacttcagaggaataaaagtgtcaaactatttgtgaacaactatgtgttaaatgaattaatgatgaatcagttt

SEQ ID NO: 214787 - DNA, 361 bp, Homo sapiens
ggtaccaatttttctatgaatgtctgatagaattctgctgtgaatctatctggtcctgaatgttttttttgttggtaatttttgtattaccatttcaatcttgctgcttcttattggtctgttcaggatatctagctctccctgatttaagctaggaggcttgtatctttccatgaatttatccatctcctctaggttttctagtttatgagcataaaggtgttcatagtagccttgaatgatcttttgtatttcagtggtgtcagttgcaatatctcctgtttcatttctaattgagcttatttggattttctcttcttttcttggttaaccttgcgaatggtctatcaaatttatttac

SEQ ID NO: 214788 - DNA, 494 bp, Homo sapiens
ttcatgtagtcttcatcgcccattaacaatattggcattataagaaatgaggaaatactgaaggaaagcacaaccaatactagatattaaattagcaaattaatattaaagagaaaagtgtgtactttgaatatattataagaacaataaatttagtgactagactttttgttatgacagaaagcagaaaactaattgttccaataagacagctctaccaactctagctttttcatccctcaaactagtttaattattaaagccattattggttccagaaacttaaaacttgaccaaaggtttaataatttatttaatatattaattcaacaaatattaatatattacctgtcatttgcttaggtgataatctgctttaagaaagatatggggctgggtgcagtggcttacacctgtaatcccagcactttgggaggccgaggcgggtgaatcacctgaggtcaggagttcgagaccaacctagccaacatggt

SEQ ID NO: 214789 - DNA, 265 bp, Homo sapiens
ggttgggctttgtcctccttccactcacttttcttacctctcccctcctctttccaaggccacctgcctgtaaatgtgctccaagtgcaaacaaacttttttccactcatcctgacatccaaaagtttgtgtctgagaaagcagtgtccaccaatccacctatgtccgactcatagggctgtctgtttattgtgcagatttgtagatgccagtgagccaagatcgggccactgcactccaacctgagagaacgagactccgtctc

SEQ ID NO: 214790 - DNA, 1774 bp, Homo sapiens
cccttggaagctggaatcctgcaacaatggcccagggtgtcctctggatcctactcggattgctactgtggtcagacccagggacagcctccctgcccctgctcatggactctgtcatccaggccctggctgagctggagcagaaagtgccagctgccaagaccagacacacagcttctgcgtggctgatgtcagctccaaactctggcccccacaatcgcctctaccacttcctgctgggggcatggagcctcaatgctacagagttggatccctgcccactaagcccagagctgttaggcctgaccaaggaggtggcccgacatgacgtacgagaagggaaggaatatggggtggtgctggcacctgatggctcgaccgtggctgtggagcctctgctggcggggctggaggcagggctgcaagggcgcagggtcataaatttgcccttggacagcatggctgccccttgggagactggagatacctttccagatgttgtggccattgctccagatgtaagagccacctcctccccaggactcagggatggctctccagatgtcaccactgcagatattggagccaacactccagatgctacaaaaggctgtccagatgtccaagcttccttgccagatgccaaagccaagtccccaccgaccatggtggacagcctcctggcagtcaccctggctggaaacctgggcctgaccttcctccgaggttcccagacccagagccatccagacctgggaactgagggctgctgggaccagctctctgcccctcggacctttacgcttttggaccccaaggcatctctgttaaccatggccttcctcaatggcgccctggatggggtcatccttggagactacctgagccggactcctgagccccggccatccctcagccacttgctgagccagtactatggggctggggtggccagagacccagggttccgcagcaacttccgacggcagaacggtgctgctctgacttcagcctccatcctggcccagcaggtgtggggaacccttgtccttctacagaggctggagccagtacacctccagcttcagtgcatgagccaagaacagctggcccaggtggctgccaatgctaccaaggaattcactgaggccttcctgggatgcccggccatccacccccgctgccgctggggagcggcgccttatcggggccgcccgaagctgctgcagctgccgctgggattcttgtacgtgcatcacacctacgtgcctgcaccaccctgcacggacttcacgcgctgcgcagccaacatgcgctccatgcagcgctaccaccaggacacgcaaggctggggagacatcggctacagtttcgtggtgggctcggacggctacgtgtacgagggacgcggctggcactgggtgggcgcccacacgctcggccacaactcccggggcttcggcgtggccatagtgggcaactacaccgcggcgctgcccaccgaggccgctctgcgcacggtgcgcgacacgctcccgagttgtgcggtgcgcgccggcctcctgcggccagactacgcgctgctgggccaccgccagctggtgcgcaccgactgccccggcgacgcgctcttcgacctgctgcgcacctggccgcacttcaccgcgactgttaagccaagacctgccaggagtgtctctaagagatccaggagggagccacccccaaggaccctgccagccacagacctccaataaagacagcatggaaacaa

SEQ ID NO: 214791 - DNA, 439 bp, Homo sapiens
tttgagcaatgtttacagtatggtgcctcaaaaatctctcttgttgctttgctgattaatctgttcagtaaataatccatcatcagaaacactaaactcagttgccctttgtagtcattatgttctgagagttctcccataactcatacccaaaaagtataaaatgatactatatgtgagaagaaaaagtaaaagtagagagcattggatattttctcatttctgtaacttgatatgttaaatttgttatacttttttttttttttaaacagagcctcgctctgttgtccaggctgaagtgcagtggtgcaatctcagctcactgcaacctccggctcccaggttcaagtgattctccagcctcagctacttgggaggctgagacaggagaattgcatgcccgggaggtggaggttgcagtgagccgagattgtaccct

SEQ ID NO: 214792 - DNA, 431 bp, Homo sapiens
ggagaaaacaaagtgcaatactcttttctgctgttcacaacatcaaattggtaattataatgttggtatttgccacatgccagtaggagatcccgcaccgttgaaacataaagaggatactgtttattgctctgggaatttacagtcccgcttaggcagaaaagtaaccatgaaaagttcttttttttttttaaacatatgatattggttaaaacttggctttcttaacttccttggaatttgagtcttctttgtgggataaagggagatgacagaaataggataattggaaccttttgtagttgtgcacagaggggatttaaaaatgaaatagccagtgttgcaagacacaatgagcacaaagaggtcagttgtggaaggagtgagtgtgcaggggaagagaggctgtttaacctaattatccttatcca

SEQ ID NO: 214793 - DNA, 444 bp, Homo sapiens
ggcactgagaaggcacagcaagtaaggtgggaggaaaaccatggcaatgtggtgtcttggaaatggaataaatatctgctacaggaggaggcgatgataacggtgtcccatgctcttgttaggacacagttgaaagatctcgagattgaaaactgagcttcacagatgtcaatattaagaactgatctttggacttagcaatgcagagctcattggtatcttttatgagaaaaatttcagtggcgtggtaagaccagattctaattgaagtgtgtccaaaacaagaagggagcttaagcattaaattttattattattattattattattattattattattttggaaatagggtctcattttgtcatccaggctgaagtgcagtggtgccatcagcacggctcactgtagccttgacttcccaggttcaagagatcgtccctc

SEQ ID NO: 214794 - DNA, 510 bp, Homo sapiens
  misc_feature (444)..(444): n is a, c, g, or t
tttcttctcatacttcatgctcatttctctagaagggcttatttggtttagagtgggtctggtaacatcctctgtaaataattcagtgctttcacaggatgacttctaggttgtttgcttttatattgggtccctgagctggttattacatcacccatatgtcttagactggaggaagactggggcccagtgaaataagctctcacacaagttggaattagtgcatagcagattccatctgtttttgccactggcttccttctccctcatatcaggacaaagttcttgctaaaaagaaaaaaaaagtcaaaatatcatagtttcattcccacaggcagtttggctttggttatgtatttgactcttagacctgtaccttgtgcccagcactgaggatacaacgcagaatgggacatgccccagcctcctctcaggagccactanagatgtggagaattcttgctgaggaacaaacacatgtttttgcctgtctgtggttttcgaagttta

SEQ ID NO: 214795 - DNA, 471 bp, Homo sapiens
taaaggactttaatactttgcaaaaatctattctagtgaactacaattatcctcaacttacacataaggaaactgaaaacacaagtactgtagtcaacctaggttactcagccagccatttttaggacgaggaatataacttacatcctattccttagtagccagagttacagttaagttccatatactataagagaatatttgacttctaacatcatagcatctttatagcaatattctcactatggctgataccaacgggttgaaccaccagcttgtaaaattccccagcatgtaaaaccagttcctgccagccagcactagctgattccagccctctgctaagttaccaagccatttatacaaataaacaaataggacttgcaagataaatgttaaacccatgtaagagaacaagttatactcaggtgttcatttacataaaaatcatctacggtctaaatttaatgt

SEQ ID NO: 214796 - DNA, 544 bp, Homo sapiens
gacagaatttgaattgtgcctcaaccagttactactgtgtgactctgggctagttgtgaacctctctattcctcatttcccctcatctgtaaactgggggaaacactaataccaacattgctgggtggttgtgagcaaacaataaacaaataatagtgtaagcaaacaataaattttagcaattgtttataaggtatttctcttgtcaagtaagccaagttaatcatctaatggctcctataaaataaagcatagggccaggtgcagtggctcatgcttgtaatcccagcactttgggaggctgacgtgggcggatcacctgaggtcaggagtttgagaccagcctgaccaacatggtgaaaccccatctctactaaaaatacaaaaattagctgggtgtggtggtacgtgcctgtaatgccaactactcgggaggttgaggcaggagaatctcttgaacctgggaggtgggggttgcagtgagccaagatcacgccactgcactccagcctaggtgacagaacaagactccgtctccaaaaaa

SEQ ID NO: 214797 - DNA, 772 bp, Homo sapiens
gtactcctgtagtcccagctactcaggaggctgaagcgggagagtcacgtgaacccgggaagcagagtgagctgagcacacactactatactccaggctgggtaacaaagcgagactcccatctcccaaaaagcagttctggaatagaactcacgctagatggatagaccagtggacactttggaaccttggggctggggaggaaactgcccatccagtaaacccccaaaaagccatttgttctgcactacgtatattgcttattctttctggtcttaagtacttgcctctcaacctccctttttagtaaaagacaaggccacgtgagaggcgggactatcaacattgtgatgaatttacttgaaacccagtgcccaaaatcaatgtaggtagccaagtccaaaaacctgttctagtccaactagtgaaatcaaactgtgatacttggataagcttagaaggaaacgtgaagaatacgtagctgctttgggtttactctggttcagttgggctgttgaaatcttaacatccttgggcttatcacctactgcttgtcagccctgttccatgtccaggggatgggggtggtgacaatccagttccaagaccctcatgctctagagaggaaggtggccagccagggttgtaactacgatgaaaaagcagtgggagggtctcctatgaggcaagcctaaggacaaaaaggaaggccttgcagcctgtattctggataaggaattaaaagctcagttaattgaagcccaaaaaaagt

SEQ ID NO: 214798 - DNA, 456 bp, Homo sapiens
taatagtggctgccggcatcccgggctgcactgtgggcacagctgtggggtgttggggttggcagagagcctgggtccctggaacacgatctggccacctgtggactagagcagaggatgaggtcatcaagctgcaaatagatccgatttcccttaatcctcgaatgcctgaaaagttgtgtggagatgacatgctccccacaaattcaattccttcagaaacctgtccgggcgttgcggctcacacctgtaatcccagcacttcgggaggccgaggtgggcggatcacttgagctcaggagttcaagaccagtctgggcaacatggtgaaaatccatctctacaaaaaaccagccaggcatggtagcgcccacctgtggtcccagctattcgggaggctgaggtgggagaatcgcttaagcccaggaggcagaggttgcagtgagacatctcacc

SEQ ID NO: 214799 - DNA, 530 bp, Homo sapiens
ctgggatagattatttgcctctgtctaggactggtctaaatgctctctttgtgggtgcccgctgaattctgtcctgtgttgttttccactgtggcaacattgaatcaatcaggcagcgctgaattccaatgctaagtcccatgatcacttcactcttccttaccctatctcacagattctctctccataccacacagctgctgctggaggattgggaaggatggtataggcagctcaagactgcctttcctaccctctttggtgcctctttccttaacttgttcaaagcagatactgtgatcactcacttggtttttggttcttatgaatgtgctcttttgtgtggatagttgtttgatttggtgttcctgtagggagatgatcactggaagcttgtatttggacatcttgctccacctctgagacatacaaaagaaatttaatgaagaaaatttcttaataataaagtaaagcacaaagtagagagaacgagaggaaatgaaatgtgagtgtacaggtcatagtaaaaa

SEQ ID NO: 214800 - DNA, 432 bp, Homo sapiens
ttcattcttcaaacatttattatgttctatgccagctagtacctgaatcagtagaagctcaaatgcatagtttctgatcttgaagatctcaaggattgctctctactgtgagaaaatctaggtagcatcaccatgaaagtgattatctcaatgggaacttctatgaaaatgtatcactaatattttggatcagtagactacactcaaaactcagcaagcagatcacaataaaagttcacctaccaaacacacacaacacaccaatgaatgggtattagaactcagttactaaactgtaggaaaggttgatgcaacactttcaaaacaatgtagtgaccaataataaattaataaggctaatactcatcatgatatatctatatgaggaagaaaatgtgcttaaggttgaacgttagaatcagattatacaaa

SEQ ID NO: 214801 - DNA, 454 bp, Homo sapiens
atataaattaagcaatgaatacattggagcaaaatttagagtaccaacatcaagagatagtgtggtatttcatttcaggttatctcacttattattaattactacttaattgggagtcgtgtttcctcatcagtttttagaaaaaagtttaaaccagctgggtgcggtggctcacgcctgtaatctcagcactttgggaggccaaggccggcggatcacgaggtcgggagatcgagaccatcctggctaacacagtgaaaccccgtctctactaaaaatacaaaaagaaattagccgggtgtggtggcgggcgcctgtagtcccagctactcaggaggctgaggcaggagaatggcgtgaacccaggaggcggagcttgcagtgagccgagatggcaccactgcacttcagcctgggcgacagagcaagactccatctcaaaaaaaagaaaaag

SEQ ID NO: 214802 - DNA, 378 bp, Homo sapiens
cacagcttattatctctgggcaggagctttcccagggtcggaggggcaagggtctagttgtgagggagagaggtgaaagcaaaagggaaatgctaaatgacatggcacagcaagcaaggtctaggcagctgcgcctttgataacaagctgcttgaagagaaagaccagatcggctgagtgaaagcactgtccatcctccccaccccttccttcctgcttcctcctcttcccatctcctccagcttctccttaaagggactaccgaatgatgatttccttgccagtaggaccttgacataaaacccagcccacaacatcacagttgattttcaagggatgagcttctcagaaaccagaatttaattacttaattttgag

SEQ ID NO: 214803 - DNA, 555 bp, Homo sapiens
cgcgatgacttacgcctgtaagcctagcactttgggaggctgaggcgggcggatcacgaggtcaggagatcgagaccatcctggccaacatggtgaaaccccgtctctactaaaaaatacaaaaaaaattagccgggcgtggtggtgggcgcctgtagtcccagctactctgagcaggagaatggcgggaacccggcaggtggagcttgcagtgagccgagatcgcgccactgcactccaccctgggagacagggagagactccgtctcaaaaaaaaaaaaaaattttttttttacactatttcttctcaaaatatttttatttgtggaacaaaatgtttttaagttaaaagaaaaaggcaaaaaactagaattctttcatgaaaaactgaccctccctaaccccaaaccccagttctaagggcacagagaagaaaaagacaaaagaagctattattgtgaattgtaagggaaccagtcaggctggtttaggaaatggacttcagggatctttcaatatagttcattctagtccaccacccaggctacagggctg

SEQ ID NO: 214804 - DNA, 144 bp, Homo sapiens
aatacaaacactataggtcatccacgggggttgtggtagtttaacccttcctataaatttccttacagaaagcgtgagtggtgcctgatgtatattgtgtgattgttgtcgattgctatagtacacgtcccttcatagtttata

SEQ ID NO: 214805 - DNA, 141 bp, Homo sapiens
tgtgtgcatgtgtgtgagggtgtgtgcatatgtgatggtgtgtgcacatatgtgagggtgtgtgtgcatgtgtgtgagggtgtgtgcatatgtgtgacggtgtgtgtgcacgtatgtgggggtgattgtgcatgtatgtga

SEQ ID NO: 214806 - DNA, 428 bp, Homo sapiens
ccacagtaatgttcattaatacctcgtgtgagacactgttttccttgtgtagttcagaatgctactttacttcctgacccctggaaaccaggaaatgattttattagcaggcaagagaacacacacacacacacacacacacacacacacacacacacacacacactgtcactctctctctccctttctctcttagcttttgtcccccaaagttgaataacataatttttgggaagaggaagaatccttggcactgaattgtagacccatatggttcttggagatatggtctaaaaatgtaattgtttgaaaactttagtgaaaacaaagtttgtgatactatagatttatagagcatagagaaatagaaattttccacatatttgctatgtctcccacttctgcataatgaggttgaaaaaagttac

SEQ ID NO: 214807 - DNA, 324 bp, Homo sapiens
cgaacttatagacagttttattctttatgcactgtctatacctgctttcatgctacaatggcagagttgtgtagttgccacagagactgacagaaaaagttggtcaaattctgccgtactgtgctggtgatgagagcaaacattcttgccttgtttgtgatcttaagtggaaagcattcagtcttgcatgattaagtaatgacgttagctgtatatcataaatgcactgaggaagttttttttctgttcctagtttactgagacttagtggggggttgctttgtattttgttttaatcaagaatggattttggattttgtcaaa

SEQ ID NO: 214808 - DNA, 630 bp, Homo sapiens
ttaaatattttgaatagccctgctaagcagtaatgaatataagaggtctagcctcgtgcctggctcatagaaagcactcaggaaaaggtagctgttattatcattgataatataaaaagattacaatacttagtcattatcaacgagatccctcaactgttctgcatttgatatgatttcccactgacctgtgtcttgaattcctccatgtgggtttaacaatgactttcaaagtacagtgatcaggctgtgctacatacttcaaagtgttctggtaccagctctaaaggagcaggtgctaccttcagtctccttagactgaattagaaataataataaatgatacattatccaggtacagtggctcatgcctgtaatccccacactttggaaggctgaggcaggcaaattgcttgagcccaggaatttgagaccagtctgggcaacatggcaaaaccccgtctctacaaaaaatacaaacgttggtgggcgtgatagcatccacctgtagtcccagctactcaggaggctgaggtgggaggatcttgatcctgggaggttgaggctgcagtgagccatgatcatgccactgcactctagcctgggcaacagagcaagaccctgtctcag

SEQ ID NO: 214809 - DNA, 377 bp, Homo sapiens
tttttaataagtaggagtacacacggcccaggccaggtacagtggctcacctggctcactcttgtaatcccagcacgttgagagggtgaggcgggcggattgcttgagcccaggagtttgagaccagcctgggaaacatggtgaaaccccttctctacaaaaaaatacaaaaattatccaggcgtggttgtgcatacctgtagcccctgctactcaggaggctgaggtgggaggatggcttgagccggggaggtcaaggctgtccaatatcaaggattcctgatatttgcaagtgagcccaaaggtgtttaacccatgagtgagccatgatcgtgttactgtactccagcctgggcaacagagtaagaccctgtctc

SEQ ID NO: 214810 - DNA, 344 bp, Homo sapiens
tgccttgcatccagcccttcccggggagtgtgatgtgaactgccatccaaggtggctgtggtacaggggcagggtctgggggctgcttctgcagcttcagcgcagaaaacccagagctcagtcccagcaaaagcctaaaggagaaggaaacagaggccctaacacaacagaaaatgatgcaccccactttcctgtggttcatcagttcacatacttcccaggagaagtcaaatcacgccccagaataggatacctacttaggacttagtgatgttttatagtcatgtcgaagaaccttcacatccatggcctcatttgatctcacagcaagatgggcatgatta

SEQ ID NO: 214811 - DNA, 463 bp, Homo sapiens
taccagctaaatcctacctattacaagaaatgatactaagactatccatcaaatagtaagaaacttccatctaacagcttaaagttgtaatcatttaaaggaaaatttagaaagccatgtcatccgtatatgtatgtattcatttttttttgagacagggtctctgtcacccaggctggagtgcagtggcacaatctcagcccactgcagactcgacctcccagactcaggtcggtccctagtagctgggaccacgtgtgcatgccaccatgcccagctaattttttgtatttttggtagagagggggtttcgccatgttgcccaggctcatgtatttgttttagaacaaacacacacacacacaatgtgactggcctctgaaacagagcctccagtccctttgcagtcgagccaagtcagacatctgagagcgttctccatgtagggatgtaatgagaaccc

SEQ ID NO: 214812 - DNA, 930 bp, Homo sapiens
aatttcctcaaacaatgctttgctcctctgtgtttgccaaaagaatgcttcagtttagaaatttggtctgtgatctgtcagatgaggatacaaaaagtttaacttaaacacaaacactaggtcacacagggacaggatccagatggttttgtatttgattacaccaccctccatctccctggcatctatatcctttcttctattttccgccatctgtcaataaacctgaacaaagaacttaatcacatatgctatcaacaggtcagtttgattttttttctaccttctctgtcactgggtggttaaaaaagagtatattataaagcagtatctagttttacatcataatttatgtttttcccaaagctaagtaagccttaagattaaggctgggccatttgctcatgtaactccagtatttgagacaaatcaaatgttatatttgatctaatttaatgagttagaataaagtatgtttttcttccattatttgctgttaatatgaattatagattttgttatttattagtaataaaattgtagattttattattacttgattaacattggaaatttagaatcaaccataacaagaaattaacaatagtatttaaagtggtttcaatgatataccttgaagtcagaatcacctgatttactcctggctcagttatgtactagtcatgttgcctcaggcatgttacttagcctcatctataaaggaggtaaaggactatgtaacttgcaggattattgtaggattaatgagataattttgtacagcatttagcccagtgccaaatgaagccctgtgtcaacaaatagtgatcattttcattattaatatttgtgctactattaaaatatctttgaatactatttagatatttaacacaccgatgaataaagtagagtgaaaatggagttaat

SEQ ID NO: 214813 - DNA, 913 bp, Homo sapiens
aatttcctcaaacaatgctttgctcctctgtgtttgccaaaagaatgcttcagtttagaaatttggtctgtgatctgtcagatgaggatacaaaaagtttaacttaaacacaaacactaggtcacacagggacaggatccagatggttttgtatttgattacaccaccctccatctccctggcatctatatcctttcttctattttccgccatctgtcaataaacctgaacaaagaacttaatcacatatgctatcaacaggtcagtttgattttttttctaccttctctgtcactgggtggttaaaaaagagtatattataaagcagtatctagttttacatcataatttatgtttttcccaaagctaagtaagccttaagattaaggctgggccatttgctcatgtaactccagtatttgagacaaatcaaatgttatatttgatctaatttaatgagttagaataaagtatgtttttcttccattatttgctgttaatatgaattatagattttgttatttattagtaataaaattgtagattttattattacttgattaacattggaaatttagaatcaaccataacaagaaattaacaatagtatttaaagtggtttcaatgatataccttgaagtcagaatcacctgatttactcctggctcagttatgtactagtcatgttgcctcaggcatgttacttagcctcatctataaaggaggtaaaggactatgtaacttgcaggattattgtaggattaatgagataattttgtacagcatttagcccagtgccaaatgaagccctgtgtcaacaaatagtgatcattttcattattaatatttgtgctactattaaaatatctttgaatactaaagaaaagagataaagtaataaaatggagtttta

SEQ ID NO: 214814 - DNA, 590 bp, Homo sapiens
  misc_feature (557)..(557): n is a, c, g, or t
ccgttgttcaggcccttatcctgttttgtttggggttcctgtttcccttaatctatcctcatctaagctgttgccaaagtgatatttttactaagccccctggatcctatccctttccagttaaaactgtcagtggtccgcccctgccttcaggatgaaagtcaagctccttttcacagctttttttttttttttttggcatttaacaatcagatcccaaaatgtctttcctgactggctcccaccgcttctctggactgttccaggaccctgactagtgcatgcactctgtaaggtgcttgtgctggtccctcctcctgatagcccttctgcctctgttccaccagattcactcctgatccctcatctccctcctcaaaaagaagtctccctcaattatcaactctctgatggattttccctggtaggtaatcagttctgttcctgtaaccctctagtagcaactatatacaagattgtgatttctattattattttcccctaaatcaggaattatcttccttttgtatattcatatttgtggatcacgaggtcangacgtcaagaccagcctggccagaatgtgaaat

SEQ ID NO: 214815 - DNA, 449 bp, Homo sapiens
gattttccctggtaggtaatcagttctgttcctgtaaccctctagtagcaactatatacaagattgtgatttctattattattttcccctaaatcaggaattatcttccttttgtatattcatatttgtggatccccagcccttagtacaatatttgacacataataaatgctccagaatatctttttcttccttcctgccaggttgtttgtaagttcttttaccttcaatgtgttcttagttttagagttaaaaggaaatgtaatgtagtttaatcttcttcttctttttcttgttttttaatggttgacaaaaccaaagcccagaaaagaaaagaattcaccctgggatgatcagccagatataatggcagggctgtttagggctgatctccttaggtgacttaaaaagaaccttgaacaacagatgcatcagagagagctgcaggt

SEQ ID NO: 214816 - DNA, 412 bp, Homo sapiens
tttttttttaattgagacagagtctcactcgttcacccaggctggagtgcagtggcataatcttggctcactgcaacctccgcctcctgggttcaagtgatcctcccacctcagcctcccaagtagctgggactacaggtgcgcatcaccacgccccgctaatttttgtttgtttttttttttttggtagagacggggtttcaccacattagccaggctggtctcgaattcctgacctgaagttatccacttgccccagcctcccaaagtgctgggattatagtgagccactgcacctgaccaggattttattttgtaagttaacaaattcagtgtaccttagggatagtttttaatgatttacattagaacaatgactctaattcttttagtacccttctgtcgtcttctc

SEQ ID NO: 214817 - DNA, 285 bp, Homo sapiens
ttcggcctgcagactttgtgtttgcgactcttgtatttcagtgttaacagctgccttttttgtacttcctctttcccagatagagacagacacttgattattttcttggttatcacagatgagtggttctcagctttgctgccacctcaccccccagacatttgccaatgtctggaaacaatttgggttgtcacaactggagcagaggtgctactggcttctagagggtagaagccagggttgctgctcagaatcctgcaatgcgtgggacagcccctctccaca

SEQ ID NO: 214818 - DNA, 413 bp, Homo sapiens
agagctaagaacgtatgcaactatattatttaggacatggataaaactgctgtaatagagctcccaaaataaaagtgctctaaaaattactgataaagccgaacgtggtggctcatatctgtaatcccagcattttggaaggctgaggtgggtggatcacttgaggccaggagttcaagaccagcctgggcaacatggtgaaaccctgtctctactaaaaaatacaaaaatttgtcggaagtagtggctcatgcctgtaatccagcactttgggaggccgaggcaggtggatcctgaggtcaagagatcaagaccaccctggccaacacggtgaaaccccgtctctactaaaaatgcaaaaattagctgggtgtggtggtgcgcacctgtagtcccagctattcaggaggctg

SEQ ID NO: 214819 - DNA, 514 bp, Homo sapiens
tctcggaacctattccttccaccataatgtgagaaggcaggattcagctgttctgacgtctctgatgtttgaagaatccacacagtccttcaattaaacctctcctgaggcacttaaaatctccctcttctcgtgacttaggactttgtccttccaggtccctgatggcacagtgaactccatgaggccagggatcatggatttctcaccctgtgtaccttcaagcatcctgcctggtgccctgcacatactggcactcagagaactagatgaaatggaacttatttttacaggtggctatcaaatcccgggcaccctggctttcccgctgacatgatgacacctactggtcttagcaaaaacagcaacttcttgattccactacctaagagctagatggggattgaggagctgataaaaacagcatgtggtcttgtggtatatttaattaagggagtgtgtgcatgttggacacataatagattctcaataaatattttttgaatcagcaaaa

SEQ ID NO: 214820 - DNA, 350 bp, Homo sapiens
ccttgctatcaaggagatgataactccatacatgttactgcccctgcacaccttccagtgggacaagatgtggcggtagaagacagtgatattgatgatccttattgtgtgtaggtctaagctaatgtgtgtgtttctgtcttagttatcaacaaaacgtactaaaaagttataattactacaaatagaaaaaagcctatataaataaattaaatatttttggagagctgtacaatgtgcttgtgttttaagctgacattacaaaagagtccaaaaattgtaaaacatatataaaagtttataaagtaaaaatgttgctgttagctaagatgaatttattatagaagaaa

SEQ ID NO: 214821 - DNA, 446 bp, Homo sapiens
ctagaaacaatatttaaattcattcccctatgtcactagtaaaataccatgacaataaatcattttacatgttttaactatattcaaaaaatgggaaaatacatccctagttcactatcctacgcccagtcaaggacagataactcacatttagactataaagttagttttctcctttagtctcagtattatgatgggattctgttttgttttgttttgttgtattgttctttttgagacgctcactgtgttgcccaggctgcagtgcaatggtgtgaccacaactcactgggaccacaggtgcatgccatgtaaagatggggtctcaccacattgccagggctgatttcaaactcctggactcaagcaatcctcccaccttggcctctgaaaatgctgggtttatcaatatcagccacagtgtccagccacagattctgctttat

SEQ ID NO: 214822 - DNA, 435 bp, Homo sapiens
attgtagaaagccagaaggagaagaaattggtctatgtggtaatcaggaaaggctttaaggaagaattagggcagctggtatgttggttaattgcaggggatggcaagctagggcctacagtcacactaccttgttttataaataaagttttattgtaacacaaccatgcccattcatttacatcttattaaggctgccttctcggtacaacagcagagttgagtcattgcaatgaagacgtgaaccacaagactaaagtatttcctatctggcccttttaaaaaaatttgtcaaacactggttaagaatgtcagctctacagtcagacaaaactgagttcaaatttttgttccataatcattagctatatgatattcagtatgttacttaatctctctaaactttggttttgtgatatgtaactttactcaaag

SEQ ID NO: 214823 - DNA, 356 bp, Homo sapiens
tcctcaagcacatatggagcctttagagatattaaccaccttctaaagtttcaaacgaagtctcaaatacaggcctggcacagtggctcatgcctgtcatcacagcactttgggaggccgacgctggcagatcacttgagcccaggcatttgagaccagtctgggtaacatggcaaaaccccatctctacaaaaaaaatttaaaaatcagtcaggcctggtggcacatgcctgtagttccagctgcttgggagactgaggtgggaggatcgcttgggcccaggaggttgaggctgcagtgggccatcagcatgccactgcactccagcctgggcgacagagtgagactctgtctca

SEQ ID NO: 214824 - DNA, 434 bp, Homo sapiens
agtcaagagtaaatcatctcatttactagtgagaaaatgttggagctggagtccttcagagagtcctggccaggcaagagggccatcagctctcttctgctcaacaggggctctcagcctcaggacactctcaggcctggaatgtccccaacacactcaaggagaaacatgtcctgtgcagacccacaggaggcatctttgcccggcacaaggaagagctggggtcagtgggacctgtagatgtagacacatcatatggagggtgggtaggaccaatgtggcagcttcatggaggccaagtgtggctctgcaccaggaaggggctgtgatggctggaggtgcccagcagtgcaggcggggagtgactggcagtggcgtggccaggtggaggccacctgtcaagtttgcaataaagcagtttcctgaatttggtg

SEQ ID NO: 214825 - DNA, 286 bp, Homo sapiens
gaacatctttaacagtaatattaacactgttgagtccacagcactttaatctgaagttatctttgcattcctttctattactttaataagtattactaaaagctgatttccaccctattctccatatgtctactagaatccttaataaaataagactcttggtggggcatggtggctaacgcctgtaatcccaacactttgggaggccaaggcaagaggatcacttgaggccaggagtcagagaccagccctggcaacacagtcagaccttgtctctatttcattt

SEQ ID NO: 214826 - DNA, 185 bp, Homo sapiens
aacagtcactgttcttttcatcctgtcaattagtaggccacttccaggttaggcattcagtaaatctttcagcttatatggagagacagcctccatatgtacaaaactacttgagtattgctaaggtaacattttagagccctgtctttgtaccttaatagcctacaagccccttctgaccctag

SEQ ID NO: 214827 - DNA, 297 bp, Homo sapiens
gaacaagttcaacatcatcagtaagaagaactatcaatgccataactctgatggaatgcactgggaaggattccacatcatttttgtgctgtaattgccaaaagttcgtaacttcagtccaatcatggaaatacatcagacaatcccaaatcgaggaacatttcacaaatactgatcagtactggttcaagacgtcacggttatgaaagataaggaaagattgaggaactgttattgcagtcctacaaaatggcgagagactaagaaataactaaatgcagcgtgatcctgggtgga

SEQ ID NO: 214828 - DNA, 361 bp, Homo sapiens
cccaaaatgtaactgataacgaacagcccttcagctattaaagaaattaaatctgtaaagatatgaaaaggaagcatccggctggacgcggtggctcatgcctgtaatcccagcactgtgggaggccaaggcaggtggattacctgaggttgggagttcaagaccagcctgaccaacatggagaaccccatctctactaaaaatacaaaaattagccgggcatggtggcgtatgcctgtaattccagctactcgggaggctgaggcaggagaatcacttgaacctgggaggtggaggttgtggtgagcccagatcatgccattgcactccagcctaggcaacaagagcgaaactctgtctc

SEQ ID NO: 214829 - DNA, 363 bp, Homo sapiens
tgcaagtggctttctagggttgcattgacaccgtgcgctgcagcccacccctatctcgggctccctgctgccccaagatcagcgccaagggggctgcaccatggccatgagccttttgcaggactggtgccggagcctggacgtggacgcgcacagggccctgctggtcaccggcatcccggagggcctggagcaggcagacgtcgaagccgtcctgcagccgaccctcctgcccctgggcacgttcaggttgcgacacatgaaggctttgatgaacgagaaggcccaggccgccctggtggagtttgtggaggacgtcaatcacgctgccattcccagggagatcccaggcaaggatggggt

SEQ ID NO: 214830 - DNA, 708 bp, Homo sapiens
aactcagacacagtgacagaaagtagaccagcctgttacctggggtaggggatggcagaggagcgggggatggaggggttccacaagaaaacttctggggacaggggaataagggggatgttcactatcttgaaggtgggggtggtttcacgggtatatacacaggccacaacttattaaattgtgtgttttaaatatgctcagtttaccatacgtcattatatctcaataaaactgttatttaaaacaaacaaaaagaaacactgcatcttctagacgaagcacaaggtgggggctaatcccgggctcaggggccagagggaacagtctgacccttcctccctaacatctgccggggctccggggaggtgggcaccaggctccaaagggcctgaggtttctttactcacgacactgcaggggaagtcctggcccaccgcagacaccaagaaactgaaacctaaagacattatgttgcccaaggaagttacacagcttgtaagcgatataaccagatcaaaagcaatctgtgtgatgccaaggcctttctcccattcatctaccacaagttcaaaaacgccgacctgaaataagtaggtgaagattgtgtgtatgtgtttaaaacagaccgttctctccactgaagccagacagtgagagccactctggccattccagaagcgtcaggcaccgtgggcacagcagctg

SEQ ID NO: 214831 - DNA, 376 bp, Homo sapiens
tgtattctctcctcatccttcagtccccacactgttttaaccctccaacatcttagagtcatgtgaagtgacttatcaaaaccagagactcaggcagtcacagcccttcatcattttatcttatcctatatatccaagatcatcatgtgcttttaaaactctcccttgtccacaagccaggattctccagccttttcctatgcttctcttcttctctccccgttacaacaacttgaagttcctccaaggccccattggagccccatctccttcaccaagtctttcctctttactccaactcattccagctcatcgttgcattcctatggtgtttgccactgcacctatgtactgacttgtgccattccttagtggt

SEQ ID NO: 214832 - DNA, 448 bp, Homo sapiens
ggggaaaaaccccttgaaattgcaggtggggggccttggccatccagcaaaataaaggaaaaaaaaagccaaaagtcactgtggctttctggtctcagtgccactggcaaagggagagagagtggaaaggagggaagtgggagttttagtagaagtgggtgagggagagatgtgttcagtaacctctgctcagctagaccctgcaaatggatgggatcggtagttggtgatttttttgtttgtttgtttgtttaactcagtacatgcagattttactgccaatctatgacttgatcccaacccattcccaaaataaaagaatttaagcatcctgactgcagtgccagcttctcatctgctaccctacatgtcccactgcagatgtcttttgataataaaccaggtttatgatgctgtaataaaccatggctttaaagagggcaagaga

SEQ ID NO: 214833 - DNA, 543 bp, Homo sapiens
caggtcacacagctggaaagagacagagctgatattcaaacccaagtttgtccctcaaactaacaccccacactgctttgggagtggacatagtgtcttgaggcttgcagggtatgtcacagacaccagagcagtgtctttggtgctgggaatgaaatgtttgttggcatttagtgtgtttactgggtgccagtcccctcactaagcacctgcattatgtctcccacatgggattctgcaaagtagaaattttacgtctcacaggtgaaggatcaagctcagagaggttaacttgcccacagtctcatgactacaaagtggcagagcagccaggatttgaaccctggtagcctggtgccagagcccaccctgttaaccacaagcagagaggttcttgatattctgatcccattaattatgagggagaaaatgtttctctgctgacaaattgttaaggggaaatttaccctcatttctcctgagccttaggggtgtcactcttaaaatcgcatattcaacaaacaaatgccttctaagtactga

SEQ ID NO: 214834 - DNA, 497 bp, Homo sapiens
gccagtgcatcccagctccagagcaccatctcagcccataagaaaaacatgtcatgacagtaaatcaataaccccttggagatgattcgtttctgaaatatccctgattaattatgccagtccatgcttggcaagagtactttgctccagcattaacctaatgctttttgcatgaagcaggattataacgggttctcataagtcaaatttgacattttaaatcaggctttaaaggtttgggttatagattttataatgtctccatgtcaaacataattgctcttattgctgctagtagacgtttgccaatcaatcaaaataacatttattttcatcataaacaagggtaaattaaaaccatttgaaatcattgtatttgaaaacttagtgaagaagcatctttagtaccattgaaatttgcttcctcactgtgatacatgggagcgtgatgaaattataaaagtcgatggaaatgtgttactattttcaccttgaaa

SEQ ID NO: 214835 - DNA, 243 bp, Homo sapiens
  misc_feature (94)..(94): n is a, c, g, or t
tctatctcaatagatgcggaaaaaaccttggacaagatttaacaccctttcacgataaaaaacactcaacaaattaagagtagaagaaaactancctcaacataatgtaggccatatatggaaagccacaactaacatcttaatcaatggtggaaaactgtaaggttttgctctaagatccagggacaaggcaaggcacttatattcaccatcgtattggaagtcctagccacaacaattaga

SEQ ID NO: 214836 - DNA, 488 bp, Homo sapiens
aacttgtcagcttgttggttatttttttcattgtagtcacatcagatctaccccttggttcatgtgcatgcgtgcgcacacctccacacacacacacatatgtatatttagtcctaactttccattgtccgaattccagttcacactgtgctctttattgcagagtctctttgctagttgtggctggttaagtgcttgggctcccaggagaagatgatgtcacagtccttgtttcccacctctctcctgtgacttcctttgaagttggatgacatatatcccagattatttgggacagtcccaatttaggtcttctgttccagaataatatgaatggcatcccttttcactctcaagtgtcctggtttggacaacaaattacagtcagccctctgtatccatgggttccaaatccacagattcaaccaatcttggatggaaactacttgaagaagaaaacaacaacaacaacaacaaaatacaacaac

SEQ ID NO: 214837 - DNA, 695 bp, Homo sapiens
tttttaaaatactggcttcagaacttcaatacatacactgagcttgttaagcatattaatacacaggctcacggatttcctagtgaacaataatttgtaactcttcttcctaaatgtctggcctttgctaactttattttaatgattaaatcctattttgttaaatgaatgtacctggaaaatgttccacatataattccaatttgagtcccaatctcagcatttttggttagattattggtacgaaggctttctggatactccagtgtaaggaaatgataatgcctccctctcagcatttggtattgatccttcttccctaattagaaaagaatttggcatcttagagaaattattgattcaacgtatgataccaaaagatcaagtagtaaattgggaattgcaggattattcctagaggaaaaggagtatcccattatgtttttacagaaatcaattctttactttagacatcctgaaaactaacgctgctttttagccttctctagctgttttttcctgacaatattactgtgtgttttttgacattttagtttaatgttaaaaaattaatctattatatatgtttacatttattgaatatattattacttcttttttgagatcctgttccatttgtgatccttataggaataatcctgtattgtttttttgatgagagcagcatttggttt

SEQ ID NO: 214838 - DNA, 540 bp, Homo sapiens
gcatttgtattttgtctactatgtttttatgatattagtgttcagagcatttgtattttgtctaacatttactaccttaaatattttgtcagtataaaatatttaaggttttgctgcttttattactttatgaacacatttgtcaggaatctgattgttagaaagcacattaaatagaattctacttggatgtggaatctataaagagtataataaggttttgatattgaggatgtcagtgtatgaacagctataacaatccacattaatctattttctgtagttgtgttacttctaactttcagactttatcctttctttcatatcttgtgtcttccctaaagtggatccagtcagttttctggttataattacaattgaaaaaaaaaaaaaattcaaccatagttacttctttattcaattacgttgttattgagcgcttcctgtaacatttggtaatgatcataacaagtaacacccaggtacttacaattggccagacattgttttaaatgttttatgtgtatcaacttatttaaa

SEQ ID NO: 214839 - DNA, 467 bp, Homo sapiens
gggtagggaaatgtcaatcatagtttaaaaataaagatatctttgagaatacttccaaagataaaaatgaagtaaaattgtgacattttggtcctcccttgtcaaaatgtgtaatttgacaagtcaaataatgtagttagtaagtattgaccacagttgtcattgataatggtattgaggtatatggatgtctattttgtgcattatttggcaatgtttaagaagttaacagttgtcagtcattgtctgaaagtgagtctgtaagtgtattgttcagcattttatcacccatgaaaaccctttttttatttaaagcatcactctattgaatggtactaaaggtacaaatttgttggggctgagatttttttcttagtttgatttttttttttaagagcatttacttaggaatgttctgtgttctaatactacttatttcagccaccagagagaaccctatgccagtt

SEQ ID NO: 214840 - DNA, 516 bp, Homo sapiens
tgaagcaaaggatcatgttttacttgtcttgggaggctgtggttaagagctagctggagtggcagaattagacatagctgggtttgaatcctgggtctaccatttgctagctccctttgacaaggcagctttgtattgctaaactttagtttgctaatttgtaaaattcagacaaatctagttcataagactccttgtgaggatcaagtgcttgctgagcacagcattattagatatgcagcaactcccttttcaactagattgaagaagtcaggatagagttttatttttaattacaagcatgttcttaaatttgccaggagtagaatgatatgaattttaatgtctacgtgtgagataaattataaatttcaagggagatttaaaaggtgttgaggttttttcaacaatatgaaaattgagcagagtaaaacagttacaagtgacatgttaatgatatacaagtatgtcattaatgacataacataacttttctaactttgtactagactttat

SEQ ID NO: 214841 - DNA, 618 bp, Homo sapiens
taatctgtcctcagataatcagaagttaatagtattctccagccctattgtaatcaaaagactgttacaaaaattcaggccaaaagcttttgcaagctatttttgtgaaatacaaaaagactgtaaagtgttggtaatgattagaaagcccaaggctggaaagagtcaagggagagaatgtatatggcagaagagcagtccactggatgggtctgcagggcagacttgggagagggaatccaggaagctgcatggaagctcacacaaatctgcagctctcctccccaggcgggagatgaggctgacagcagggctgaggcactgcctcccaagtcctgcagctctgatccaggatgctggcctggggaaagcaacgcacatactcactgcatgatgcggggttaggggagcatggcaaccctgctgagcggtaaatgtgctcagtcgtttttttcccctctacctaaagcttttcctgtcaacagcatccgagttacttagtatctctggagcaactcagacagaggggcttaacagtttagaagaaacagcttatgattccccacctaagagaggaaataaaatgcatttaagtgaatgcctcccatttaattaaca

SEQ ID NO: 214842 - DNA, 390 bp, Homo sapiens
cgaaagcaatattccaatctattctattccccaaagtaaataaaatgttaaccccaaacaagaaataaacgtaggttgaaaaccaccaatgcccaccacaatggttttgcgtaatacccactcggacaagttgaagaagtttggtggcagggggcgggagtgaagatattttcactggattctttcttgtccttgggtcaagacatgaaaagtgctggtcagtgcgaccatagagactgggatggggcaggtctctgatggagacttcaggagtctgaacacaacactgtcccatttgtgacatttatgaatgccatgatgatgaaattcagagaaatgatgaagttggggatcataccccaactctgggtcctgaaacatttggaactc

SEQ ID NO: 214843 - DNA, 377 bp, Homo sapiens
gaattccacaaagactaaagaaatgagttttcatttgttggtcatttgtcagctacggaacttaattctttactaatctttagtatgtcaatatctgatccttaactcctccctaaaattttgaccccttcccaattaatccctctcctgttcagtataaacagagcaccatgaacacaaaccaagtagagactttaaatggaatggcccttaatcatagatcctccttcttttcctatgtaggggagtctatgaacactctaatgttaatcctagctctttatgcaaatgtatgtatgaaataacattaatgtcataatattgtttcatgggcaaaaactacaaaattcaaaacatatttgctgagcattaaccat

SEQ ID NO: 214844 - DNA, 470 bp, Homo sapiens
agttgggcttcggaatgactccccccccgccactttacagatggagaaaccgaggctcacagatggtaaggaactggaacgagatcacagagctgggaagtggcagaatttgatttgaacccaggcatcccggccccagagtgggaataaaacagttgcatgccagggattacccaccagatggatcataacagctgcaaatgtgctcggggcttcccgctcacacacaggatgaaacccacatttcttcctgtggccaactggatctggccctgccgcccctgctgcctcctctccctccatctccgctgaacactctgcctcctcagggactttgcacatgctagccttttgcctgaagcagtcttcccccagatgcatttgcctgaactcttcagtctcagctcaaacgtcactgagaggcatcccctgtgcccccagctgtgcccctgagaaggtactgactaaat

SEQ ID NO: 214845 - DNA, 526 bp, Homo sapiens
tgagaggtcaggtaaaatgagaagaaagaataattggatttgatagcatagatgttcttggtggtttcagtctctggaatggtgggttcctaagcctgattagattagactgagtagagaaaaggaggtaagaaaggatagacagcaacataggttcgatactttgaacaaatttactaccaaggagactggagatagggaacaggaattagagttacatgggatcacaagaagtgtttttgttttattttgaggtaggggattttaaggcatgtttttattttgagacttctaacagaaaaaaaagtacgaaaagaggagaaagaagatggggtccagagcacaagttgagtggttgtcctataatacgagaaaggatatttcctcttcagaaggctagtgttgatatgggtgttgatcagtttgttgctttgatgggaagatttatgactccctgtgttaattgcatctgttttcttagaggtaaggtctttagctgataaggagacaggttaggaggttttga

SEQ ID NO: 214846 - DNA, 267 bp, Homo sapiens
ggcccaagcaatccttccaccccagcctcctgaggagctgagaccacagttcttttatgcatggacaaccgtgctgatgatgcattcagtttaggagaattttccaattgaaaaagtgctctggagaagtttaagtgccatgaatcacccaaacctcatctaagtctcgtgaaggcaaaggctgtgaaaggcagtcacagagagaagacatattgtagttgtgctgcctgattcaactaaatagaaaaatattttgtaaagacatga

SEQ ID NO: 214847 - DNA, 442 bp, Homo sapiens
ctgcctacagtagtgagccagaataggagggaagttcccagttactgcagggaaggtgggtgaacttcctgtatgttttatatatatatatatatatatatattttatatatatatattttatatatatatattttatatatatatattttatatatatatatagtatgtatgcaatggatctgttgattgggtttaagttacttttatttaagctgtaattgtttcagttctgctgtttgtggaagttagtaagctaaagtatgtagggaacatgtttacttaaaaaaatctatgcacatttaagaacgattaattctgcagctacttgggaggctgaggcaggagaatcacttaaacccgggagatggaggttgcagtgagctgagatcgtgccactgcgctccagcctgggtgacaagagcgaaactgtcaaaaagaaa

SEQ ID NO: 214848 - DNA, 397 bp, Homo sapiens
gagatgaagtctcgctctgttgcccaggctgcagtgcagtggcgcaatctcgggtcactgcaacctccgcctcccaggttcaagcaattctcctgcctcagcctcccgagtagctgggactgcaggtgtgtgccactacgcccgtctaatttttatatttttagtagagctggagttttgcgatgttggccagactgctgtcttaacttctgacctggtgatccgtctgccttggcctcccaaagtgctgggattacaggtgtgagccactgcacctggccagggatgtaatttggaagtgaaaaagtatataggttgttgttattcctgagagtagaatataatgatagctatgtttattgagtgttgttatgttctaggctcttgttatatactg

SEQ ID NO: 214849 - DNA, 872 bp, Homo sapiens
agcacactgctgccttcacttgaccttcctttcatcccctcagacctggctgaggcctggagacaccttgctgcaccatcatttcacctgagcccagcccagctcaatgctcccccacacgctgtcctgcagtccgcatggacctgcctgagacctggagacaccttgttgcaccatcatttcacctgagcccagcccagttcaatgcttcccacacactgtcatgtcgtccacgtgggcctggctgaggcctggagacactttgctgtccccatcagttcacttgagcccagcccagttcagcgctccccacacgctgtcctgcagtccgcatggacctgcctgagacctagagacaccttgctgtccccatcatttcacctgagcccagcccagctcacagtgctccccacacgctgtcctgcagtccgcatgggcctggctgaggcctggagacaccttgctgtaccatcatttcacctgtgcccagcccagctcaatgctcccccacacgctgtcctgcagtccgcgtggacctgcctgaggcctggagacaccttgctgtaccatcatttcacctaagaccagcccagctcacagtgctcaccacacactgtcctgctggtccacctgtctggatgtgaaccctcctgcttgtgtctcctctctgtatccatgattagccaggcacctggcttggagtaagcatccagtaatagatttattcagttattagttgattagctaatgccttggtaagggttactcaagccatagatgataggtgaaaatgaacatcaataaaatacgaaatttacccttgggttttttatattaatagttattttcaacagaaagtcaaattgagtcaa

SEQ ID NO: 214850 - DNA, 642 bp, Homo sapiens
taaccaggtaacataaccattacctctacctaattccagcacagtttcatcactccaaaaagtaacccataaccattagcggtcactctccgtaccctgtcctcatccatccacttcccccacgctggcaacaggtagtctatttcttgtctgtatggatttgcttatgctggatgtttccatatccctggaatcctacagtatgtggccttttgtgtctggcttctttcacttagcataatgttttcgggttcattcccaggtgatttttaacaggttaccaaggttgaggaaccatagatctgcctctgcagacacccaccctgtccatgtgtgttagcttcccacacagagccatccgtggcctggctttgagcagccttctggccaatggcaggctgtacttcctggttcctgtgggaaggagcctgcaccccactccacccacaccagcagcccctgttttgagtgagtagcaggcacctgtgttctgctattaaagcacacgcttctcaaattattacctttaactttggccagccccaaaatttgtacctccattttctcaggattttaatgagaattaaacaatacatgtttaatttagaagaatgcctggtactcaataaacgcctattaaat

SEQ ID NO: 214851 - DNA, 177 bp, Homo sapiens
acataagtggccaaaatcacacgaaaagatgctcaatatttactaatcattagggaaatgcaaatcaaaaccacaatgagataatcctaatcacctaatcaccattagaatggctattaaaaaaaagacaacagaaagtggtgttgatgaggatgtggagaaattggaaaccttatg

SEQ ID NO: 214852 - DNA, 213 bp, Homo sapiens
gaagagggggctacagagccccctcttcaggactcatgatgcacattaacatgctaaaggctctgagaagtcctgaaaatgagacaccagcttgactttgtttcactgaatgttatcgctaattagccagttactcccttttttagatgaacacttattgttacccttttaggcatgctgccttcaaaaaaagcttcaactgctggcttagaa

SEQ ID NO: 214853 - DNA, 456 bp, Homo sapiens
aagaaggaaggaacatgactttgttgcacatagtcgtataagtaaatgacagaatgagaaagagaaaaaagatatatagatggaaaagaagtgatgagaatatagcaatgtttgaatttatcaatgcttgaatttatcttattctaaagaataagaataattttgatgggccaggcgcggtggctcatgcctgtaatcctagctctttgggaggccgaggcagctggattgcctgagctcaggagttcgagagcagcctgggcaaaatggtgaaatcccatctctatcaaaatacaaaaaattaggcaggcgtggtggcatgtgcctgtagtcccagctactcgggaggctgaggcaggagattgcttgaacctgggaggcagaggttgcagtgagccgagaccgcaccactgcactccagcctgggcgacagagcaacactccgtctaaaaaaaa

SEQ ID NO: 214854 - DNA, 428 bp, Homo sapiens
cctccgctgggacccaggcgtgcgaccggctctgcctcctccgcagttctgcctcaggacctttgcatttgccatctcctctgtcagcttcagttcccgatgccgaaatggatctccatcaccttcatattgaagctcaactgtaacatcagcaaggcttcctgcaatcccctactttactagttcagcacctcccaccaccacaccccctggaaaaatttcccctcacttccttaatttcttccatagcacaactcatcagcatctgaaattctacacgtatttatggtttataccctccgagtagaatgtgagctcattgaggtcagggaattctgttttcttcattatgatatcctcagcacctagcatatatttgaggttcacatactgaccaaacgaataaaggaatatgttaatttttaaaa

SEQ ID NO: 214855 - DNA, 451 bp, Homo sapiens
ttcctcaaatcatgggagagattttcaaagaagaaaaaatagaaaatattttaatgcactttaaaaatacaggtttgtctgcaccatctgtcaggtaaaaaaaaatgaattttagggaaagagcacagatgtttattaattcaatgtagaaagtatattactggctgggccaggtgtggtggctcacacctgtaatcccagcattttgggaggccaaggtggatggatcatgaggtcatgagttcaagaccagtctggccaggatggtgaaatcccatctctactaaaaatacaaaaattagctgggtgcggttgtgggtgcctgtaatcccagctactcgggaggctgagtcaggagaattgcttgaacctgggaagtggaagttgcagtgagccaagactgtgccattacactccagcctgagcgacagagcaagactccgtctcaaaa

SEQ ID NO: 214856 - DNA, 276 bp, Homo sapiens
tgtagctgagaaaggaggctgtatttgactgtttgtcttggggactcataggctaagtgcccctggttttttcaatgtggacctcactgtctgaactcttgtgtgggcacgtggattttttctttttaaattcacaaataacagtgagttgaaaagccctgtctctagcgtaggaatgctgaatttgtctcaaatcaggtaagtatgggactttgctcatacaagttaatcttgccattaatccttgatacaatttcagtagacttgggtacagca

SEQ ID NO: 214857 - DNA, 425 bp, Homo sapiens
taaactatgtttgggttagttgacctctgtagctattctaaagttttctatcccttatctgtattccgctgtcattcctgtgcctcaagcctctgccaggaatctgatggtactctggctgaacttaaaacataagaatctcaaaggtctcatttagtaaatgttagtgctaagttggtgacagcctgggttatatgctttctctttcagtcttcagtagatgcttgtgatagttttcaaagaactgtaaaatttccgggtctgtacagatttttagagatcatttaatccaaccctgttacagtatcatgtcagcatttaaatagcagtaaaggtcatgaaaagtgaagtgaaaggcagcaaactccatgaaaaactaaatacagtgacaactgagggaagtggtaaagtaaaaaaatattaat

SEQ ID NO: 214858 - DNA, 378 bp, Homo sapiens
cttaacatcatttttgactgctttaacaaggactgttgcaccgtaactttcaatgttagcatgtaatgcttcaagtcattttttaacaactgctgcaccatgttccatagtttcagtatatcatggtttagccatttcccaaattgatagcagtttaagttttaactttaaaacagcttttttgctggtggtggttctctgatgagatgaaatttcggtgataggagcacagatctacgctaattatcgagattcggcatttatgatgaagttctcttttggttaagaaattgatatgtggaagcagccacccctcccctatggtagttctgactctagcagttagaagttgtgtgaccttggggaggacattgaatc

SEQ ID NO: 214859 - DNA, 734 bp, Homo sapiens
agcacagttcaagagtctgaatcatttaattgtgttttattcatatctgaatttgcatctgtcacaaacccaatgtgtccaccgtgaaaaattgcatccttcaaatattactgaacaaaaaaccctattcaaataggtctgttctgtctagattgtctgtgaaatttctgaggaatgttgtgggctctgtttcctgtaccaaattgttgagttatcacacatcattggattctacccaaagtgtgctggataggcatattatattcagacaggataccagttgtctttaccattcataaaggaaaaagaaaagattactcctgctccctgccataagatataaactaagaagtgaaaatgtgtgtacccatagtttttttaatgtgtccttgatttcttttcttcaccaagatttgagttttattcagtcatagctttgttatgcactttcttgtcaccctgtacttgttcaaaactaaggactatagtcaagactcagatcctgccctgggattggtgccatcttagcttgtttggaaaaaaaaaaaaaaaaaaaaaaagatctttagagataccatcatatccatttgtatataaaaagagaaaagaatggaagtgatgctgtgtaatttattttcatctatttactctattttccaaattttccacaatgcgtatatattttataatcaagataatctgttactttttaaattttttatttttaatttttg

SEQ ID NO: 214860 - DNA, 458 bp, Homo sapiens
cacctgctctgaatgtgtggctaggaggctacccaccaataaattctgaactcctcctattacaaggatcagtaaggagagaggggacatgggtcacacaggtacagacattaatatgaccataaggaaatattatgaatagctttatgcccacaaattcaaaaacatggatgaaatgggcaaattccttaaagatgcaaactttcagaaacggaaaagaataaacagactatctgaacagctctatattaaagaaaactccagccccaggcagcttcactagtgaattctagcaaatatttcaggagaggtaatacaattttctacaaactcttgcagaaaattaaagggaagggccagcaaataactcagaaaaaagacattacaaggaaccaaaaacagactaacacacctcatgaacacagacagaaaaattgttaacagttttttttgttgtt

SEQ ID NO: 214861 - DNA, 585 bp, Homo sapiens
tgcggtggctcatgcctgtaatcccagcactttgggaggccgaggcgggtggatcacctgaggttgggagttcgagaccagcctggccagcatggtgaaaccccaactctactgaaaaatacagaaattagctgggcatggtggcaggcacgtgtaatcccagctacttgggaaactgaggcagaagaatcacttgaacccgggagatggagattgtagtgagccaagatggcgccattgctcttcagcctgggcaacagagtgagactccatctcaaataatggggaaatataacttaatgaataactaataagtaagtaaatgaccagagagtgctctttccattttctcacacaggaatggacagcaagactaccctttgaagccaattcagtttgtactctaagacacagattgatagaggggtgcttgtataaagaataaaacctcagctaattctgaactccaggaaatgctaatgttggccaggcacggtggctcatgcctgtaatcccagcactttgggaggttgaggtgggcagatcactggaggtcaggagtttgacaccggtctgaccaacatg

SEQ ID NO: 214862 - DNA, 518 bp, Homo sapiens
tgtctaaatgtatcccatgactcccattatcccctggaaaaagttaacaacttgcttggcccctcagaaccttcaagcgtgtgcttctggagctatgcctcatgcagggtccacatcattgcctgtgtgcaagccacatggacacctggagcacactgtgtgccctgtgctttccacaccctgtgcctgtacacctgcccctccctgtgctcagcatgtccgggcccggctagttcctcctagtcactcagtatgcagtgtagcagccacctactccaggaaggcttccctgcccctccagtaatacacattagaaaaccctctgtggggcttctggaaaacttggtgtcagcctgcatcatagcagcttcgacagtgtttctcaaactgtgctttgcagagtcttctatgttccaaggagacttctctgtggctaccgcaagttgtggtatctcttctgtgcttagcttcattatgagatttcctttgaagaaggatttccaagagcttgaaagaag

SEQ ID NO: 214863 - DNA, 470 bp, Homo sapiens
ttttcttttctgagacaggatcttgctatgttgcctagtctggagtgcagtggtgtaatgaaggctcactacatccttgacctcccaggctcaagtgatcttcccacctcagcctcccacctgtagctggaactacaggtgcatgccaccacatccagctaattaaaaaaaatttttttgtagagatgggatctcactatgttgctcaggctggtctcaaactggcctcagtgtcttgcagtgctgggattacaggcattgtttgttgtttcttaactttgtttatggtatctcttgccacagtaaaattttaaagttttatgtagtcaaatgtctctcttctcttttacagtttctgggtttccagtcttggttaagaaggtcacccgcaccctcagattgtatatgtagtctcctagattctctttcaggatttgtatgattttaaggttttcattttttttttaaag

SEQ ID NO: 214864 - DNA, 467 bp, Homo sapiens
ttttcttttctgagacaggatcttgctatgttgcctagtctggagtgcagtggtgtaatgaaggctcactacatccttgacctcccaggctcaagtgatcttcccacctcagcctcccacctgtagctggaactacaggtgcatgccaccacatccagctaattaaaaaaaatttttttgtagagatgggatctcactatgttgctcaggctggtctcaaactggcctcagtgtcttgcagtgctgggattacaggcattgtttgttgtttcttaactttgtttatggtatctcttgccacagtaaaattttaaagttttatgtagtcaaatgtctctcttctcttttacagtttctgggtttccagtcttggttaagaaggtcacttgagtccaggaggttgaggttgcagtgagccctgtttgcaccactgcactccagcctgggcaacagtgaggccctgtctc

SEQ ID NO: 214865 - DNA, 461 bp, Homo sapiens
ggtaggaggacgtccgctctaagaacagaagggaagtcaaggggctccctggacggcacggagcggttcttctcgtcactcacccatccccacctgggttcggtcatcgtccattgttggccccgcgcactaccattttcttcttagatttcttcccattcttactgtgccccgctcttaactcgtcagcctggctattgcagtagtctccaaatggactctacctctctctctcctctccgccccagcccatttgcacacacagtcggatgtatctttctgagacagcacctgcatcgtgaccccacaaccttcaatggctccacatcccatggatgggagggacacagcccagagccagcctaaaatccaattcctaccttcgtcccggccttcaggttgaattgtaatgtattatcttttagttgctactaaccctgagccattctgcaagactggaa

SEQ ID NO: 214866 - DNA, 819 bp, Homo sapiens
cgatcctcactgctgtgacactcccatgtgtcccctaccacctagccaaatgataagataaacagtttggcttgattcacaccttcatgctcccaacgaccatcctgtctgaaacatcctcatgacttttatctatctctctcctagcacctattcaattacaagtcaataattccaggaagcctttacagataaagccacttttgctctttcccatcccctctaacaatactgatgccttttttcctaaaccaaaaatctagatttgttgcttaacaatgttggttgtatttatggggacaatgggacagaatgcttgcagttgttgcagctgccatttatcctcatgattccttacaccctttactgtgaattgttttatagatgtgctttccagtataaatgtgctctccaattagattacaagcttcttgaaggcaaggattcagactcctactaattttgacttctctttagaccaggggtctaaagttggctcaattctccaattgtcatattaacctgaaaatcccttaggaaggcatgccagagtggatatcaacatactgttctctaagtgcaacacagctatttctttcaatagaattataatgaatatttctgttaagaatagataaaatacgccaggtgtggtggctcatgcctgtaatcccagcacttttgagaggtcaaggaaggaggatcagttgagtccgggagtttgagatgagcctgggcaacatggcaaaacctcgtctctacaaaaaatacaaaaaaagtaagccgggcatggtagtgcatgcctgtggtctcagctac

SEQ ID NO: 214867 - DNA, 409 bp, Homo sapiens
tgtctcccaggctggagtgcagtggcgcaatcttggctcgctgcaacctctgcttcgcgggttcaaacgattttcctgcctcagcctctcaagtagctgggattacaggcacacgccaccacccccagctaattttgtatttttggtagagacagggtttcactatgctggtctcaaactcctgacctcaggtgatcctcttgcctcagcctcccaaagtgctgggattacagacgtgagccaccgtgcctggcctcatttccagcatctctgttgcatttcatcccgtctcctgcaccacagcatcactccatttgtcctgcctttgggcgtccaagaggaagcctgccctttgtcacagcactttctgtttgggtagctttaagtgtctcaccccttcttttctctc

SEQ ID NO: 214868 - DNA, 306 bp, Homo sapiens
aacatgtttagattttcattcattgcaattaatatgcttaatgaagctcaaattgttgttacatctttgaccagtgggagcctgcccctcaccctctctctctttttttttttgtaaagataggttctttctctgtttccctttcctttccttacttttcaggcagagttttgctatgttgcccaagctggacttgaactcctgtgctcaagcaatcctccagcctcagcttcctgagtaactgggactacaggcacgtaccaccacacccgactctgctattgtttctttaaataaacattctgc

SEQ ID NO: 214869 - DNA, 733 bp, Homo sapiens
cagagcatttaagaaagcttaaaaattctagaagagcaaattagcaaaataaattgaagagagaggcaatcaacacaagaggagaaatctccaatgtctctatcgtctcatccccggggaatcacgccttcccagtgcctacttggtctcacccttggtgcatcatgcctctccagtgcctggactgactaatctctagggattcctgcctccccagtgccttcacagcctcatctctagggaatcctgcctccccagtgcctgcgcggtctcatacctagagcaatgaagaaggcacggaatgaaaggtgatgtggatgcggctgcagatcctcttcctgcctgcaggagccctggtccatgggcaggtcctctcagtctcaccttcctcgtgtggcaacagggataaccattcgtacttcatgcactggttttaagcatcagatttcctcatgtctatagagtgccacattaaaaatcacttaaatgccagtgggctgtcctttttgtgtgtaatttttttttcaagctattttcttaagacattttgccagaaatggaattactgagtcaaaggaggtagacattagccacaaatgtcaaacttacttatgggcaattttaaaatggcctttttagtttcaagtactagtatttgaaaaaagatattcatctataatggatccattatatgtagggcaagcagtcctatttcttttaaacaactttctaa

SEQ ID NO: 214870 - DNA, 397 bp, Homo sapiens
acaagagcacatagagaatagaactacaatgaagtgactatggcacaaaggcaaaaagctgggagcctttccaatgttgccaagcagcctggcttaaatgggggctaaagaactcagaaaaaggccaggcacgatggctcacgcctgtgatcccagtactttggaaggccgaggcgggtggatcatgaggtcaggagatcgagaccatcctggttaacatggtgaaaccccatctctactaaaaatacaaaaaattggccaggcgtggtggcgggtgcctgtggtcccagctgcttgggaggctgaggcaggagactggcgtgaacccggaaggcggagcttgcagtgagccgagatggcgccactgcacctggacgacagagagagactccgcctc

SEQ ID NO: 214871 - DNA, 583 bp, Homo sapiens
tattttgttgctcaaattgtcccaaatttgacctggggaacttttaaatttctcacaatttatcccatctcagaaaattctaatacctagaactagcttattatgagaattctgttttgtcaaggaatcttagaaggctaaggaatagctaaacttcagcaataagactaaattatttttctaattctttttcattccaaaatggactttattaaaatgaggatattgggggtctgcttgatttgccattgtctaaagctgagtttcattactaaatcttaattgatctgtttactctttgctctaaatgcttggaggggagcccaaagggccatcagtatttgtatgacaataatagcgtacatggctaaaacacaatctcttaaaatcatttctcattaagagagagggagagaaatctatagtgacatctgacaaagctgaatggtcaatctgaaaataaagaactgccaaaattaagaaagctgagaaacagctagagacaacagaacaggtcagtcgtaacagagttacggaagagatgattgtctccaattgccacagttgaaatggaatgctttgt

SEQ ID NO: 214872 - DNA, 909 bp, Homo sapiens
cacatgtgcagaatctcttttgccatataagtgacattcacaggttccagggattcatacgctggctatctttggaggccgttattcaacctgccaaagtgagatccattcttattgttgcatgtatttgtagttcattcattctcattgctgtatagtcttccgtttgtttatccatttttcattacatccaaaagttattcattctcccattaatagtcttttgagaatttttcaattctgagctattatgaatagtactgtgtagaacattcttatacatgtcttttggtgagtgtatacatttccattgagtataaacctaagaatggaattgccaggttgtagggtgtgtatattttcagttttagtatttactgtcaaacagttttccaaagtgactgtaagaaggcaccattttaatgtgtagcataaaaatgaattacgctaatgatcttagtgggttgaatttctcgaaacacctaaattgtaccaaatgagttatattgcagcaggtatgttgttaatttcatataacaggaaaataagagcaaaagtaattgcccttattaactgacacattagtattacatactcattaggttattgctccttagaaaaaatgcgaattttaagtaatcgtaagtagtatgttgaattagtatgttgtgggaaaatctgtgatttaattttttaattgaattttaaattttgggttataacctcattaaaatgcatgatatttccttatataggtttctaaattatgtctgtccaactcatctatatccaaatggccattaggaagaattatccaattcagatggcataggcactgccttccaatttcttcatttgtatttttttgttgctgttttcttttttgcctctgtccccaacaatttgacc

SEQ ID NO: 214873 - DNA, 726 bp, Homo sapiens
agcatttaagagtcactattatgttttgccagttaaaattttttaaatcttttgaagagagaaacaaaatcttcagcgttcttgagaaataaaattattgttcagtaagtaattttccatccccttgaatatatgttatatattctttttcggcagattatcagattagtaagtgtttaaaaggcatcagtttttaaaactgcatataccacacacacacaaaacagtacacaaataaaggttttcacaaattaaacaaactcacatactagtcttcagatcaaaacacagagcattatgtgtaccccagaagccctcctctttccccatcttaacactgtcttctttcttgctgaaagttactatcctgacttctaaaatcatagattagttttgcctgttttttattttatgtaaatgtaatcatacataatacactttttttcattcatcatttttgtgaatattttagtttcttgttgccactgtaacaaattaccacaaacttagtgacttaaaacaacacagatttattcttttatagtcctggagatcagaagtccagaggttgtgagggagaatgttttcttcccttttttggcttccagtgacggcctgtatttatgggcttgtgaccccttcctctctatgatcaaagcttgcttttgtcattatatcatcttctcttctgtagtcagatctttccctgcctctaagtttagggct

SEQ ID NO: 214874 - DNA, 521 bp, Homo sapiens
  misc_feature (476)..(476): n is a, c, g, or t
agcatttaagagtcactattatgttttgccagttaaaattttttaaatcttttgaagagagaaacaaaatcttcagcgttcttgagaaataaaattattgttcagtaagtaattttccatccccttgaatatatgttatatattctttttcggcagattatcagattagtaagtgtttaaaaggcatcagtttttaaaactgcatataccacacacacacaaaacagtacacaaataaaggttttcacaaattaaacaaactcacatactagtcttcagatcaaaacacagagcattatgtgtaccccagaagccctcctctttccccatcttaacactgtcttctttcttgctgaaagttactatcctgacttctaaaatcatagattagttttgcctgttttttattttatgtaaatgtaatcatacataatacactttttcaatccaccaatttgggggaaaaatttaggttncctggtggccacggtaaccattacccacccttagggggccttacc

SEQ ID NO: 214875 - DNA, 701 bp, Homo sapiens
tatcctgacttctaaaatcatagattagttttgcctgttttttattttatgtaaatgtaatcatacataatacactttttttcattcatcatttttgtgaatattttagtttcttgttgccactgtaacaaattaccacaaacttagtgacttaaaacaacacagatttattcttttatagtcctggagatcagaagtccaaaaatcagtttcattaggcctaaatcaaagtatcagcagggttggctctttattgaggttgtgagggagaatgttttcttcccttttttggcttccagtgacggcctgtatttatgggcttgtgaccccttcctctctatgatcaaagcttgcttttgtcattatatcatcttctcttctgtagtcagatctttccctgcctctaagtttagggctcacctgcataaagcagggataatccccctatctcaagatccttaatttaatcacatgtgcagaatctcttttgccatataagtgacattcacaggttccagggattcatacgctggctatctttggaggccgttattcaacctgccaaagtgagatccattcttattgttgcatgtatttgtagttcattcattctcattgctgtatagtcttccgtttgtttatccatttttcattacatccaaaagttattcattctcccattaatagtcttttgagaattt

SEQ ID NO: 214876 - DNA, 413 bp, Homo sapiens
gcctgggttccaggagtgcttcctttggtggtgcccactactgcactctgtcctgtcttaggtgaccctcacggtctctgcaggcaggtgccgttaatagccccactgcacaatgaggaaacggcagcacagaaaggcgcggtggctcacgcctggaatcccagcactttgggaggccaaggcagagggattacttgaggtcaggagtttgaaactagcctggccaacatggcgaaaccccatgtctattaaaaatacaaaattagctgggcgtggtggcacatgcctgtagtcccagctactggggaggctgatgcaggaaaattgcttgaactggggaagcagaggttgcggtgagccgagatggcaccactgcactccagcctggttgacagagcaaggctccgtctcac

SEQ ID NO: 214877 - DNA, 351 bp, Homo sapiens
cgatctgctccgtgagaaagctgccgtgtagagctggagttgagagtcgtgggtttatcccatcatttacaactactgattgccttttaaaatatgaacacatttattaagaaccacaacaaaacccattcctgattaaaggatatctttttcttatcactggccctagccagtgattgttcttcaaccaagagctgggaggagtgctcctaagcaaagattttggatgcaggaaaggaacactccaatcccacagggaagaccaacagatgtgtattccagacagacagagcctcactggcagagcagctgggaagacgctgctgactgacaggtggagactgttctcac

SEQ ID NO: 214878 - DNA, 409 bp, Homo sapiens
agtaggtattattgtaggacaaaatatcccaggctcccaagctgtgttctgtgatacatcagccctataaaatgggtttaaaaaaagaagaagaagaaaaagaaagttttccctgttgagtgatctgagaagccctgtacactgactcctcttggttgatctcagggccactagcacactaaaggctctgagaaggcctgcagtaagggtgctagcctcatgtttcccaaacttatttgccccagaatcccttttgcgtgtttattcaaacccctctgttcttcagttcatcctagagaatggcctgaaggctaggttagagctctaaggaaggagagaggatggggcttccccgaaaagggacattttgtgtgcattgcacaaggcccagtccaagcctagcacagtc

SEQ ID NO: 214879 - DNA, 312 bp, Homo sapiens
agcgtgactccgcctcaaaaaaaaaaaaaaaaaaaaaaatacgacctatatgttaatctcaataaatgaaaagtatatcacaaatttcaacatccattcatgatttaaaatgatcagaaaacaaagattagaaagaaatttataatttataactatacaaagggcatataccaagaaacttaatctaacatcatagtggcaaaagaatatgtccctccctaagatgaggggcaaagcaagaacgtccactatcaccacttctatccagcattgtattggaggacctgccagtgtaagatggaactgggcaat

SEQ ID NO: 214880 - DNA, 626 bp, Homo sapiens
cgtggtggctcacacctgtaattccagcactttgggaggccgaggtgggcagatcacctgaggtcagaagttccagacaagcctggccaacatggcaaaaccccatctccactaaaaaaaaaaaaaagccgggtgtggtggcacacacctgtagtcccagctacttggaaggctgaggcacgagaattgcttgaacccgggaggcagaggttgcagtgagctgagatggtgccactgcactccagcctgggcaacagagcaagactctttctcaaaagaaagaaaagaaagaaaaaaaaaagaaaaggaaaggaaagaaagaaagagagagagaaagttagtttataattagaagaaattctttaacatggtcttaagggctagtcctatcacctacaatgaaaggataattcccagtcatcttaactgtcccaaggcatagaaaacagtgggaagcttccaaattcattaaatactataatataacactgattccaaagccagataaggatgatcccccacaaagagatacataggccaggagttagcaaactatggcgtgtggccacatccagtctgccatctgtttttatttgacccacgaactaagaatagtttacattttt

SEQ ID NO: 214881 - DNA, 394 bp, Homo sapiens
tttttttactaactcagagatgcttctttgtgaaaatggaattgttagtatagagtaacatctgtcagttcttttagatcttatcatagggaataatagtttgatttttcacaaaaaggatctggaataaaggatttgcagggtgtatgttgagaagaggcagttgatgtatgcaccagctagaaatctgagacttaactatgtggtcttgaatcttttcccatgctattcttcctgctacaagtgacttttttcaagtacagttgacccttcaatagtgcagcggttagactcactgacccctgcacagtcagaaatttttgtataatttttgacttcccaaaaacttaactagtaacccttctgtcgtgactggaagccttactggtaacac

SEQ ID NO: 214882 - DNA, 598 bp, Homo sapiens
attaacaggacaactcttgtctggacttcaaaaacacacccctggttctggaaatgggcctagaaacagaaatagcctctcctactgggtgggcacctgacatctgacatggaggagaggggcgtgggcaggccaagtgtcagcatctccttggttcaaggacaacccaggacctgtgctaagcatgaaacccctgctcaatagtgtcactacaacaaagaggactgtcatgtctagaagctcttcctatccttttttgacaattaccactagcaatcaatggattctgatgtttctgcttacagtgactgaataagcataattattctattgaaggaaattttttcttgccatcctcatgttagtaaacataattcagactcccaatgtttttaccttttcaagtgtagcaagaatgttttttctgttaacagagatcatcaacttgcaattacattaagcctttatgatggttaatgatagttcatttgttgtgcctgggctgaatgataagtgtagaactctccacgtgcaacttgctgaatctccaaatctgattgctaccttttgagattcagaattactgttaggaaggtgc

SEQ ID NO: 214883 - DNA, 582 bp, Homo sapiens
ggactacaggcgcacaccaccacaccagctaaaagatggggtttcaccatgttggtcaggctggtttcaaactcctgacctcaagtgatacacctgcctcggcctcccaaagtgctgggattacaggcgtgaaccaccgagcccagcctgaaatttaatgtcataggaaatcgaagagttgattaaaattattagctaccaggcaataatatgaaaatcagtgtattgtcataaagatatctaagctattactttttgaagttgtataaaaaggtgaagttaaaatgtttttaagaagtcaatgtgtctgttttacatagggttgccatttctgtttttaaactttagttgggttttaaattcctgaattttcacatggctcatgtgggggacattgggatagaatggtgtttggggtatatgcataaaaaaagggagtctgtcttaaattaaaggcatatatcccccaaaagaatggaatctgttagtagtaggataaagtaattttttgcaaaatgataaccagagaagatgtttcattgtttgatcatgaatggaattgtctgtgaatgccatcatgga

SEQ ID NO: 214884 - DNA, 224 bp, Homo sapiens
ggttcatactcctctgagaatctaatgccacccactgatctgacaggagacagagcacaggcagtagtgctcgctcacctgccagcccctcacctcctgctgtgcagcccagttcctaataggccacagactggtaccagtccatggcccaggggtccctgatatacacaataatctaaaagttttatgaattttttaataaaacttaaaaataataaaatact

SEQ ID NO: 214885 - DNA, 235 bp, Homo sapiens
gccagcagggcccagaccagaatgggagccctgtttgtgatgtctgcggtccctccctggggtcgataagcccagggcttgtcggggcaaatacagaagtatgagcagcatcttttcctctcggtccctcggggagatgagagacgtgttggctaaccagctgcagatattcacctcacatctcttgctctcccccaggtctccctacaccaccacccgctatggaagccccatc

SEQ ID NO: 214886 - DNA, 493 bp, Homo sapiens
agttcccttctgcttccagtcttcctgcctttgcttcaagttgtcctgcctttccagacggaaccaatgtacttcttacatatactgattgatgtctcatgtctccctaaagtatataaaaccaagctgcgccctgaccaccttgggctgtcttcaagatcattctgaggctctcaccggtacgtccttaaccttggcaaaataaacattctaaattaactgagacctgtctcagattttctgggttcaccgtatatagtaacatgtagaaagtaatcaaaatttatttttctgtgtattatgtcactcattctatactattactaaatcaatctatttttatctttgttttgtgtttaattatatgttaggtttacaaatttccatttgtacagatttgtcttttagttctgtgtattttatcacagttaatttgttttttcttgctctgaatctatatttgaaatacaataatttgttctatattttaata

SEQ ID NO: 214887 - DNA, 882 bp, Homo sapiens
ttaaatactgtctctgccatcatgaatcttgctgtcaggtatcaccgccactgaacaggttggagaagaagaacctagtgctgaatccagggtttgtgacaaggctggaagaacatttggtctggctagttaaagtgtggaaagagattcacgctcgtgccaagtatcaagagggatactctgatggactgttcagagccccaatttctgtaactatcacttctcagtgtattgaaagatgctaaacattagaatcaactgaactgactttatcattttattacactatatcaaatcgggttctttgagattcttattctccaaacaatgaaaggaataaatataaactgtgcctgacaaatgaagaaaagatggagatcaatagcttgttaaaataattttgatgtatgctattattataaaatacaacttttgtagaataatgtaggtatgtcactgtcactaaagagtattttatgtattctcatcatttaaggcaaatataacaatatgtattaatttaaattcaataaattttactattaaagttatatctagatagaaatttatgatattcaaaactggctaataaacaggttaagaaaatgatctaatttaagaaaaaattatagttactagcttgttcttttgaatggctagttcaaattattaacaacttcaggaaaaaatttaaattaatgatacaaagcataatattttgcaatgtccttaggtatttgtcctaaatttgatatcatacggtttcatgtttatgaagaactgtttcaactatgtcctaagttggtttgctacagttttgcatatgacatcagttgaacagactcgtaagactagcatttgaataaaatgttaataaatgat

SEQ ID NO: 214888 - DNA, 396 bp, Homo sapiens
cctgggacgtgccaggtggattttaaggaatgataaaggtactaaccactaaactaaccaatccaggccaaccttccagcagatattataagccttagaaatcaaaccatgtagatttcaatgctagaatagaaattataaaatgtaaactgactagtaaattcaatttttttaaagtaaggaattagcaaaaaatgtacagccatctaaagtaattaatataaactaacatgcaggagagaagggatttactacttgtatttcaaaaatacttccagaggtaagatcagaggtgtttggcttggcaagcctgggtgtttgctgctttctcatgccaactgtggtgatgtagactgtgtatcaaagaatcataaatgccaacaatccctaaaaatt

SEQ ID NO: 214889 - DNA, 539 bp, Homo sapiens
tgtgcgatgggcttgtttaattcccaccgttctgtccgcagagttaactacaagtggtttaggctctgggacagaacatttggggaagctttgtaaaggaccccaaactgttaaattcccagctgagctgtgagagctaataaaagacttgagatacctccttgggcattagaagaagcttttctttctttcttcttcttcttcttttttttttttttttcttttttatgggctgagacaagcgacatctaggcccctcgcaatactagctgctttgccacttcgcagagacaaaatgaaaggctctactgcaggaacatttgaaggaactttctttggggggcggtgggggctatcagcgaagggaggggaatgtgcgtggagctgaggaggagcctcccggctctccgagggccttggggttgggatccctaggtgcagcccgttgacagtcggccccacggccatggacgtcctttccccaagttagctgagcgcctgccaccgagatcccccgagcctgggcttcgcgcggccgc

SEQ ID NO: 214890 - DNA, 412 bp, Homo sapiens
aagcgataaactccctgtggcgctgaagtaatttgttttaaagccaaatggtgcccttcagctaagtaaccgacccaaggaggaacagttgggaggggtgtgtgcacgtgtgtgtgtgtgtgtgtaagtgtgtgcgtgtgtgtgtgtacctggagccttcgacagccggctgggactctaaaaagatcgcgctggtccaccacttgttaaccctttcttcccgccaactcaaaagtttctgagctgacgtcaagtgtcaaagcctttctcataaagaggtttctgccgtgggtgggcggaaaacatagaaaagtaattatatgtatatttttgctcaatctggtcccctaacgtaaacatactcaaacagcgcgcattaaaaataaaataataaaaattgttttctggagga

SEQ ID NO: 214891 - DNA, 991 bp, Homo sapiens
atttccagagtttaggccttaagaagctttgaatcccccattatcactctcctataaccgtgagaatacctgctgtgcagaagcccagtctagcctgctggaggacaaaaggccacgtagagatggaccaaggtgccttggccaacagccagcacccactgccagatatgagagagaggccatcttggacatcctagtcctgttgaactcagatgactgcagccacaggagtgatcccagtgcctcactgcttccagttgctggaggatatgtggtgctgcactgacaaatgcctccaccactgtggcagacgtgtgacccttgacgttcttcctaagtcagaatctgtattctgtgtgtgcctagtgtggagaacatggatctgcccagccacactggctcagattctctgagaggaccagggcagtaatggtgcccaggagtactctatgatgttgccaccggaggaaggtgccaaggatatcggcttcagagccagctaccatgtgaaaagtccagcttgatgacctagaaggacctttacctgcagaaggacaaggcttcaactctgttctgcagattctccttcagtaaattgggagtgcccttccacactggtcaacaggcccctccctgctgctttggatcaccaccttaagtcaaacacaattcaagtgccttcaaaagagcagcacatggactggcaaatcgtgactggtgaaaatgggcacaatcaagtagttaacctgcacctattctcactttttgcagacttccaaactcgctgaatgcacagaggccttggcctggcttatctcctcctcgctcacttatcctgaagaattgctttccctttagacaaacattctgtaaaggatcagatggtaggtctgtggcagctaatttcccatcttagtccttatgcctgactaagcagtcaatgaaagaaaaataaacctgaaacactcacacgaggcataatcaaaaaaaa

SEQ ID NO: 214892 - DNA, 980 bp, Homo sapiens
gtacccacccacctctgttcctggctgtcaagatgataataataattaccatcctttcactcacaaatgaagcccagtctagcctgctggaggacaaaaggccacgtagagatggaccaaggtgccttggccaacagccagcacccactgccagatatgagagagaggccatcttggacatcctagtcctgttgaactcagatgactgcagccacaggagtgatcccagtgcctcactgcttccagttgctggaggatatgtggtgctgcactgacaaatgcctccaccactgtggcagacgtgtgacccttgacgttcttcctaagtcagaatctgtattctgtgtgtgcctagtgtggagaacatggatctgcccagccacactggctcagattctctgagaggaccagggcagtaatggtgcccaggagtactctatgatgttgccaccggaggaaggtgccaaggatatcggcttcagagccagctaccatgtgaaaagtccagcttgatgacctagaaggacctttacctgcagaaggacaaggcttcaactctgttctgcagattctccttcagtaaattgggagtgcccttccacactggtcaacaggcccctccctgctgctttggatcaccaccttaagtcaaacacaattcaagtgccttcaaaagagcagcacatggactggcaaatcgtgactggtgaaaatgggcacaatcaagtagttaacctgcacctattctcactttttgcagacttccaaactcgctgaatgcacagaggccttggcctggcttatctcctcctcgctcacttatcctgaagaattgctttccctttagacaaacattctgtaaaggatcagatggtaggtctgtggcagctaatttcccatcttagtccttatgcctgactaagcagtcaatgaaagaaaaataaacctgaaacactcacacgaggcataatcaaaaaaaa

SEQ ID NO: 214893 - DNA, 845 bp, Homo sapiens
caaaccttgattatgtaccatgcacgattttagtcattttacactttacatgtattaattgtttaaatattcataacaattctattaggtagatattattattgcattcttcttctttttcttttttaagagacaggtattgctatgttgcccaggctgctgctggcctcaaagccctggactcatgtgatcctcccaccttggccttctgagtagctgggactatagtcatgtgccatggtgcccagcaggtagatactattatattcattttataagtgatgaagttgaaacccagtctagttataaatatgcccagtgtcacgaagctaataaataacaggattaggattgaaatccaggtcagtctgaccttgaaccaccaaatacactgccttcttataactcagctctttggagttctacatttgatttacttttgtgtttcaaccccagatgtatagttcaaaaataatacataactttaaaaataaagataatttttaatgaaaagaaccagaattaattgtataatctgttgttagaaaaatcttttggccaggtgcgatggctcacagcggtaatcccaacactttgggaggccaaggcgggcagatcacgaggtcaggaaattgagaccatcctggccaacatggtgaaaccccgtctctactaaaatacaaaaaattagccgggcatggtggtgcacacctgtagtcccagctactcaggaggctgagacaggggaatcacttaaacccgggaggcagaggttgcagtaagccaagatggcaccactgcactccagcctggtgacagagcaagactccgtcaaaaaaaaaaaa

SEQ ID NO: 214894 - DNA, 410 bp, Homo sapiens
gctaattttgtatttttagtagagatggggtttctctgttttgatcagggtgtctcgaactcccgacctcaggtgatccactcgcctcggcctcccaaagtgctgggattacaggcgtgagccaccgtgcctggcctgcttgttgttttcatctcatcctgatttccaaatacaggagagaagctgaattggtgttcactaacaagcacaggagctttgttatatttacagtgtcattcttggcaaaacctgaagggtgtgttcgtggggtgatgaggttcagtcacctgtgatctgtgcatctggccagcactgtggtgacatccttaggaatccatggggagagagaaagcattcaggagttagtgggtcacgtttgacaagggccaataaagaaatatgcaaagaca

SEQ ID NO: 214895 - DNA, 535 bp, Homo sapiens
gggaatcttccctaccattcatcccttctttatcatcctgccaaaataatttcttcactgggactttttgctataattacctcaattttgttgttttaacttaaaagtaataaactcatatgctacatctagattacaaattccggaaatagagattgaactctttcctgcatttcctgtttttcctgaggatccagtaatgtgctcttgaatgcaataaatgcttactcaccctctccagtaggctatttccatctgattctgtcattcatcccttcagtgattatttgttaagtacctagtgcattttgagcacactgtgtggttctagatacacaccacatagtgaaacagacttggtccctgccctcgtggaccttacaaccccatgatgaaggccacataacaagaaacttctctggacacacattttatccagtgaagatgtttttaaaatgtgattaattaacattttttcaggtggactttagcctgacttacagccaactagctacaaaccaagatttctttcttg

SEQ ID NO: 214896 - DNA, 527 bp, Homo sapiens
gtttgttttcctgttttctgtagtagaattgcattttctcaaataacatagaaaactcatattagtgatatgaaggcaaaaaggaagaggattgatataaactataacttaatatttatcaagttccaaacactgttaaaaggcacattgtgtctgctagctcagttctgtcttgccagtagggacataggggtattcccattgtagggatgaagcttaatgatcagagaaggtaggtaatttgttcaatgtcatgcagctatgctgttgtggaacctggatgagatccaaatctctctgcatcatagtctcaacaagctgctgcttgaaacactacttactggagaggaatttgtgtgtgtctgtgttttgtttttgttttgcctagaatagcaaacagtgattaagtaagggtaaaaacatctcagaataatacaatgtttctctaggtccttcaaagaacatttaatgtataaatgttttattgtatcccatgaaaagtaaaataaacaattctctttctcact

SEQ ID NO: 214897 - DNA, 482 bp, Homo sapiens
ccctgcacttgaaccgcactctgttcatctaagaattctgtgtatgttgtattacattggaactatctggattacagcacagactaatagtcaaccagccaaaataaaatcagccaaagattcattgctgtcgttaaaaacctcactttagaaaggaaggacctaagtagatactttagtaatcaaatctgaggaagttcaattttacttggttgtgagaaacatggagcatgcaaatacctaaaattaagcaatactaaagaaaaaaataaatttacttatcaaaaatgattaaagtgtagaagtgaatctgctatcacagtaatttaataaactgaagcatgagttattttggattgaatttgttacatagctcatgcatgaaatgatctgttgcttgttcttgtgactatgaaacagcaaagggaaaaaatgtattctgtccgaggcattgtaaaaatattgaaagctttgagcctttt

SEQ ID NO: 214898 - DNA, 324 bp, Homo sapiens
gagggcctgtggcgcgggggctgggcagtcaccctcacacctgaggcagcagctctggacagggacaagccctagaaactccagcctccagtgagcgggagccactgcttgagggggcttgggaagagggatcctctcctcactggctacggcgggaagagggcttagtcttcgtgtgctcagctgtgagaagcctagaagtgctttgctgtcgtttcctcacttaataaagacagcaaatcagcctcacactgcagcctcctggattcttcccatttctcatttcctcacttaataaagacagcaaatcagcctcacactgca

SEQ ID NO: 214899 - DNA, 487 bp, Homo sapiens
tgaaagaatacaaaagaaaaaaaaaagaaaacaaatctttcagaattgtttgaagtaagaacaagacaagaggaggtgattggtgtgttactgttctacgaaaaaggagaaaaagcttcatgaaatcgccattcagcaaggacagaactggagatggcttctcttttacaaagaaatctctgtcccaggctttcagtctgtttggtgttcatacaagtgtttgtgtgttgtgtggaaggcgggtgaaggcgggtgaaggcggtcctgttcagggccccctttggtgaacacagcaggcaaaatactctcgtcatccccagccaaactggcctgcaagcacactgacttccacatccctagcatttaggcctttgaatagaagctgacacgtagcagccagctgaacaagtatttaatgaggagcaacacaactccaagaagggctccttagtgtattgtcaagttgctgcagccttgtgagatgaaa

SEQ ID NO: 214900 - DNA, 559 bp, Homo sapiens
gttttacacccagagagaagcacagggccgaagctagaaccagaatgcagggatcccaagggtcagcccagagtacttccactggaagacaccacccacccacctccttcttagttctgaacctagaatttacccagctaaattacagtcacttcagctaaattacaatcaagtttgaaggcagcataaaaacattttcagacataaaaggtccagaaggcttttcttcctatatcctctcctaggaagatatttgaagatgtaattcagctaagtgagggggcaaaaaagaaaaacaacaggaagccatggaatctagagaccagcactccatcctagcagagcaaggaagggaagtcccagaatgatgtggtatagaccagttgagccagatcagagcaggaaaatggaaggaaggctccgaggaagtgttcccaggaatagaagagagaattgtagtaaatttcatgattagtagagttgaaaagcctgaggatatggtgagggcacactgtccttttatcaacaagaaaaagaaaggcaattgaaaactcccgga

SEQ ID NO: 214901 - DNA, 397 bp, Homo sapiens
attcccaacttatgtaattgtatgtctataaatattattttaataatcattttgcttatattgccagttgtgttgaaccaaagctcagaaatagaaaagtcactcaataagagtgacatcatggggcttccatattctccctcaatgacttccagatcaaattttctcagtgtataaatgaaaagatgatgtttctaacagccagccctgcagactcgacctgggatctgaagatccagctgtgttcactttgcttcttctaccgtcactgtaatgaacatgctacatggctgacaactgtgttgatggtgcgtgaggttgaatataatctagcttgtctcttctgtgaaggattttctgactctgctagcctaagaagaataaagaaaaatgagta

SEQ ID NO: 214902 - DNA, 496 bp, Homo sapiens
atcatttttgacagtttcataatatttcattgatcaatatagtttaagtcatattaatgaacacattgttttttcatctttggctataatgaagacattgcagttattatacagatgtcattcaaaatattacttagttgaagtgtatgtacatttacaaataacccactagcgatatttgtttccccacatcctcattccattgtaatccaagtttttcaaccattatggtgttaacaaactttttcatggctaccatatatgtaaaaactatttgtttccttttctgtaaagtgtttaatccctttccaatttctcctgtgggttattcatcttttttttattcatcttttttttttaactgggttcctgatgatctttagtaagtacatttttcacttgtccttgataaaaattgcaaattttttttcaattagctgtcatttgactttgtttatggtttagcttttctgtgaagaattttttatttgtaatt

SEQ ID NO: 214903 - DNA, 317 bp, Homo sapiens
tctctacatctggaggttatctggaaaaatggggataagatcacccacatcatactgttgtcttgaaaactgagggacctaatatagctaaagtacagtatagctagctattagatatttgaactaattttactctcccacacaatttctactgtcctgtccctttctctgttggcttctctccaatgtgaagtcctgcattagtgaatgaatatctgaattaaactaaaagattccaaagtcctaaatagcaatgatctgattttttaaaaaataaaggatgctgaagtgttgtgatgcctactacttcgaaatga

SEQ ID NO: 214904 - DNA, 512 bp, Homo sapiens
cctccttcctctttctccagttgctcgcttcaacctttgaagattacactgtttattaagaatgctttctaatgagtgtgtatttccctagtaaaaaaaaaaatggggtttggtggagcttaaccatagctcataaatattcgtatgatattctcattattattttggagttatgcttttcatcattaagtagttaaaaatttttgtttcacttttagctttgtttgtgtaaatggtataagtatattgatatttgggtgaaatttgaaaatgttccaaaaccagttcatgctgcttgaagtttgatgtgccacatagttgaccaaacatatcaaatgtgtaaagcattgactgttgtctttgaaatagaacatcaaaatgatgattagccatggacctgggtaggatatagtttgtctggaaagagggtcacagaataagccctgagagtcttctttgctgctgagtcccagaatttggcacgatgtttggctccatacagacgtgttgaa

SEQ ID NO: 214905 - DNA, 103 bp, Homo sapiens
ggagtcttctttttattgttgctatcattattgttatttgaggtatcctagagggacacagagaatttgtggggaggggccagatctctccaacaactggtta

SEQ ID NO: 214906 - DNA, 455 bp, Homo sapiens
aggatcaagctaaattttaatcttctagatgaccgcccccaaggggtaaaaatgctagatgaaaaacacataggaatttatggaattgaaatcattgccaatatatctttaaaatacgccccaatcgactaagccattacaaaattagagtttttaattaatgaaataagtgctgttaaaaggtacataattttaaagcaatctttacttgcacagtaattgctatgacaagcatgtcacctgtgaaaactggatgggtaaaacagcaaccttctgacaaaatgtggcaaagtatcctaagtattttaagctcctggaatgaattaagaatgaaattttacttttttaaaaaagattttactcacgaaaatgtgttctaaaactactaccataaagcaagatattggcagtccctataatgcctatattaccataatctaattttgccttcttaa

SEQ ID NO: 214907 - DNA, 515 bp, Homo sapiens
ttgaaatcctagtacatgatttttttttttatcctatgtgcagaaatcaggaaaaaacaaattctacaaagaatttgaaagatattatttcaggccaggtgtggtggctcatgcctgtaatcccagcactttgggaggctgaggcaggtggatcacttgaacctgggaggcggaggttgcagtgagccaagatcacgtcattgcactccagcctgggtgacacagcgagactccatctcagaaaaacaaaaacagaaacaaaaaaaactgtacagtctgatccaaactgttgctgtattgattcctcctcttgcttactgcctgctgacttctgagatgatagtttgcttccccattctcagtacatccctaattcatccttcattgagcatcttttatcataaagctgtcttctctggggattaatatccttaccgtgtttcacagggcagaaacagcttggcttattaacaagcatagtccttttgaaggatggcgtttgatctacaacgtcc

SEQ ID NO: 214908 - DNA, 608 bp, Homo sapiens
ctccatcttctgtccccagcaagcactggctcctctttatggttcatcttgtcccttttccaccaggatctctgtccaaattccaaacaccctgcaacatctatggtcccaccaggcactgactaaggcattaagagggagtgtcccagcccaccagggttgtagagaaggtgcgtagagaaagtgctcaagccccacctgagtcatgactaaggtgtgcagaggagataccctagcaccccagttatcagcatcaagaactatatcatcagacaatccagggttgacccaggatgtggcacggaggaagaaacctcagaatgtccagtggtagacccgtcagtcaggaattccccactgcatccttgcagatgcagtcagagctggttgactaagccctcgccaacgtgtggccattctggaactatctagcctccaaggatcagaagcaaggctcagtgtgtggccatggcaggggacatcagggagattggaccctgagggaagcatctgtacctgggctggcaggccctcttctcctcaaagggactctatatctgccctcctcacctggccaccatgagtacactgagggctagggatgatct

SEQ ID NO: 214909 - DNA, 337 bp, Homo sapiens
gagcgccgaagcgcccaggcgcaggccgaagctgccgcgctttctgggcacggcgggagtgctgagcagaaaggggagcgccgggggcccgcagccggctccggaggcgcgggccgggtttttgtttggctacgctgagcgccagtcagccccagcgaacaactccagttacgacaacaacccaccttccttccagacaagcgagacttgggctgctgcgtccgtcctattgtttagacacttgccaggggctccggagtcggcagagccaccgagtccccgctctgagtcgtcgccctccctctcccccacctcgctccctggagcgggaggccag

SEQ ID NO: 214910 - DNA, 405 bp, Homo sapiens
taaatctttacctgtaggctgcagtgcatgaacatggttcatctctattttttatggcttctttgatttttttatttgtgttttgtagtttttagtgtaaggatcctatacatatttgataggcttattcctaagtagtttatattttttggtgctattgtaagtaattgtgttgtttttgtttcactttccaattgcttattactaatgcaaatacagcttatttttgcatattgagcttgtatcttgcaacgttactaagctcagttattagttcttaaattctttgggtttttctacatagacaattatgtcttctccaaacagagacagttttatttcttcctttccaatgagtatgcttttaatttattttctctcacctattgcactgcagctaggacc

SEQ ID NO: 214911 - DNA, 254 bp, Homo sapiens
agacgggccgggcgccggagaggaacccggactctgcccaaagtctcgccgcccgccggctgttttctggcggagggtgtgtcccggagggcggcgagcgcgggtgaaggctggggccaggcgcgggtggaggcgtcaccggggtcgggctagcaggccctggaatcaggcttttgggacatcccgaaagtgagtccaacttggggagaaactgagggcacctcgggcggtctggcagcggagaaggtgggcgg

SEQ ID NO: 214912 - DNA, 483 bp, Homo sapiens
ctagacccaccctgggccagaagggaacccactgccctgaagggaaagacgcaagcctggcaggattcatcacctcttgactaatgagcccttaggccttgagtaaacataagcaatagccaggcaataattgacacaggccttgggcgagacccagtactttactggctttaggtgtgatccagcacagtcccagcaatggtggccacaagagtgcttgtgtcacccctcccccaactccaggcagctcagaatggagagagagattctatttgagggaaagtagggaagagaatagaagactgcctggtaatccagggaatcctcccagttcttatctaagactaccaaggcagtacttctacaagtctgcaagagtcatggcattactgggattggggtgcctcctaatgcatatatggcttcagtgaccaaagacttagatcacaacactcaatttcctttgagtacttggaaaacatt

SEQ ID NO: 214913 - DNA, 414 bp, Homo sapiens
gtcgtccaagctgatggactgaggggggtcattccagtggacacgggggagctgagctgtgagggtcctggattgcgtggggccatgtctgacctgcagatgctgcagagtttgggtcgagttacacgtggaattggggaatccccactgaagggcgctctctggccttttagtggccacggtttgcaatttcttgagccagggtcaccctgaacattcatttcaagaaacaggagatgcccaaggacagggcttcatgcctcacacaactttctgattaaaaggcaatcaattaaaataaatcccttcgtttctagggaagtcccatcacacaggcatcatctgggcttgcgttctgacatcaggggaagctgtgaaatcacacagcaataaataataaaggcttgagattaa

SEQ ID NO: 214914 - DNA, 345 bp, Homo sapiens
caccctggcccgccatgccccatcctgtacctgtgaaaaccccgagaccttagtgggcacagacacaagcagctggacattgacaggaacacaccggcggaagaagacacaagcggctggatgtcgagaggaacgtaccggcgtaagagcacattgacagccccagcagactggcaggccatcaactggcagaacgacactaagtttggccagggtggtcggaggagagcctggccctgagtggaccgactcgaggggaaaaccaccttcccactccatctcccttctggctcccccatgggctgagggctacttccactgaataaaaccttgcactcattctcc

SEQ ID NO: 214915 - DNA, 638 bp, Homo sapiens
ccattcaccaagagaaattccagattgtgaactaaaaaagaaaaaaatgttgtaaaaactagaaagtagtattttttcttgggattggagaagttttttctaagaatacaagcaatgaaaccgaaaaccctattaaactcactcacctgcctttaatgccgtagtgtgcacaccccagcgtgtgtgtgtgtgtgtgtgtgtgtgtacatagacatatatattttaaaatgtttaaatttgaacatatgttaccaatacatataaagcaaaagtagaaaatcaaaaagatgaagtaaaaatgttttaaaatattgtttgtggtatttgtggttaataaacctttgctctttctaaaaaaatgttcttttagagagagtcatgattaaaaatgcttgtcatttttgaaactcctagttttaacactttataaaaacaacttaatgttcttaaggtaagtttattttcatgcttggttttaatgactattgtagctgaataagtcacttcattaattaagatctgtggatccaaatatggctgtgcttactgaaaatatttttgagttccatccaccaattttgcaaaagtgtgttgttgaaatttttataataaattttcatcttttccaatgtcagtaa

SEQ ID NO: 214916 - DNA, 471 bp, Homo sapiens
tactattggcaaacagaggaaaaagaacttggaagacactgcttcattatgataccttggtaataaatgcagaggatctaaaaaggtgatgaatttcaagagaaagagtatttacattctcaaagtagttctggaacaaaagctaaataaacctcacatagccatatcctaggatcacagctgaaataaaagggccagatgtggtggctcacacctgcaatcacagcactttgggagactgaggcaggaggatcacttgaggccagtagtttgaaacaagccttggcagcatggtgagaccccagctctatcaaaaaattaaaaaaattagccaggtgtggtggccaatctggaggccaacgcaggaggatcacttgagcccaggagttggaggctgtagtgagctatgattgtgccactgccctgggcaacagagggagactcggtctctaaaaataatgatagtaataa

SEQ ID NO: 214917 - DNA, 385 bp, Homo sapiens
tctgattaatcctgaaatgaagcctttcacaaatggataataacttgttggtttggaggaagcatgggtgttcataaacaaaggcatggcagtaatacagctgagggagatggagcggagggcgacggaacagatcgagagagcaacctcagagtatgcacccagcacacaagaacggcaaaataaatgcttgaagttttattaatgaagcaaacatggcattggccaccctgatttttgccacgctgtgttcctaaaagccacactataaagtggatcctattttcccttaggaacaatgttgtaattacgggttctgttccaagacctcatgttggtttcctataaattcaagacataatcaataaaatcttgtaaaaacaga

SEQ ID NO: 214918 - DNA, 447 bp, Homo sapiens
cagcaggaaaccacagaaaatggctgattgcaagggaaaactctagacagtagatctgtagaaagcattcgcgacctcaggaagcataagatacagccttttaacaaaataacagccttgcagatcaagagttatgcaaaataatttacagtcataatgatacatcaatgatcaagaaaaaaataaggacattttcttgtggaaagtgttgacatgttaaaagcattttggtcaaaaagaaccaacacttcagtttggtcctttaaaggaatccaaccaaattgaggggttggatagctgtttgggcagcccttataaggagttttgtttatattgtgtcaagatagaggtttccacaggtgtcttatataagtggcaaatataaattgatcccattcttgctgaagtagacagtgccctcaagtggaattaaaacaaacacaccac

SEQ ID NO: 214919 - DNA, 438 bp, Homo sapiens
agattgcgccactgcactccaagaagaagaatttactacacagaatcttgattggtaaaaagtaaatatggaaaacagattttagcattcacatggtatgtagcatttattgaaacctcataggtcggggcatccttttatgaacgtagttgtattaattggtttgaataaatgagaaagtaagtctgcatgtttcaattataaaagtgtagtatatgcttataagaaactgaaaaatgtgttaacaagagaaaataggctggccatggtggcttacacctgtaatcccagcacttcagaaggccaaggcgggcggatgacctgaggtcgggagttcaagaccagcctgcctaacgtggcaaaaccccatctctattaaaaatacaaaaatggccaggcgtggtggctcaacacctgtaatcccaacactttgagagg

SEQ ID NO: 214920 - DNA, 350 bp, Homo sapiens
tcctgctggagacctcacttgagagctcagggttggggcccagcagtctgtgtctagcagccctccgcccgttctccagcacactgcaggccacttctgctcccacgcccatctcttcctgtgttttgttttgtttgacaccttctgtgtgcagggctctatgggttcctgcaggctaatctctaggcatgggaaacaccgatgattacctggggcaggggaggaggttgggagtgactgataattcaaggtttcttctgaggatgacgaaaacattctgaaactagatatggtgatggttgcacagctctgtaaatacgcgaaaacccttgaattgtacactttaaatg

SEQ ID NO: 214921 - DNA, 433 bp, Homo sapiens
caggtgctcctggttagccccctatgattggaaagtcgattttaagccattttaacttatgcagactctttcttggtcaagatactgtgaaccagtttggagggggcgccacttagcatctgagttgcatctctttcaggaaggattctaaccctccgattttgcttcagaatttttgccaaaccgggtccagcctctctgttgaagctgatctgcccacaccagttctgaaacaggagtcaatgttacttacctttcttgcttctaccaagcagtgatttctaacaccttctagtgtgaagacacctttatgatgtctgttttagaacggcacgtagtcattgtacttggtatagtgacagactatgagaaagctaccaggaatttaatatgaaaatgaatacattcataaataaattgcttatgtattcac

SEQ ID NO: 214922 - DNA, 326 bp, Homo sapiens
tattttcagatttgctgctgtttaaatcacttctggcttaattttaaatttataaaacatcttgtggtctgacaaagaattgtatctacttgtctgaggaaataacaagggcaggtaaaactattttgaggaactttatgaaatagaaaaagatgccaggagaatattaaaaatggccatgatgttaattctcctcatatgaattttttaggcttaacagagtttcaaagagaaatcctattgtaatttttttaaattggccagatgtttctaaaacttatccctggaagaagaaacaagtgagaataaatgagaaaatgttttta

SEQ ID NO: 214923 - DNA, 117 bp, Homo sapiens
gcttcgtataatacagaaagatttaaatacagaaaaaggaaaaatttcttctaccccccatgtcaactcctaggccttctttgcaaaagtagccagtgttaacactttcttatagat

SEQ ID NO: 214924 - DNA, 816 bp, Homo sapiens
gtgatctacccacctcgggctcccaaagtgctgggattacaggtgtgagccgctgtgccctggctgtttcttttcaaatagtagcatgatcacatttgcattttagctagtacactgtaccagcagttaggaaacagtgagggaaaagattagacccagttaagtcacaaaggtgactagggtttactattgcaatggtagagggatgggggagtacatttaggagggttgaatctacaggaaacctggtgatcaattggttgtgggaggtgagatagaaggaagcagcaaggaaagatgtccatgtttctgatttaggtggatggctgtgaaatttattgagaaggggaaagaggaagaagagaagatcggggaaggggagagtatgaatttagtatagaaacatgttgaggttaaggtgcctaggagataagtagaggtgtctgttagtctgaagctcagaggagaggcttggtctagagagctgaagatgattcatttattcagaaatatttattaattgcttcctgtggggctgttctaggtgttagagaaccagatgaagtcagtgctgctatggagcttttattctggtggtagagacaaacagtaagctagtaaataatgtaatttccgctggtaaggaccatgacgaataataaagttaggggatagtgagtgactgaggatatgggctagactgatacgaaatggaatttaacatcctgtcctttgtaagaagttgagggcggcctgtcagcagataataggtagtttaaacagtgagtttggtatccaaataattatacaaaaaaa

SEQ ID NO: 214925 - DNA, 671 bp, Homo sapiens
tggagtgcagtggcatgatctcggctctctgcaacctccatctcctgggctcaggtgactctcccacctcagcctcctgagtagctgggaccacaggcacaccaccacacctggcaaattttttgtaattttagtagagacgggatcttgctatgttgcccaggctggtctcaaactcctgggctcaagtgatccacctgcctcggcctcccaaagtgctaggattacaggtgtgagccaccacgttcagccccttctgcatttttccacggagctgcctcttataaaggttagcattggcactgatgaccacattccacaacttttaacttctgattccccttgcctttttctgaacccttgatatagatgactacccttctttttcttcctttaacttttgagaggttatgttctcttttataactcttcttctgttccctggtttgtcttctatacatgtaggcattctccaagttgttctcaaaattcatttcccctgtcttggatgcacaatctcattattttactgtgttaaagtcatatcatatgttcatttaaattacacaaatttatccagacattcagtcaaataaaagagagaaagaatatttagcaatagcaagtgcagtagtgctggcaattctgcttacactccgtttattgaatgt

SEQ ID NO: 214926 - DNA, 366 bp, Homo sapiens
tccaagtgtgctttcttttaaaaaagttatttaggcccatcctttataaacacccaagtagatggtctgatggggtcatggtaacaaagattcagcttctatctaggtggatggtaagacccgctaacatcttggcaaaccgtgttattgggccattaaggaccagtgcttgaattctggggctgaaaattcaacgtattcccttataagaaaatgtctgctcatgataagaagtcacacaaagtacaacctcactatagtacaggatttagaatctttatttctccatctcatcttaaacccattggaagttagcatggattagagggtcggttgactcttctcaatgacggggctggcatataa

SEQ ID NO: 214927 - DNA, 152 bp, Homo sapiens
tgaatgctgatgctttcctagggttctggggacatgaataaagtgacatttccttgatttttcccgctgcagtctcaggccgtaggattttctgttttgtgaaatgagttataacttgttcatattaaagtgagatagaaggatatccctct

SEQ ID NO: 214928 - DNA, 598 bp, Homo sapiens
atatacgtgcggtgtctctccaacactgaaccttcccgtgggccctcttacctccatctcacaggatcttggttaaattacttccaccaaagccttctctaagcttatccatctttccccacaactgggttaggtatccccagagtgattggatagtatcttctgcttactccaactgaggtacttattaccagcttgcttatctatctccctactcaatactaagagtatatgccttgttcacctaaattctactgtctagctcaacattttattgaatcaactaatcatcaaaaggcctaacaaattatttcacattcattaaaatacagctgtgcagtaaatacaagttatcagtgaaattttacctaccattaatgagtaataataggttctgttcaacaagttttccatttgacctgccatgttataaactagaaatattttaggatccttctgctacaaagtttttcaagaaactatttacaaatccattttatcttattacaacaggaatgagttactttccaaatttgttttaaacatgtagaagacacttagcacagggcagatgctcagtgaatgtcagttgtctcta

SEQ ID NO: 214929 - DNA, 568 bp, Homo sapiens
tcggcacgagggggtctcagtgttacccagactgaaatgcagtgtcttagtcacaggtgcaatcatagcacactgcagcctcaaactcctgccctcagacaattctcctgtctcagtctcttgagtagctgtgcctatgggcatgtaccaccatacttggcaacatacacttcttgacttcaaaactttctacaaagcaacagtaatcaagacagtgtggtactggcaaaatgatagacatacgaatcagtggcacagaattaagagttcataaataacctgtgtctatggtcaactgattttcaacaaaggtgttgagacaattcaatggagaaataatagtcttttcaacaaacggtggtgggataactggaaagccacatgtaaaagaatgatgttgaacacccagctcattaacatacacaaaaattaactaaaaaactgaccacagaacccaaaagtaagagctaaaactataaaactcttagaggagaacttaggggtaaatctttgtcaccttggattaggcaatggtttcttagatatgacaccaaaagcagaagtgatg

SEQ ID NO: 214930 - DNA, 525 bp, Homo sapiens
agttgcccaggctggtctcgaactcttgggctccagtgatatgcccacctcagcttcccaaagtgtggggattagaggcgtgagccaccacacctggcccatagcccttttttattgaagacaagtgcactctggcctgtagctgatttgcaagtgctttcagggaagcattagagtaaaacagaaaactatctgtagatgacaaaatacttaaaacggtgatgattaacctattactgataatcttaaaagtgaaagatctcctattgcaaggacgaaaaaccaaacaccgcatgtctcactcataggtggaaattaaacagtgagaacacttggacacaggaaggggaacatcacacaccaggtcctgttgtggggtggggggaggggggaggggtagcattaggagatacacctaatgtaaatgaccagttaatgggtgcagcacaccaacatggcacatgtatacatatgtaacaaacctgcacgttgtgcacatgtaccctagaacttaaagtataataa

SEQ ID NO: 214931 - DNA, 996 bp, Homo sapiens
taacagctgttctgtattcagagccgcacaatcaaggaaaaacacgatcggaggcgggccctggacaggaacaagaagggtgggcttgactgggcggcccgcggtcttggctcccctttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgta

SEQ ID NO: 214932 - DNA, 930 bp, Homo sapiens
taacagctgttctgtattcagagccgcacaatcaaggaaaaacacgatcggaggcgggccctggacaggaacaagaagggtgggcttgactgggcggcccgcggtcttggctcccctttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggaaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgta

SEQ ID NO: 214933 - DNA, 1505 bp, Homo sapiens
taacagctgttctgtattcagagccgcacaatcaaggaaaaacacgatcggaggcgggccctggacaggaacaagaagggtgggcttgactgggcggcccgcggtcttggctcccctttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggaaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgtaaaaaaaaaaaaaaaaaaaaaaaaaaaaaaaaaaaaaaaaaaaaaacaaaaaaaaagaaaaaaaacacaaaagcaaaaatagaaaacaaaaaaaggggggggggcgctatgattggataatctttccctgcgcgggggcgacactatatcgtacatcaccagcagtttttatgccaggaggggtgtccacaattagggagggcatcattgtaagacccgcggggagagcgggcgcgcctttatatacaaccgtgtcagaatgggggaaaacgacggccataccgcacgcgtcctgtcggagaagaaggaaaactcacatatggggggaggtggtcgacacattattcgagggagccgcgcaccaccagctaaacaacaaaactaacaccacataccccgcgcgacgacgacacacatcaacaatcaagctacccaaaacaacaatacttactagatcactcctacaaccacaccaagccctattcctcctccaccacctataacacaaaaacatactaaaatatcaaaaaaatcaacaaataattctatccctaacaaaaaaattataacaatacg

SEQ ID NO: 214934 - DNA, 1047 bp, Homo sapiens
taacagctgttctgtattcagagccgcacaatcaaggaaaaacacgatcggaggcgggccctggacaggaacaagaagggtgggcttgactgggcggcccgcggtcttggctcccctttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgtaaaaaaaaaagggggcgtaaattcccaggccaatccgtccagtctgacaggc

SEQ ID NO: 214935 - DNA, 725 bp, Homo sapiens
taacagctgttctgtattcagagccgcacaatcaaggaaaaacacgatcggaggcgggccctggacaggaacaagaagggtgggcttgactgggcggcccgcggtcttggctcccctttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgta

SEQ ID NO: 214936 - DNA, 1331 bp, Homo sapiens
taacagctgttctgtattcagagccgcacaatcaaggaaaaacacgatcggaggcgggccctggacaggaacaagaagggtgggcttgactgggcggcccgcggtcttggctcccctttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtgagtgggggcgcggaggggctcagggttcggtcccccgcccgctccgggcgtgggcgtgttctcggcgggcgtgcctggaggaggagctgggtccttgtgtggctgcagagtcagatggggcggggatttcggggcaccgggtcctcaccttcacgaaaaaggccccacagcacgtccccactacccgacgactcactcttcgtggcttctctctcctccccaagagcaggggtgggcctgtctcgcgttcccctgcgggagtcaggaagcgtccttcctacctaccagtcctcccctctggtgtctggggacacttcctgggggcctttcaggtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgta

SEQ ID NO: 214937 - DNA, 1425 bp, Homo sapiens
taacagctgttctgtattcagagccgcacaatcaaggaaaaacacgatcggaggcgggccctggacaggaacaagaagggtgggcttgactgggcggcccgcggtcttggctcccctttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctgggtgagcccaggcccaagcgggaacgggcgcggggcgggcggcgcagacccaggggcgcgggcttcatgccccagccgtgccccctgtcccgcagaaagacgccccgatccggacgctggtgcagcgcatccaccagctgcaggctgagcgcgcgcagggcttccgccgactggaggagtgagtgggggcgcggaggggctcagggttcggtcccccgcccgctccgggcgtgggcgtgttctcggcgggcgtgcctggaggaggagctgggtccttgtgtggctgcagagtcagatggggcggggatttcggggcaccgggtcctcaccttcacgaaaaaggccccacagcacgtccccactacccgacgactcactcttcgtggcttctctctcctccccaagagcaggggtgggcctgtctcgcgttcccctgcgggagtcaggaagcgtccttcctacctaccagtcctcccctctggtgtctggggacacttcctgggggcctttcaggtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgta

SEQ ID NO: 214938 - DNA, 1906 bp, Homo sapiens
taacagctgttctgtattcagagccgcacaatcaaggaaaaacacgatcggaggcgggccctggacaggaacaagaagggtgggcttgactgggcggcccgcggtcttggctcccctttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtgagtgggggcgcggaggggctcagggttcggtcccccgcccgctccgggcgtgggcgtgttctcggcgggcgtgcctggaggaggagctgggtccttgtgtggctgcagagtcagatggggcggggatttcggggcaccgggtcctcaccttcacgaaaaaggccccacagcacgtccccactacccgacgactcactcttcgtggcttctctctcctccccaagagcaggggtgggcctgtctcgcgttcccctgcgggagtcaggaagcgtccttcctacctaccagtcctcccctctggtgtctggggacacttcctgggggcctttcaggtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgtaaaaaaaaaaaaaaaaaaaaaaaaaaaaaaaaaaaaaaaaaaaaaacaaaaaaaaagaaaaaaaacacaaaagcaaaaatagaaaacaaaaaaaggggggggggcgctatgattggataatctttccctgcgcgggggcgacactatatcgtacatcaccagcagtttttatgccaggaggggtgtccacaattagggagggcatcattgtaagacccgcggggagagcgggcgcgcctttatatacaaccgtgtcagaatgggggaaaacgacggccataccgcacgcgtcctgtcggagaagaaggaaaactcacatatggggggaggtggtcgacacattattcgagggagccgcgcaccaccagctaaacaacaaaactaacaccacataccccgcgcgacgacgacacacatcaacaatcaagctacccaaaacaacaatacttactagatcactcctacaaccacaccaagccctattcctcctccaccacctataacacaaaaacatactaaaatatcaaaaaaatcaacaaataattctatccctaacaaaaaaattataacaatacg

SEQ ID NO: 214939 - DNA, 1277 bp, Homo sapiens
taacagctgttctgtattcagagccgcacaatcaaggaaaaacacgatcggaggcgggccctggacaggaacaagaagggtgggcttgactgggcggcccgcggtcttggctcccctttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtgagtgggggcgcggaggggctcagggttcggtcccccgcccgctccgggcgtgggcgtgttctcggcgggcgtgcctggaggaggagctgggtccttgtgtggctgcagagtcagatggggcggggatttcggggcaccgggtcctcaccttcacgactctcctccccaagagcaggggtgggcctgtctcgcgttcccctgcgggagtcaggaagcgtccttcctacctaccagtcctcccctctggtgtctggggacacttcctgggggcctttcaggtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgta

SEQ ID NO: 214940 - DNA, 1761 bp, Homo sapiens
taacagctgttctgtattcagagccgcacaatcaaggaaaaacacgatcggaggcgggccctggacaggaacaagaagggtgggcttgactgggcggcccgcggtcttggctcccctttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtgagtgggggcgcggaggggctcagggttcggtcccccgcccgctccgggcgtgggcgtgttctcggcgggcgtgcctggaggaggagctgggtccttgtgtggctgcagagtcagatggggcggggatttcggggcaccgggtcctcaccttcacgaaaaaggccccacagcacgtccccactacccgacgactcactcttcgtggcttctctctcctccccaagagcaggggtgggcctgtctcgcgttcccctgcgggagtcaggaagcgtccttcctacctaccagtcctcccctctggtgtctggggacacttcctgggggcctttcaggtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaaggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgtagccgctctgccatctctgtgtacaagggtgctgcagccagtgtgcctagggagggggcccccacagggccagggattgtgggtagaagactcccaccctccctagaaactgaggtttttttgcttgagacagggtcttgctgtgtcacccagactggagtgcagtggcgagatcgtggctcactgcagccttgacttccccaggctcaagcagtcctcctgcctcagcctcccaagtagctgggactacaggcacatgccaccacaagcccagttaattttttttttttttgagatagagttttgctctttttgcccaggctggagtacaatggtacgatctcggctcactgcaatctgcacctcctgggttcaagtgattcgcctgcctcagcctcctgagtagttgggatcacaggcatgcaccacca

SEQ ID NO: 214941 - DNA, 1350 bp, Homo sapiens
taacagctgttctgtattcagagccgcacaatcaaggaaaaacacgatcggaggcgggccctggacaggaacaagaagggtgggcttgactgggcggcccgcggtcttggctcccctttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccaccagctgcaggctgagcgcgcgcagggcttccgccgactggaggagtgagtgggggcgcggaggggctcagggttcggtcccccgcccgctccgggcgtgggcgtgttctcggcgggcgtgcctggaggaggagctgggtccttgtgtggctgcagagtcagatggggcggggatttcggggcaccgggtcctcaccttcacgaaaaaggccccacagcacgtccccactacccgacgactcactcttcgtggcttctctctcctccccaagagcaggggtgggcctgtctcgcgttcccctgcgggagtcaggaagcgtccttcctacctaccagtcctcccctctggtgtctggggacacttcctgggggcctttcaggtggttggcgccggtgcagggcctgagagcctgggggcgcggcctcagggtccccacatgccgcagaggccaccgccagtacctgcgcagcggccctgactacgacttcgcgcgctaccggagcacagtgcacggggtgacccaggccttcgccgccgcctcgcgggaggtgctggcggtggaagcagagctgggcgggcctcgcaggcagccgctgctcgccggccacgtgcgcagcctgcaggagctggagcagacgcggctgggcacggtggccctgctgcagttgatggagacgccagagctggcggggcaggaggacgctgtacggatgcagcagctgaaaatgaattcccatccgctcttgtagggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgta

SEQ ID NO: 214942 - DNA, 382 bp, Homo sapiens
agtgttccctcttgctgctagtgctgcctggaggtttggcggcgggcaggagggcctggggctcaccacagccacagccctcttgcagcttcgcggcagcagctaattcaccccatctgggttttatttatagttcccatccgctcttgtagggtaattaaaaccatggaggcgatcagcgaggttctccaggaccttaggtttgatgcggaatctgccgagtgatggcggctccccagggatgcgccgagggagatgggaaacggggcggatggcgcccagcccagccctaactgccagctggctggggttgcgccccactgcgctgctgaccttcctgcagttccagacacctcccacaataaagagctcctcctctgta

SEQ ID NO: 214943 - DNA, 348 bp, Homo sapiens
gatcggactcttgaggatcccccgtccttcatcatacctacccagcacggggagagcacagatgaagaactcagcaaatacacagaaagcacatatcacatgcaaaggccctggggctagagtgaatttgatgatcaagagacagtgagtagaggatgggtcagtaggtgtgcagcaaaccaccatggcacatgtatacctgtgtaacaaaacctacacgttctgcacatgtatcccagaacttaaagtggaaaaaaaaaaaggggaaagaaggaaggaaggaaggagaaagaaagaaggaaggaaggaaaaaaaggtaggtataatgacacggccgggggaaccctc

SEQ ID NO: 214944 - DNA, 464 bp, Homo sapiens
  misc_feature (431)..(431): n is a, c, g, or t
  misc_feature (464)..(464): n is a, c, g, or t
gatcggactcttgaggatcccccgtccttcatcatacctacccagcacggggagagcacagatgaagaactcagcaaatacacagaaagcacatatcacatgcaaaggccctggggctagagtgaatttgatgatcaagagacagtgagtagaggatgggtcagtaggtgtgcagcaaaccaccatggcacatgtatacctgtgtaacaaaacctacacgttctgcacatgtatcccagaacttaaagtggaaaaaaaaaaaggggaaagaaggaaggaaggaaggagaaagaaagaaggaaggaaggaaaaaaaggtaggaaagaaggaaggagaaagaaagagagagagaaagaaagaaagaaaagaaagaaaaagaagaaagaaagaaagaaaagaaaagaaggaaagaaaaaagaaaggatgagagnatatcttctcgagaccggggtgtattaagctcn

SEQ ID NO: 214945 - DNA, 289 bp, Homo sapiens
ggtaacaagatacctatgcaagctgaaaaactcttggctttttagtttgtatcacttccagaaacttttagatgctacgtatagaagtggctttcttttagggttaggtaagatacttccttttttggaaatagttttgccatttggtctcgctgcctgatttgtgctttttcttcttcagcaggtagtgggaggctgtgtattgtattgccttttaccagacacccagaggggtcatgttggaaaatagcatcctcttagcaaaaacacaatcccttctctgagaata

SEQ ID NO: 214946 - DNA, 421 bp, Homo sapiens
tctcaaaataaggagcaataattcaaagaggcagaaatcatgagcaaaaagatagcagacttggaagaaagatccaggagacctacatgcaaatatcagaaaaacataagagcacagatcaaggagaggcaaagttagttaaaattagatttattcaagtcagcagatggaaatgtattaccaaggtccacacacttagacatattctggtaagatttctgaactccaaggattaagacaaatcttataaatacagagacagaaagatcaactatgcaaatatctatctatagacacatacatatacatatagaagaggaagaagaagaagaggaagaagaggaagaagaagaagaagaaaagaagaagaaggagaagaagaagaagaaagaagcagcagcagaagaagaagaagaagagg

SEQ ID NO: 214947 - DNA, 357 bp, Homo sapiens
ttatatagtttctcaagcttaggtctttttaaaaataattgttgaaagggaagaggcacattgttttaaaaaatctgaatgtagaatctttgttttaacaagacctggaaagtagatagagtagggttgtaaggtaaaagaaaagttaacttaaaacacattgaatttttaacttttccccacgaggaagcaacggttataacattgttcttgatacaggtagagacagatagatttagattttctttaaggcactcactagtcagagagagaaataagatatgtaatttccaattaagtgaagatttctagaaaggaatgaagaaaacttcatttggtaaaacaaaacataacaaa

SEQ ID NO: 214948 - DNA, 755 bp, Homo sapiens
aatgggaaatgcaggtcaaagaattcaaaacagcagatgtgtatgatgaacaagtttagacatctatcgtacaacatgagaactaaagttaataaaattatattgtatgtcagggttttttgttaaataagtggattttagctgctgtcttatcaccaaaaattaactatctgagatgatagatatgttaatatccttcactactgtaacttttctattaatatatgtatcctacaacatgttgtaaacctcaaatatatacaataaaatttattttaaaataataaaaatattgacagtacaacagagtgactatagtcaataataacttaactgtacattttaaaataactaaaagagggtaattgggccgggcacggtggctcaagcctgtaatcccagcactttgggaggctgaggcgggtggatcacctgagatcaggagtttgagaccagcctggccaatatggtgaaactctgtctctactaaaaatacaaaaattagctgggccatggtggtggatgcctgcaatcccagctactccggaggctgaggcaggtcggttgtacctcagcagccgatgctgaaccgagctgagatcaagccactgcacttcattcaggctgggcagacagtgagattccgctcaaagcctcacccatctccctcacaccacaacatgtccgcctgcttggtccacccgattctgcatcggacaagcttatcattgcgcccgctcgcgctacttggcccc

SEQ ID NO: 214949 - DNA, 661 bp, Homo sapiens
aatgggaaatgcaggtcaaagaattcaaaacagcagatgtgtatgatgaacaagtttagacatctatcgtacaacatgagaactaaagttaataaaattatattgtatgtcagggttttttgttaaataagtggattttagctgctgtcttatcaccaaaaattaactatctgagatgatagatatgttaatatccttcactactgtaacttttctattaatatatgtatcctacaacatgttgtaaacctcaaatatatacaataaaatttattttaaaataataaaaatattgacagtacaacagagtgactatagtcaataataacttaactgtacattttaaaataactaaaagagggtaattgggccgggcacggtggctcaagcctgtaatcccagcactttgggaggctgaggcgggtggatcacctgagatcaggagtttgagaccagcctggccaatatggtgaaactctgtctctactaaaaatacaaaaattagctgggccatggtggtggatgcctgcaatcccagctactccggaggctgaggcagaagaatcacttgaacccaggaggcggggttgcagtgagccgagatcatgccactgcactccagcctgggcaacagagcgagactccttctcaaaaaaaaaaa

SEQ ID NO: 214950 - DNA, 675 bp, Homo sapiens
gttgcattcttttgagtctttgatcagcttttcacttaatacacaatttacatgtgagagagggatagaagaatagtcacttatgccttagtcggctaaatgaatctgcgattttacatacacagtagggcagaggaagcagtcagttacgcatttgtctcaggtgggtagaggggtgactttgagttctgtcctttgtcccatacctgtgaagataagctatcaatttacattgccagggtgaaatacaacagaactgttttagagtgaaggtcttgaggcccacaaggaatttccttgggggcaaattgtcagggaggtatgtagctttttttttttttttttttaatctttgtagctatcttattcaggaataaaatgagaggcagttttgctcgatgcaattcccagcttgacttttctttttggcttagtgattttggggtcctgagatttatttttcctttcacaaactcatgggtagtgcagtcctgtaatttgcttaaattcctgtaaaccaagaaagtacctgagacaggtctcaatcagtttagaagtttattttgccaaggttaaggatatgcctgtgacagcctcaggaagtcctgatgacatgtgcccgaggtggtcaggctacagcttggttttatacattttagggagacagaagacatc

SEQ ID NO: 214951 - DNA, 360 bp, Homo sapiens
cacagtggctcacacatgtaatccatttagccaaaaaattagccagatgtggtggcgcatgcctatagtcccagctactcaggaggctgaggcgtgagagttgctccacccgggaggtggaggttgcagtgaggcgagatcacaccactgcactctagcctgggcaacaacacaagactctgtctcaagacataagactttccatatcttaacatggcagaagagctgaaaagtttggttacttgaagttcttctatatgctttccttgttactttaagcaaacaccacaaagggtttcacatgtctgcttccccgcccaggaactgtgtgtgtgtctttctttcccccattcctgttcc

SEQ ID NO: 214952 - DNA, 857 bp, Homo sapiens
atcctaggtagtgggctctattgatgttgatcattttacccagataagaaaactgagacacaggtgcccacagccagccacagagctaggattcaagccaggtcatctgactctagattccagcctccccacagtctcccaggggcacgtagcctcagaggagcttcctgtctgttaccagagagaagccctgtgcctaagaaactgaagcagcaggtaaagggacaggtgacctaaaagaagacaaaattgctgggagatccccggagatcccaggcaccactgatggtgccttcaaaagcttggctcagagatctcttggagcagcctggagtcaggggcctagcttaaattccagttcagccacttgctagcaggctgtgggaccttgagcaagccacagaatgttcctgggtctctttcttcttctgaaaatggaaactttgcaaactataaagactcaagcaaatgaaagccagaggatagtaaatccaagatctggttctttgaaaggtccaaaaaataataataataacctcctcatgaggctgatggaaaaaaagagatagaaaaaaaaaatgcaagattcggaataaaaaaggaatcataaaaagagtaattatagccaggcaccatggtggtacacaactgtagtcccagctacttgagaggctgaggcaggaggctcacttgaggctgtagtgtgctatgatcacacctgtgaatagccacagcagtctagcctgagcaacatatcaagaccccgtctcttaaaaaaaaaaaagaacagtaattatgattacatattttttaaatgagagtaatatggcaaaaatttgaaaaattagagaaatgga

SEQ ID NO: 214953 - DNA, 726 bp, Homo sapiens
atcctaggtagtgggctctattgatgttgatcattttacccagataagaaaactgagacacaggtgcccacagccagccacagagctaggattcaagccaggtcatctgactctagattccagcctccccacagtctcccaggggcacgtagcctcagaggagcttcctgtctgttaccagagagaagccctgtgcctaagaaactgaagcagcaggtaaagggacaggtgacctaaaagaagacaaaattgctgggagatccccggagatcccaggcaccactgatggtgccttcaaaagcttggctcagagatctcttggagcagcctggagtcaggggcctagcttaaattccagttcagccacttgctagcaggctgtgggaccttgagcaagccacagaatgttcctgggtctctttcttcttctgaaaatggaaactttgcaaactataaagactcaagcaaatgaaagccagaggatagtaaatccaagatctggttctttgaaaggtccaaaaaataataataatatagtccaacgtctagtagttgcaaactaccatgtctgagaggaaaaaagcactggatattataaacagcagattacatattgtagaaaaaaccgtgaactttagacatagcaacagcaattactttacaaacacatagggcaaatactgtacttaaaagaataacacagcatctacagccttgggacacttc

SEQ ID NO: 214954 - DNA, 340 bp, Homo sapiens
acgtacatatgtgaaaactaatgaaattgtactcttaagatgtgtgcatatttactgtgtgccaattatacttcatttagaaatatctggagagagagacatagaaatttctgaattctttcctaaatagaaaagaattccatgcagcttaaatatcgttgcaagtattgatgcttatacctttagaaagcccattatgcttctgaaaaatgcacttactacttaatatcatacataatagaaagctaacattttgtattaacggaatctggaaaacatattgtactacacatttgaaattacagatttactaactagtaaagataactatttaagaact

SEQ ID NO: 214955 - DNA, 182 bp, Homo sapiens
ctgaaccgaccattaggcagaaaatcctttgagtcaatgcctctcactgaatccacttctcatcctgtccacctgcctgctttgcagtgcagagtaaagtgggccttccttgactctcttcagggaccaatgtgcttgaggccatcatgaggactttctttttttttttttttttttttttt

SEQ ID NO: 214956 - DNA, 279 bp, Homo sapiens
ttcttgtggaagccaaaacaattccatcttggatgctaatccttcatgttgacttctgattaacccttgttcctagaaggcctctaagatttccagtttatctatagtttcttgggtaacagcacgtacttaccataaatcctaccccttaggtcaaagcaatcttgattgtatcatacttcagttgtcctacatgtcctttctgaatcacatataccccttccttatgatataaacgtattacttgatggtctacccgtagtagtattaatcatttta

SEQ ID NO: 214957 - DNA, 416 bp, Homo sapiens
ggttggaggagacatgggactctggtcccagtaatgaggacaagaaaagaaaggggaaaccggagaagtggacatttctggtcgagcaggaaaagtgagtggcagggcaaccactaagacaaagtgatggaaggaagtggggagggcgggagagtctggagggaaagattcgctcaggaggctgagagaagaggaggaagaaagacccagactgcagtgagtttgcagtcagtccctatcacgtccagaaaagcccagagataagggatggaaaagaattgggttggaggaagagaggagaagatttatgactgtcaagaccagagaaatcagcaggagaaaaactaccaacaagagtaattcctaagaaggccgggcgcattgactcacgcctgtaatcccaacgctttgggagg

SEQ ID NO: 214958 - DNA, 563 bp, Homo sapiens
cagacgtggttctggccctcatcatttgcaatgcagttggagagatggggctgggtagcacctgaccagcgatatgtggttaataagacatagaagagggaaaataccacgtggtctggggtgatcaggcattgaaggagatttgacttagctctttgcagaggagggtagcctcacagacaggcaggaatgaataggcagatctagctggggctgcggattttggtaggaaagatttggaggccccaaaacaccttgcctagatgtttcaatgagatgagttatagccaaaggtacttcagcttggaaattgtgtttttgttttttttttttgataaaaatatattcatttatcgacagtgtgtggtatctgttggcatgagaaaagatttaagagacgatatattgattagttgtgtatctttagaatcaaatgagaaaatgtgaaagtgcttggaaaatagtaaattgatgtataaatgaaagttttacattatcatgtgtaacagtttgttatataatagagttgtgtgatgtcaggaataaaagaagctggtgaaatt

SEQ ID NO: 214959 - DNA, 234 bp, Homo sapiens
gtgaaaacatggatgaaaacacaaaaatttatttgtactttaaaggctagttattaacagctgtaatattttaagttgagtctaatggaattgtaatagtacaagttctaatgaaagaacaaaatgttctttatccctttagaaaagaagattccttagatgtatttaggaaaagaggaaaagaaagctgtactttcaagtcctataagtacagttttcaactagaagattaaa

SEQ ID NO: 214960 - DNA, 407 bp, Homo sapiens
ttacagtcattctgtatttttgccatttggtattttttcctgaaacattacataataagaatgcagcatgctttctttatgtaggtgatctgtgaaactttttgacaattaaaaattggtttttggccaggcacagtggctcacacctgtaatcccagcacttcgggaggccgaggagggcagatcacccaaggtcaggagttagagactagcctggccaacatggcgaaaccctgcctctactaaaaatacaaaattagccgggcgtagtggtgcacacctgtaatcccagctacttgggaaggtgaggcaggagaattgcttgaacctgggaggtgcaggctgcagtgagccgagatcttgccgttgcactccagcctgggcaacaagagcgaaactccatctca

SEQ ID NO: 214961 - DNA, 529 bp, Homo sapiens
tccacattctcctaatattaactttttaccatatttggtttcatattttcatgagacagtatttgtttctgaaccatttgggagtaatttgtagacattatgccccttagcccctaaatacttatgtccctttattcctaagtatgtctccctaaataaggatttttaaaaaatatataaccacaatataatcgtcagtatcaggaagttaacattgatgcagtactctatagactttatttaaattttgcagtatttcctaatttccttttaagtgaaagagaaactgtttcccctggtttaggttccagttcaggattatatgtgttacttttggtttttcatgtctctttaggttccttaatacagaacacttcctcagtcttcctttgtgtttcataatatgactttttttttttttttttaaagagatgagatctcactatgttgcccaggctggccttgaactcctggcctcaagcaatcctcccacctcagccttccaaagtactgggattacagacaaaag

SEQ ID NO: 214962 - DNA, 410 bp, Homo sapiens
tcaactttcctagtatcccaacttgctttcaagagaaaactaaaaactcattcacatgaataaagtataaatgacagtcaagagcttaaagtgttagctgtcctaggtggggaataagctcacaaggaacatcggtaaagaggaacatgtcaggagtgggagcccactttgccttataccctgaccaggtatgtagtcctcaatgtaaaactctcccactgggtgggaattcctcccaccccaacaacgccagcctccctgtggctttgcatcaggctccatctcctcatcgcagcgtggaactctattcctgtctctccaatgtcctcacaccccagtgactccaacgtcctctaggactagggaagtctgcacggaacctaccaaaatccctggcactctgacagccc

SEQ ID NO: 214963 - DNA, 286 bp, Homo sapiens
acgcataattgcctcttcgatgacggtagggtggggggcatccatatagtcacttcaggtttatggagggttcttctactattaggactttcgcttcgaagcgaaggcttctcaaatcatgaaaattatcaatattactgccgttagagaaatgaatgagcctacagatgataggatgtttcatgtggtgtatgcatcggggtagtccgagtaacgtcggggcatacaccacatgaaacatcctatcatctgtaggctcattcatttctctaacagcagtagtatt

SEQ ID NO: 214964 - DNA, 349 bp, Homo sapiens
agtctgttcgcttcatcattgcccccacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaacataaaggacgaacctgatctcttatactagcatccttaatcatttttcttcccacaacactttctcggcctatccggaatgccccgacgctactcggactaccccgatgcatacaccacatgaaacatcctatcatctgtaggctcattcatttctctaacagcagtagtatt

SEQ ID NO: 214965 - DNA, 985 bp, Homo sapiens
gagtggagggaatgagcaaggaaggaggaggcggaaagagggtcagggaggtgacagggcagattgtgcagggcttggtgggccactttgcctataactctgggtgagaattggtgccactggaaggttcctagcagaggagtggcgtgatccttctggcagctgcattgaggagagtttgcagggtgtcagggtggaagtgggagaccagttgggatgccatggccgtaaaccaggtgagaactggcagagcttggaccgtgatggtaggaatgggcagtgtgatacatggcttgataaactgcctagaccctcacataaatggtaaatgtatttttcatctcacttacgtctcctttaattacagaagtagaaaatggttactgtagaaaattggctagctagaacaaatcccaaaagaaaataacagcctctcctaagtggaccacccaatgttagagttatcgaagcaattatattttaatcattttcttttaataattacatttgaaagtactgtgttaaaatcgcttaaactggcagaagcggacttttaggtcatatgcacagtggggtgcagactctgcattttaagattcagtggagtgtttgaccgttctgctgtacactggaggggaaagagaagggtaagaagatgaagcctttactttgcttctcgtagcttgcagagaaggatgggggcaggtgagcagagacagctattcccagattacagccaaatacatattttgaaaatgatgaatggaatttcagggaatggggccctgtaagttccctgaggtcaggtactgtgtcttattctttactgttttcctaacatgtgatttagtgcctggcacatagtaggtgcccagcaaaaatatttgttgcgtacatatgtgaattaataagtaggtaatgcatggaatgaaacatgtctttttggaaagatcaagaaggactacctgtcatgtgagaccatcac

SEQ ID NO: 214966 - DNA, 285 bp, Homo sapiens
ggctcctccctcccccctgaggagctctttctaagcagcatcttccagttctgaaacttgaaatatcgtctgcgtgctggtgactgtgagttccagatctgaacatccagctggcatcttggcatctgtttgtgaagatctcacaactacttcaataaaacctttccccaaacagggtgcttgcacccccaatccttattctgtacccctctgtattcctcttcacaggaaatggaactcatatgactcaactttcagccagaaagttcggtcgtctttgactgt

SEQ ID NO: 214967 - DNA, 388 bp, Homo sapiens
tgtgtgaattactgagtgtgattaaagtatttttaggtttcttagggagaagtgattctactatacactcactttaatgttaatgtgtgtattcaacttttgccattaggaaaaagtttagttttgtcaacaacctcatagtaattggtttttatttataacatccttattttattcaagcagctaaatgccttttttttcaatagagactcggtttcactatgttgcccaggctggtctcgaactcctggtctcaagcaatcctctcactgtggaaaactgcggctggaggatggcttgagtccaggagtttgaggttacagtgaggtatgattatgccaccacactccagcctgggcacctaagcaagaccctgtttcaaagaaaa

SEQ ID NO: 214968 - DNA, 665 bp, Homo sapiens
agttccaaaacaaccctttaacatttatgttttctgcactttgtctcattattgaaaataacaagcgctatgtaaaagcgtaaagaatatactgaggtttacagcaaggataaccaccaaagaccgggagttagaaagctatggcctgtgggccaaatcttgctcaccacgtgcttttgtaaataaagttttattggaacatagctatgcccatttgctatgtattgtctatgtctgctttcacactgcaacatcagagttgagtaattatgatagagaccatatggcttaagatatttgctatctggtttttcactggaaatgttttccaacccatgctatagatattttcatggtatttatttactgactcgtttgttcattctttcagtggacaccaaccctgttaatgacgctggggaatgtaaagataagtacatcagtctctaatttccaagagcttataatgtaacagagacaagttatgtactcaaataacagagacaagtcatgtattcatctttacctctgaccaggcagaatgcagcacgtactacagacaagaaatagctaaattgctgtggtagtttagagatgatgagagcctccgacaaaggcagggaattgggaaatgcacaaagatattgcttccataactgtggcac

SEQ ID NO: 214969 - DNA, 468 bp, Homo sapiens
gggtcggagctcggtgcaccacgccccccctctgcgcccggggcctctgcggggacagaggtctcaggaaagtagcctttatttatgtggcaccgatcggaacccgcggccggccaggcggacctggacggagcgtccctgctcggaacctggcgcggggcgccgcgcgctcgtgtggcgcctcggcctccccaccgttcagtccccggaggcacggagctcgcggcgggacgatgacggttgggccgggccaggcgtgggagactcccagactccggcccgccgggacggccagctgcgtcaccttggacgtgggcaatacttcggagcctcggttatgtcgcctgtaacctgaggacaacggcctggaaggggctcaggtgacacggcggccctcactggggccgatttagccggtctgccgcccctccgcgccggaccgccaggcggggtaccagggaaactgcg

SEQ ID NO: 214970 - DNA, 463 bp, Homo sapiens
cagaaacttgtgttgatgctccagttatatattcctatgcattatattacagggactagtgaatgatggcccaaatgccaatctgaggcttgcatcttgtacttctttgatatttttaatatatttaggctttgagtatgtagcacacaatgaattggaaacttatgtttatgatctagttatgtattcctatgtattacagggaccattgactgatgtcctaaacaccattctgaagctctaatagtgtctagtgtaaactgtgaaatattgatacacttcctcttacaatgagtgacattatttgatccctaaccatggacatcattgtggaaattcacctccaccccatcctcacctcatcaagtccctagcattccaacactataatgtctacttctgcagctgatattctgatttctagaatgtgtttgtcaaatattatatctgttgtcagctttcc

SEQ ID NO: 214971 - DNA, 566 bp, Homo sapiens
atgcttggtaccagcttggcctatctttattgctcaaaccaataatacaatttgctgaggtctgggaggtcccttcagagaatcattgctctccccaaatttggttgaggtctaaggttcattttgctttataactcctttcctggagttttactcacttccaacaaggaagattagttttcctgtttccatgatgatggagggccagcaagtcctttctggagtttctgctcccttccaacagagaaagtgagtttgagttttttcctgcttcatagatggtagacagcagtgttcagcgtgagcctcattcctaggtaagtagctcaattagagttttgtcttgaaaattccccttagtgactaaaagttaagattgacaagtaactggtcttaacttctccttaccattaaaagtcctcagtaatcatatttgttttgttattttggttttcttccatcagatttgattaactctacctgagttggtcaaattcgaaggagaactccaaattacggggaacaaggcctctggattcactaaaattccatgcagctgcaaaaaa

SEQ ID NO: 214972 - DNA, 636 bp, Homo sapiens
aaattagctgggtgtgggtggtggtgcgcgcctgtggtcccagctactccggaggctgagatgagaggctccctttagctcaggagttggaggccgcaacgaactatgattgtactactgcactccagcctgggcagcagggcaagaccctatctctaaaatttaaaaaataaaatatataaattagataggtcaagttcaaaaagacacgcaactactatgtgccaaaacttgggctgagcacattgagtgctcaccaccgccctgtgccaccaagtctgataccatccaccctgtgtcctagatgaggaaacaggtgcacagagaggttaaaatgttggctggaggccaggtgcggtggctcacgcctctaatcccaacactctgagaggccgacgtggatcacctgaggtcaggaatcggagaccagcctggccagcgtggtgaaaccctgtctctactaagaataccttaaaaaaaaaaaaaaattagctgggcatggtggtgctcacctgtaatcccagctacctgggagtctgagggaggagaaacgcttgaacacaggaggccgaggttgcagtgagcccagatcgtgccactgcactccagcctgggtgacagagcgagactctaact

SEQ ID NO: 214973 - DNA, 619 bp, Homo sapiens
ccaggggtcagcaaattatgatccagaggccaagcccagcccgtctgcttttgtgtataaagttctcatggaacagagctgtgagcctgccgtgtgtggtctacggctccccctggacacagctgcagagctgattcccgcacagacctcggggcccgcagagggaggcgccttccctccatcatccccactgagcaccagccgccgcagccgctaaaacctgcggaactcactccatgccccttgttggctttcttcacataaagtggataaaactgggtgtttacagcctaaagcagcccatgccaaggcactcctcagggactgagccttagtcacagtccttgtgactacagcacgtccatagatgagagctggccgagggatccgtgtgcctccagcttctcggagctggaaagaatccatactggaaaagtgttccttcagtgctcctccttctgggaaaaaaagacggggagctacatcaaccttaagggttaatgttgcttgaattatcttaaatagtgaagatggagaaatagtcaataatgaagagcatgaatatgcatccaaaaaaaggaaaaaggaccattttagaaatgacacaaatactcaaagt

SEQ ID NO: 214974 - DNA, 1656 bp, Homo sapiens
ccaggggtcagcaaattatgatccagaggccaagcccagcccgtctgcttttgtgtataaagttctcatggaacagagctgtgagcctgccgtgtgtggtctacggctccccctggacacagctgcagagctgattcccgcacagacctcggggcccgcagagggaggcgccttccctccatcatccccactgagcaccagccgccgcagccgctaaaacctgcggaactcactccatgccccttgttggctttcttcacataaagtggataaaactgggtgtttacagcctaaagcagcccatgccaaggcactcctcagggactgagccttagtcacagtccttgtgactacagcacgtccatagatgagagctggccgagggatccgtgtgcctccagcttctcggagctggaaagaatccatactggaaaagtgttccttcagtgctcctccttctgggaaaaaaagacggggagctacatcaaccttaagggttaatgttgcttgaatgtaagcataataaatattcagcatgtctcctaagacctggagtatcatcagagaccaagcttggaaaaccacaaagaatgacgcccagtttctaagagtcattccgtgctttacaatcagcccacaaccaccgagtcccaggaagcccagccgagaccgcggcaggtcctgacgcggcatcagcctgagtctgagcccagaggaagcttctgctgccacaattgctgcgtgtgctcatggcttgggtgcaggcccaaccacagcggaccaagggcaggctgagatttggcctggactggagggctgtctcaaggagggtgacgtgtctttgacttttgcattcttcccctttcctttctattctcttggtgacgtgaacacagacagaaagtgaacgttttttgcataaattccctgtagattctggatattaggcctttgtcagatgcatagtttgcaaatagtttctctcattcagtaggttgtctgtattctctgtcaaatgtttctcttgctgtgcagaagctctttcatttagttaaattctacttgccaattttgttttgttgcaatcgtttttgggaacttagccaaaaattctttgccaaggccaacgtcaagaagagtatttcctaggttatcttccaggatcttacagtttgaggtcttacattgaaatctttaatatattttgagttaatttttgtatatggtgaaaggtaggggtctggcttcagtcttctgtatgtggctagccagttattccaacaccatatattgaatagtatggtctttttccactgctgcttttgctggccttgtcaaagattggatggttgtaggtgtgtggctttatttctgagttttctgttctgttcattggtctatgagtctgtttttgtaccagtacagaagctgttttggttactggggctgtatagtatagtttgaagttgagtagtgtgatgcctctggctttgttctttttgcttaggattgctttggctatttgggctctcttttcattccatatgaattttaggatagtttcttcttgttcttaaatgcattttataattaacttgtttagctctaagaaaaaaacttgattttgtattggaatagcattaaatttaatatttt

SEQ ID NO: 214975 - DNA, 936 bp, Homo sapiens
ccaggggtcagcaaattatgatccagaggccaagcccagcccgtctgcttttgtgtataaagttctcatggaacagagctgtgagcctgccgtgtgtggtctacggctccccctggacacagctgcagagctgattcccgcacagacctcggggcccgcagagggaggcgccttccctccatcatccccactgagcaccagccgccgcagccgctaaaacctgcggaactcactccatgccccttgttggctttcttcacataaagtggataaaactgggtgtttacagcctaaagcagcccatgccaaggcactcctcagggactgagccttagtcacagtccttgtgactacagcacgtccatagatgagagctggccgagggatccgtgtgcctccagcttctcggagctggaaagaatccatactggaaaagtgttccttcagtgctcctccttctgggaaaaaaagacggggagctacatcaaccttaagggttaatgttgcttgaatgtaagcataataaatattcagcatgtctcctaagacctggagtatcatcagagaccaagcttggaaaaccacaaagaatgacgcccagtttctaagagtcattccgtgctttacaatcagcccacaaccaccgagtcccaggaagcccagccgagaccgcggcaggtcctgacgcggcatcagcctgagtctgagcccagaggaagcttctgctgccacaattgctgcgtgtgctcatggcttgggtgcaggcccaaccacagcggaccaagggcaggctgagatttggcctggactggagggctgtctcaaggaggtatcttaaatagtgaagatggagaaatagtcaataatgaagagcatgaatatgcatccaaaaaaaggaaaaaggaccattttagaaatgacacaaatactcaaagt

SEQ ID NO: 214976 - DNA, 888 bp, Homo sapiens
acctataatcccaccactgtgggaggctgaggtgggaggatcacttgagctcaggagttcaagaccagcctggacaacatagtgagtccctatctctagaaaaaaataacaacaacaacaaaaagctagccaggtatggtggtgcatgcctgtagtcccagctactttggggggctgaggtgggaggattgcttgagcccaggtaaggctgcagtgagtcatgattgtgccatcacactccagcctgggtaacacagtgagattctgtctcaaaaaaaaaccaaaacaaaacaatacaaaaaaacccacatgattttgtgtacatgctctatcataggacacccccagcaggtccaaggcagtacctagtaatcacaagcacatacacggccatttctgcagcaaaacctccagacatgccactggagagtaatcaagaccatcagcagcttcttagtagttcaggtcaggttttgccactgaacgagctgcccaaacttaccagaacaactgttcttcagaactgcttgggttttaaaactaagggtgagggattatagagcagcatcaagatcccacatggagtggacccacagtacaaggtgtaacagggcattctgaatatctccaacatgcagacaatgagcagcagcccagaagggagccgtgcctgcctgaggcatgcaggcagctgggggaagtcaggtttccagggcaggaaatgccgctgctagtgacagcctgaagcctgacataagggtttttaccctagtgggttagtttctggtgaatgagtttggcaagtcatacccagcattctctgtataataagtcagagagaccaccaaggtgcactgcctgagctaagggtgagtgctgtgccgagaa

SEQ ID NO: 214977 - DNA, 389 bp, Homo sapiens
ccagctgttgaaaagaacaaagaggaagacagagaccaggactccgcccgggaggggcagtgcagggtggctctcgtttctggtccagcctgcattcagcatttatctgttcagcacgattaactgaatacctggtcgctactaggaggaaaagggccttccctggcagcagcctgaagcacgaacgaactcacggcatgccaggctgtgttctagaaccaggagatggaggggcatatggagattagtccatttaatactcaaaataatccaattaggttggaaatttataaaccccatttaatatatgaagatgatggggcacagggaggttaagtaatttgcctaaaagcacacagctagtaaagtggtagacctgagattccaat

SEQ ID NO: 214978 - DNA, 692 bp, Homo sapiens
ggggagccaaacaattcagagacaactatctttagcattttggtatattctttccagatacattttttagatagtattgaatatgcctaatgtacagtttttcatcttgcttttctcctttaacattcttgttataaactgttagcctttttagtgattgcccaacattttgagttgtattaccttaatttacttgactttgtattttaaaaactaatttctgaacaagtacatatacatattcctttaaagggtgcttggattatactatgaattagttttttagaactagcaagctgatgaaagagcaccattttcctacagttagaaaaaaatgcattatcttaccttgtgtggttatgcgtatctgaatcactgcaaaactgcatttgaaagtcatccttaatattgccaggattctgattgggttagataggatctttggacttttttacaattttcaggtcaaaaccaatagaaaaaaatagcaacagaaattttctgtggaataatgatgtcactagctcccctataaacgttctcaaagtaagtaatttccaggctgtaccgtttggcacatgcacagagaagaaacttaactgtttataatagtgcgtggtttgtttttagagttttaagaaaaaatctggagtatattttaatgtaatattattatattatttatgtacgct

SEQ ID NO: 214979 - DNA, 360 bp, Homo sapiens
tctgctggggccattccagctttggctgataatgcgtttattgcgttactttagtacagtcggcctgcctcgccccacctccagcagcccagcctgttcacagctttctgctcactgctcactacccaaggaggtggggtctgtctcccagggtgggcactccaggcacctcctctgccctggatgttgccttgtatgccttgggtgaagggcttctcttgcctcagctgaaaccaagttttatagaatatggatatggatcatcaaatgagatttttacagtacagtaaagtgtgaatctaattgcagccagagccaaaaaaaaaacaaacaaacaacaacaacaaaaaaaacaaactg

SEQ ID NO: 214980 - DNA, 447 bp, Homo sapiens
tcctttccggcagtacccggaacacttgtagcttggcgtatttctctctatagtttacatgctatggagaaccttaattgcaggagaatgaatgaattcacaaaaactcgattatagcagtatagcatatgtaagttctctcacattggcaactgcctaccttgaattacttcattaataaaacaaaacaaacaaaaaccaaagcagtttttaatcttcaaaacctcgtggtggggaaaaaaatcttaaatgatgtttattgctgtgggtttttattttcccctttctggttttgaaagagacaaaaatttaaaatccagcaagtgtattacattgctttaaagactacaaaatttattttgcttgttaaaggacataaaaaggtaatacatcaagctgttaaagatggctacctttgaggaggggagggaaattaggaggtgtggt

SEQ ID NO: 214981 - DNA, 438 bp, Homo sapiens
ccactggccaaatctgatccaagggctgtttttgcacagctctcaagctaacaatagttttcacatttttaaagtgttgttaaaacaaaacaaaacaaaacaaaaagaagcatatgtaacagcgaccacaggggcctgcaaaatctaaaatatatttgctatccagacaaaaatgtatttactttcaaacaaaaaaaggttgccaactccttatctaccctaagacccagctactccactcctagatatttacccaaaaaaaatcaaaattatgttcacaaaaagacatgcaaaagttatacttataaaaatcttgttcatggtatctaaaaattggggaaggggggtaattggccagctcatcctaaaattcacatggaagagcgaaggaccaagaatactgaagacaattttgaagaacatgttggagggaaggga

SEQ ID NO: 214982 - DNA, 458 bp, Homo sapiens
tgtggaggaggagcaagatgtgacagtttcatttccagaggatcactctagctgtggaatggaggatggaatgcaggaaggcacacatagaagtggggggacagttcagaggctacagcagtagtccaggaaagaaatgttggtggctcagaacttgggtgatggcaaataaggggaagattttaaggaagatggagtgctgttatagactggaggccgagagctaagacggcattatcaagattgatttccaggtttatgcgtgagcaacaaggcaacaaaagtgggtatgagatggggctgaagagtaaatgcaaggtggagaaaccagagaagaaacagaagtttagaagagggctctgtaagatgggaaatcttacacattacctacatgaaccttaagatgtgggaaagggggatggcagtggtgagaaatgctagattaagaaaagcagaca

SEQ ID NO: 214983 - DNA, 219 bp, Homo sapiens
tactgggcggagctgggctggccaggccagagctggctggagccttccagtctctggtctgtggccaggttcacagccttgagagggcaggaggtatgaggcctggagatgtggggccctcagggtggggtggatgaagagaaatggagattcagtgacagaaagatccagagagacaaggagtggggaaagagatgggaggcccaaagacagatttta

SEQ ID NO: 214984 - DNA, 628 bp, Homo sapiens
ttgacttagttcacagtggaatactcttcactgcatctttctaaatggagaactgcccatttctttggattcagcccaagtacagtgctatctagatggagggggctgggctgaaactttttaaaagggctcttctaagcccaggattctgtaattcccagtttttcatcctactcttcgtgtttttccagcaccttcagaaacttagaaaatttaaaagagagagctagaaaaagaggaaaatgaaaaggaaaagaaggaaagaaagttctggctttcctacctgcctattgcttgaaacttcctggcccctttattaaaaagtaataagtgaagctgttaaatccagggtacccctagcaacaagatgagaaccactgttttcattgttaggaggctagattctattcaacttgcccttagctttttaaaacataatggataagccacagcaattttatctgtttccccaactataaaatgggataataatctctctaacctttttcttccatcctggaattgtccccaagatgaaatttgatcctgtaaacttgcttcagtgaaaggcactacacaaacaaaagtggtaattatagagttgcttggtaaagcagctttgcattgt

SEQ ID NO: 214985 - DNA, 419 bp, Homo sapiens
cgtggtgggagagaggcccttccacccagtctcgcgggaagcggcttgttcacgtccccatttgggtaggagccctgggtctgtgttcactgttggggaagctcccgggccgctcctggatgcagccggaatggctgagatcttcagcccggaagagggaggctccgttctgcactgtggcgtcgttgtctcggcttcctctcctgagtctccgtccagaatctgcggatcatggtgggcaggcatccgttccaacaggatggtgacaggaactgagcaaaggaaggaataattcactgagaattcgggggaaacctcaaacagttctcaggaatgggagatttttgtattctgtaaaaattccatttgcatggagactcagattttaaatctctaattaaaaacaaaagtagctgaat

SEQ ID NO: 214986 - DNA, 316 bp, Homo sapiens
tgtggtttagtggaagaagagggaaaagggagagatcaggagctaattgtgacccatttccaagtgtccaagtttaggagttgattcttgtcatgattagtcattttggaagcacgcatgtgcatttaaaccacactactttcattctgagtaatgtaagaggatttttaacttccaaaaatgtctagaattcaggttaacgtctcctagtcatgtgtgcataaagggcacggtatgcagggccttacttcttttcaggctatttgggccattgcattatgagaccttgtaaccaaaattatcaccctaacatcat

SEQ ID NO: 214987 - DNA, 412 bp, Homo sapiens
tgctgccccgtcccggcggtaatgcgctcccggccgtgacccccgctgggggcgggggccgggatccatgcgcggagcccccacccggcccggcgcctgcggctgacggcggcgggggttggggggcgcgcgtctggcctcctgcccaccccctggcgtcgacatcacgggccgtcgggggctgcgccctaccccgcggccaggctctggagggaccctggaggtgccgccggcctcagcccatggcccaaaggtacgatgagctgccgcactacccaggcatcgcggatggccccgcagccctggctggcttcccagaggcagtgcccgcggcaccagggccctatggccctcaccggcctccccagcccctacccccaggcttggacagcgacggcctgaagagggacaa

SEQ ID NO: 214988 - DNA, 466 bp, Homo sapiens
cagtaaaatgtgagtgagaattcatttctgaccatgttaaatgtacagattttatagcataaaggtagagcagcacatctcccagccacgttttcttttagacactgattgctgcattcctaggatgtgatcttgctgaatgttaatcatgaggggcccagggtgtggtgggagtgggctgtgggtgcaagaaatatcctcccctcatcctgtggagcttaagactgaccctagaaaatacaactcaaggattcccactgtatttcccgttacttctataaaaatgttcatctgggggcttttggagggtggagggcgagaggagagagaggatcagaaaaagtaactaatgggtagaaggcttaatacctgggtgatgaaataatctgtacaacaaacccatatgacacaagtttacctacataacaaatctgcactaataccccctgaacttatgataaaagtt

SEQ ID NO: 214989 - DNA, 633 bp, Homo sapiens
aagatatcaaagtcagggtagcctagagtatgctgggtaaaaaacagtctccatatctcagtagcttgaaacaattagtttcctttccactgtcactacatgtccatcaaagataggctaaagacttttagttgtacaaggacaaagaccaacggcagcctgcgcaaccaccgttgggaatattgccagttgctctgctgaaggcaaaagaaagctctggaggccttgccccgttaactaaatgttctgcgcagaagtaatgagaatagaggagaggaatcagagctgaaaagagcagatgaatgtgagatggttccagaatttggagattgtttaaatgtgggaagaggggaggaattgtggatggatgacgctcaggtttgtgtcttgggcaaactgggtggtgttgcttactgagataagaaaagggtaggtttgggattagaggaaatgttggtagagagttcacttttggaaatgtctagcagctagttgtctaaatggatctggagtgctagagagaggcaggggtatttagatttggaagtagtctccacaagaaggtttaatctgtgatagggaacagggttactcagggcaaacttaagaaagtgataggagagttgacatcga

SEQ ID NO: 214990 - DNA, 227 bp, Homo sapiens
atcagccggactgacacatctaggggcgtttgggattagaggaaatgttggtagagagttcacttttggaaatgtctagcagctagttgtctaaatggatctggagtgctagagagaggcaggggtatttagatttggaagtagtctccacaagaaggtttaatctgtgatagggaacagggttactcagggcaaacttaagaaagtgataggagagttgacatcga

SEQ ID NO: 214991 - DNA, 641 bp, Homo sapiens
ccaggcacaatggctcatgcctgtaatcccagcactttggaaggctgaggcaggaggattgcttgacccaggagttggagaccagtctgggcaacatagcaagaccctatctctacaaaaaataagttagctgggcatggtggcacacgcctgtagtcccagctaattggaaggctgagacaagagggctgcttgaaccccagaggttgaagctacagtgaactgtgatcacaccactgcactccagcttgggagacagagtaatataataccctgtctctctaaaaaatgaaacttttttttaaattaatttgggatttatgtagacacatcaccaccattcttatactggtcttaattttcagattcatgtgaggtgccatttttttctgaagtagatgcataattgatttcaagttgctggcctcatatcaaagtatcagacagaacaaagatattcagtgttgctgggcgtggtggcttacgcctgtaatcccagcactttgggaggccaggagttcaagaccagtctggccaacatggtgaaaccctgtctctactccactagactcccccacacaaccatgtcgccggcttgggccagccgacttttagactgagccagtttatcgtgcgcccgc

SEQ ID NO: 214992 - DNA, 520 bp, Homo sapiens
tgtcacacttgacatttagttcatcattaaatcccatcggtgctagcttcaagatatccagattttgatatttctcaaaatctttccaccttccattttgatctatgccaccactatctcatgcctggatgattgctatagtgctggtctttgctaatcctgcctattctttctccttttgtccttgcctccctttgtttggtttgttctctcagcaaccagaataatactttaaaaacattaggccaggtgcagtggctcacacctgtaatcccagcattttgggattacattaagtggaaggattgcttgagcccaggagtttgagaccatcctgagcaacatagcaagactccatctctacaaaaatgaaaaataaaaagaaataaataggtgggcatagtggcacacgcttttatgcttttggtcccagctacttgggaggctgaggtgggaagatgcttgaggccgggaggttaagacaatcctgagcaacatagtgagacaccatctctaccca

SEQ ID NO: 214993 - DNA, 496 bp, Homo sapiens
gaaggtttacagcaaaaaaaaaaaaaaaaaaagagagagagaaagactgattacttgtcacagaatcgctgagtgaatcactaagtgaagacctgcctatcacagttttctgttcctgaaatgttgactgcacattttgcttctgcttgacatatcaagctaagtaactaaatgctgatatttgatattatttgatgtcataatcagatgctcattcaatacaagtcactgccaaattttacaaagacttgcagaaattgaaattctagttaatgttatccttcacttgctgctttggttccagagtttaagttaattcttttctaggcttttaattaagcagatgatgagagtgggatgggacaggggtcaacattaagtttggagtattgttttctcatcattcaccacagcctgcttcaaatctgttttatttttatttttgagtttattttttcagcactgaggaaagctgataacatcatatatatttggt

SEQ ID NO: 214994 - DNA, 217 bp, Homo sapiens
cagctcagaggttgcctatgagtcaatacaaatttctaataacaaagaaaacaccacggacttggaaagagagaaggggtcttgtggcgagtcaggagtccactgtttgctgggctctgccagacaccgtgcacgacccattccctgactggctcccagtggggatggcttcaaaagcctcttgaggaacctctcatccactgctggcacttggaga

SEQ ID NO: 214995 - DNA, 204 bp, Homo sapiens
acagttacgaggatggtgaccctggttctgggactgatgctggcaacattcaggagagaaatgttgtggctggcgttctcaagtacacgccagtaaaagaaggtcatgtgccacactggtcttctttgtgtgcccttgaagctgggagcttcatttgtgggcatggagggaataacagtagtgaaggtaggtaggtaagtgtcc

SEQ ID NO: 214996 - DNA, 2888 bp, Homo sapiens
cccagagttccttcgagctccccgagtccccgcggagcagcggcggtcgaggggcggggacgggggcggagcccaggaacgccggcccccagggctggaggctggggcggccctgaggacgcgtgcggggcaggtcacgcttgggcctggctgcctcaggagccaccctgcacggcgccgggcgaggctgtgcgcgccctcccggaccctccactttggggctttgcggtgtagcggcgcgccccactcccttacgtgttcagtcccgaatcacgtacgggccgctgcagctccaggacggcggacgccagcgctctcggatccccaggcccctccgtgctcatcccggaccgctccgtccctgaggaaaaaccgccccgtgcccggaaccgcggcttctcccacgcggggcaggccggggctgtgagggggcagcccgcctgcggactaggccgggggtttgaggaggcggctctgccggggacaaagccgggggcgtgaggggcggttctgccgggttcggggcgcgcggggcaggttgcgtgaagaggcggaaagtcccactcgccctcggcttctccctgcccggccgccggtgtcccgcccgccgcctccccgcgcagcccggcccgacccgcggcgatggcccagcccggggacccgcggcgcctctgcaggctggtgcaggagggccggctgcgcgccctgaaggaggagctgcaggcggccgggggctgcccggggccggccggggataccctcctgcactgcgccgcgcgccacgggcatcgggacgtgctggcctatctggccgaggcctggggcatggacatcgaggccaccaaccgagactacaagcggcctctgcacgaggcggcctccatgggccaccgagactgcgtgcgctacctgctgggccggggggcagcggtcgactgcctgaagaaggccgactgggtcctcacagaaggcacagaggttgccggtcaaagctgttttcctgcctgccagacccctgaatcctctaggttttccatctgtgccaaggatgtgtgtgttttgaagacctggcccctggcttctaatgtctcagctgcctccatctgacagcttctcctggttggccttaggactcctctgatgatggcctgcacaaggaagaacctgggggtgatccaggagctggtggaacatggcgccaatccactcctgaagaacaaagatggctggaacagtttccacattgccagtcgagaaggcgaccctctgatcctccagtacctgctcactgtttgcccaggtgcctggaagacagagagcaaaattagaaggactcctctgcatactgcagcaatgcatggccatttggaggcagtcaaggtgcttcttaagaggtgccaatatgaaccagactacagagacaactgtggcgtcaccgccttgatggacgcaatccagtgtggtcacatcgacgtcgctaggctgctcctcgatgaacatggggcttgcctttcagcagaagacagcctgggtgcccaggctctgcacagggcagctgtcacagggcaggacgaagccatccgattcttggtctctgaacttggcgtcgatgtagatgtgagagccacatcaacccacctcacagcacttcattatgcagctaaggaaggacatacaagtacaattcagactctcttatccttgggagctgacatcaattctaaagatgaaaaaaatcgatcagccctgcatctggcctgtgcaggtcagcacttggcctgtgccaagtttctcctgcagtcgggactgaaggattctgaagacatcacgggcaccctggctcagcagctcccaaggagagcagatgtccttcggggctctggccatagcgcaatgacataaggatgtttccaagaggaggcaataaagtgcatgagttgctgggagcctgagcacctttcgtttttcggctcagagaaagccaagtgcaacttgcttcagtcatcctgaacctgagttcaaccaaccgcagccacctacgtttgaccccagcgagatcaaagttgtatatctgaggtgtaccagtggtgaagtcagtgccacatctgcactggcccccaaggtcagctccctgggtctgtctccaaaaatggttgctgatgacatcaccaaccattgactggaagagtctgaggatgatagtgaaactgaccagccacagcagacaggcccagattgaggtggtgccttctgcctctgccctgatcgtcacaaccctcaggaaccaccgacagaaagaaagaaacacaaaaacatgaaacacagtggtagcaccacttctgatgagattgtcaacattgcctaacagatgcagcagcagtctttagccagagaactctctggaaccattaaagaattcctgggggccggttgcggtggctcatgcctgtaatcccagcactttgggaggccgaggcgggaggatcatgaggtcaggagatcgagaccatcctggctaacgtggtgaaaccccgtctcttactaaaaatacaaaaaaattagccaggcatggtggtgggcgcctgtagtcccagctactcaggaggctgaggcaggagaatgctgtgaaccctggaggcagagcttgcagtgagccgaatatgcgccactgcactccagcctgggcaacagagcaagactccgtctccaaaaaaaaaagaattcctggggcctgcccagtctgtgagctgccatgttgatagtatcacagatgataccaacagtgaagctgtggaatgcccagctagttaaagaatgcaaaggaaaatattttcacaaagggttatctgataaccaaaaaataaaaagacatttcatctaagccactt

SEQ ID NO: 214997 - DNA, 1782 bp, Homo sapiens
cccagagttccttcgagctccccgagtccccgcggagcagcggcggtcgaggggcggggacgggggcggagcccaggaacgccggcccccagggctggaggctggggcggccctgaggacgcgtgcggggcaggtcacgcttgggcctggctgcctcaggagccaccctgcacggcgccgggcgaggctgtgcgcgccctcccggaccctccactttggggctttgcggtgtagcggcgcgccccactcccttacgtgttcagtcccgaatcacgtacgggccgctgcagctccaggacggcggacgccagcgctctcggatccccaggcccctccgtgctcatcccggaccgctccgtccctgaggaaaaaccgccccgtgcccggaaccgcggcttctcccacgcggggcaggccggggctgtgagggggcagcccgcctgcggactaggccgggggtttgaggaggcggctctgccggggacaaagccgggggcgtgaggggcggttctgccgggttcggggcgcgcggggcaggttgcgtgaagaggcggaaagtcccactcgccctcggcttctccctgcccggccgccggtgtcccgcccgccgcctccccgcgcagcccggcccgacccgcggcgatggcccagcccggggacccgcggcgcctctgcaggctggtgcaggagggccggctgcgcgccctgaaggaggagctgcaggcggccgggggctgcccggggccggccggggataccctcctgcactgcgccgcgcgccacgggcatcgggacgtgctggcctatctggccgaggcctggggcatggacatcgaggccaccaaccgagactacaagcggcctctgcacgaggcggcctccatgggccaccgagactgcgtgcgctacctgctgggccggggggcagcggtcgactgcctgaagaaggccgactggactcctctgatgatggcctgcacaaggaagaacctgggggtgatccaggagctggtggaacatggcgccaatccactcctgaagaacaaagatggctggaacagtttccacattgccagtcgagaaggcgaccctctgatcctccagtacctgctcactgtttgcccaggtgcctggaagacagagagcaaaattagaaggactcctctgcatactgcagcaatgcatggccatttggaggcagtcaaggtgcttcttaagaggtgccaatatgaaccagactacagagacaactgtggcgtcaccgccttgatggacgcaatccagtgtggtcacatcgacgtcgctaggctgctcctcgatgaacatggggcttgcctttcagcagaagacagcctgggtgcccaggctctgcacagggcagctgtcacagggcaggacgaagccatccgattcttggtctctgaacttggcgtcgatgtagatgtgagagccacatcaacccacctcacagcacttcattatgcagctaaggaaggacatacaagtacaattcagactctcttatccttgggagctgacatcaattctaaagatgaaaaaaatcgatcagccctgcatctggcctgtgcaggtcagcacttggcctgtgccaagtttctcctgcagtcgggactgaaggattctgaagacatcacgggcaccctggctcagcagctcccaaggagagcagatgtccttcggggctctggccatagcgcaatgacataaggatgtttccaagaggaggcaataaagtgcatggtaattcataaaaaaaaaaaa

SEQ ID NO: 214998 - DNA, 2309 bp, Homo sapiens
  misc_feature (2199)..(2199): n is a, c, g, or t
  misc_feature (2205)..(2205): n is a, c, g, or t
  misc_feature (2247)..(2247): n is a, c, g, or t
  misc_feature (2304)..(2304): n is a, c, g, or t
cccagagttccttcgagctccccgagtccccgcggagcagcggcggtcgaggggcggggacgggggcggagcccaggaacgccggcccccagggctggaggctggggcggccctgaggacgcgtgcggggcaggtcacgcttgggcctggctgcctcaggagccaccctgcacggcgccgggcgaggctgtgcgcgccctcccggaccctccactttggggctttgcggtgtagcggcgcgccccactcccttacgtgttcagtcccgaatcacgtacgggccgctgcagctccaggacggcggacgccagcgctctcggatccccaggcccctccgtgctcatcccggaccgctccgtccctgaggaaaaaccgccccgtgcccggaaccgcggcttctcccacgcggggcaggccggggctgtgagggggcagcccgcctgcggactaggccgggggtttgaggaggcggctctgccggggacaaagccgggggcgtgaggggcggttctgccgggttcggggcgcgcggggcaggttgcgtgaagaggcggaaagtcccactcgccctcggcttctccctgcccggccgccggtgtcccgcccgccgcctccccgcgcagcccggcccgacccgcggcgatggcccagcccggggacccgcggcgcctctgcaggctggtgcaggagggccggctgcgcgccctgaaggaggagctgcaggcggccgggggctgcccggggccggccggggataccctcctgcactgcgccgcgcgccacgggcatcgggacgtgctggcctatctggccgaggcctggggcatggacatcgaggccaccaaccgagactacaagcggcctctgcacgaggcggcctccatgggccaccgagactgcgtgcgctacctgctgggccggggggcagcggtcgactgcctgaagaaggccgactggactcctctgatgatggcctgcacaaggaagaacctgggggtgatccaggagctggtggaacatggcgccaatccactcctgaagaacaaagatggctggaacagtttccacattgccagtcgagaaggcgaccctctgatcctccagtacctgctcactgtttgcccaggtgcctggaagacagagagcaaaattagaaggactcctctgcatactgcagcaatgcatggccatttggaggcagtcaaggtgcttcttaagaggtgccaatatgaaccagactacagagacaactgtggcgtcaccgccttgatggacgcaatccagtgtggtcacatcgacgtcgctaggctgctcctcgatgaacatggggcttgcctttcagcagaagacagcctgggtgcccaggctctgcacagggcagctgtcacagggcaggacgaagccatccgattcttggtctctgaacttggcgtcgatgtagatgtgagagccacatcaacccacctcacagcacttcattatgcagctaaggaaggacatacaagtacaattcagactctcttatccttgggagctgacatcaattctaaagatgaaaaaaatcgatcagccctgcatctggcctgtgcaggtcagcacttggcctgtgccaagtttctcctgcagtcgggactgaaggattctgaagacatcacgggcaccctggctcagcagctcccaaggagagcagatgtccttcggggctctggccatagcgcaatgacataaggatgtttccaagaggaggcaataaagtgcatgagttgctgggagcctgagcacctttcgtttttcggctcagagaaagccaagtgcaacttgcttcagtcatcctgaacctgagttcaaccaaccgcagccacctacgtttgaccccagcgagatcaaagttgtatatctgaggtgtaccagtggtgaagtcagtgccacatctgcactggcccccaaggtcagctccctgggtctgtctccaaaaatggttgctgatgacatcaccaaccattgactggaagagtctgaggatgatagtgaaactgaccagccacagcagacaggcccagattgaggtggtgccttctgcctctgccctgatcgtcacaaccctcaggaaccaccccaccccccctggaacagtaactgtatctaacgcacctaacaaaccccagaaggctgcacacagcccctgcacatggtatgccnccaagnaattacccatggatttgaaaaaggtaatatatgatgtaacanacatgcgcaaaagaggaggtataaggagtttatagggaaaaatattagcatctgggnaaaaa

SEQ ID NO: 214999 - DNA, 2635 bp, Homo sapiens
cccagagttccttcgagctccccgagtccccgcggagcagcggcggtcgaggggcggggacgggggcggagcccaggaacgccggcccccagggctggaggctggggcggccctgaggacgcgtgcggggcaggtcacgcttgggcctggctgcctcaggagccaccctgcacggcgccgggcgaggctgtgcgcgccctcccggaccctccactttggggctttgcggtgtagcggcgcgccccactcccttacgtgttcagtcccgaatcacgtacgggccgctgcagctccaggacggcggacgccagcgctctcggatccccaggcccctccgtgctcatcccggaccgctccgtccctgaggaaaaaccgccccgtgcccggaaccgcggcttctcccacgcggggcaggccggggctgtgagggggcagcccgcctgcggactaggccgggggtttgaggaggcggctctgccggggacaaagccgggggcgtgaggggcggttctgccgggttcggggcgcgcggggcaggttgcgtgaagaggcggaaagtcccactcgccctcggcttctccctgcccggccgccggtgtcccgcccgccgcctccccgcgcagcccggcccgacccgcggcgatggcccagcccggggacccgcggcgcctctgcaggctggtgcaggagggccggctgcgcgccctgaaggaggagctgcaggcggccgggggctgcccggggccggccggggataccctcctgcactgcgccgcgcgccacgggcatcgggacgtgctggcctatctggccgaggcctggggcatggacatcgaggccaccaaccgagactacaagcggcctctgcacgaggcggcctccatgggccaccgagactgcgtgcgctacctgctgggccggggggcagcggtcgactgcctgaagaaggccgactggactcctctgatgatggcctgcacaaggaagaacctgggggtgatccaggagctggtggaacatggcgccaatccactcctgaagaacaaagatggctggaacagtttccacattgccagtcgagaaggcgaccctctgatcctccagtacctgctcactgtttgcccaggtgcctggaagacagagagcaaaattagaaggactcctctgcatactgcagcaatgcatggccatttggaggcagtcaaggtgcttcttaagaggtgccaatatgaaccagactacagagacaactgtggcgtcaccgccttgatggacgcaatccagtgtggtcacatcgacgtcgctaggctgctcctcgatgaacatggggcttgcctttcagcagaagacagcctgggtgcccaggctctgcacagggcagctgtcacagggcaggacgaagccatccgattcttggtctctgaacttggcgtcgatgtagatgtgagagccacatcaacccacctcacagcacttcattatgcagctaagccctgcatctggcctgtgcaggtcagcacttggcctgtgccaagtttctcctgcagtcgggactgaaggattctgaagacatcacgggcaccctggctcagcagctcccaaggagagcagatgtccttcggggctctggccatagcgcaatgacataaggatgtttccaagaggaggcaataaagtgcatgagttgctgggagcctgagcacctttcgtttttcggctcagagaaagccaagtgcaacttgcttcagtcatcctgaacctgagttcaaccaaccgcagccacctacgtttgaccccagcgagatcaaagttgtatatctgaggtgtaccagtggtgaagtcagtgccacatctgcactggcccccaaggtcagctccctgggtctgtctccaaaaatggttgctgatgacatcaccaaccattgactggaagagtctgaggatgatagtgaaactgaccagccacagcagacaggcccagattgaggtggtgccttctgcctctgccctgatcgtcacaaccctcaggaaccaccgacagaaagaaagaaacacaaaaacatgaaacacagtggtagcaccacttctgatgagattgtcaacattgcctaacagatgcagcagcagtctttagccagagaactctctggaaccattaaagaattcctgggggccggttgcggtggctcatgcctgtaatcccagcactttgggaggccgaggcgggaggatcatgaggtcaggagatcgagaccatcctggctaacgtggtgaaaccccgtctcttactaaaaatacaaaaaaattagccaggcatggtggtgggcgcctgtagtcccagctactcaggaggctgaggcaggagaatgctgtgaaccctggaggcagagcttgcagtgagccgaatatgcgccactgcactccagcctgggcaacagagcaagactccgtctccaaaaaaaaaagaattcctggggcctgcccagtctgtgagctgccatgttgatagtatcacagatgataccaacagtgaagctgtggaatgcccagctagttaaagaatgcaaaggaaaatattttcacaaagggttatctgataaccaaaaaataaaaagacatttcatctaagccactt

SEQ ID NO: 215000 - DNA, 2714 bp, Homo sapiens
cccagagttccttcgagctccccgagtccccgcggagcagcggcggtcgaggggcggggacgggggcggagcccaggaacgccggcccccagggctggaggctggggcggccctgaggacgcgtgcggggcaggtcacgcttgggcctggctgcctcaggagccaccctgcacggcgccgggcgaggctgtgcgcgccctcccggaccctccactttggggctttgcggtgtagcggcgcgccccactcccttacgtgttcagtcccgaatcacgtacgggccgctgcagctccaggacggcggacgccagcgctctcggatccccaggcccctccgtgctcatcccggaccgctccgtccctgaggaaaaaccgccccgtgcccggaaccgcggcttctcccacgcggggcaggccggggctgtgagggggcagcccgcctgcggactaggccgggggtttgaggaggcggctctgccggggacaaagccgggggcgtgaggggcggttctgccgggttcggggcgcgcggggcaggttgcgtgaagaggcggaaagtcccactcgccctcggcttctccctgcccggccgccggtgtcccgcccgccgcctccccgcgcagcccggcccgacccgcggcgatggcccagcccggggacccgcggcgcctctgcaggctggtgcaggagggccggctgcgcgccctgaaggaggagctgcaggcggccgggggctgcccggggccggccggggataccctcctgcactgcgccgcgcgccacgggcatcgggacgtgctggcctatctggccgaggcctggggcatggacatcgaggccaccaaccgagactacaagcggcctctgcacgaggcggcctccatgggccaccgagactgcgtgcgctacctgctgggccggggggcagcggtcgactgcctgaagaaggccgactggactcctctgatgatggcctgcacaaggaagaacctgggggtgatccaggagctggtggaacatggcgccaatccactcctgaagaacaaagatggctggaacagtttccacattgccagtcgagaaggcgaccctctgatcctccagtacctgctcactgtttgcccaggtgcctggaagacagagagcaaaattagaaggactcctctgcatactgcagcaatgcatggccatttggaggcagtcaaggtgcttcttaagaggtgccaatatgaaccagactacagagacaactgtggcgtcaccgccttgatggacgcaatccagtgtggtcacatcgacgtcgctaggctgctcctcgatgaacatggggcttgcctttcagcagaagacagcctgggtgcccaggctctgcacagggcagctgtcacagggcaggacgaagccatccgattcttggtctctgaacttggcgtcgatgtagatgtgagagccacatcaacccacctcacagcacttcattatgcagctaaggaaggacatacaagtacaattcagactctcttatccttgggagctgacatcaattctaaagatgaaaaaaatcgatcagccctgcatctggcctgtgcaggtcagcacttggcctgtgccaagtttctcctgcagtcgggactgaaggattctgaagacatcacgggcaccctggctcagcagctcccaaggagagcagatgtccttcggggctctggccatagcgcaatgacataaggatgtttccaagaggaggcaataaagtgcatgagttgctgggagcctgagcacctttcgtttttcggctcagagaaagccaagtgcaacttgcttcagtcatcctgaacctgagttcaaccaaccgcagccacctacgtttgaccccagcgagatcaaagttgtatatctgaggtgtaccagtggtgaagtcagtgccacatctgcactggcccccaaggtcagctccctgggtctgtctccaaaaatggttgctgatgacatcaccaaccattgactggaagagtctgaggatgatagtgaaactgaccagccacagcagacaggcccagattgaggtggtgccttctgcctctgccctgatcgtcacaaccctcaggaaccaccgacagaaagaaagaaacacaaaaacatgaaacacagtggtagcaccacttctgatgagattgtcaacattgcctaacagatgcagcagcagtctttagccagagaactctctggaaccattaaagaattcctgggggccggttgcggtggctcatgcctgtaatcccagcactttgggaggccgaggcgggaggatcatgaggtcaggagatcgagaccatcctggctaacgtggtgaaaccccgtctcttactaaaaatacaaaaaaattagccaggcatggtggtgggcgcctgtagtcccagctactcaggaggctgaggcaggagaatgctgtgaaccctggaggcagagcttgcagtgagccgaatatgcgccactgcactccagcctgggcaacagagcaagactccgtctccaaaaaaaaaagaattcctggggcctgcccagtctgtgagctgccatgttgatagtatcacagatgataccaacagtgaagctgtggaatgcccagctagttaaagaatgcaaaggaaaatattttcacaaagggttatctgataaccaaaaaataaaaagacatttcatctaagccactt

SEQ ID NO: 215001 - DNA, 2797 bp, Homo sapiens
cccagagttccttcgagctccccgagtccccgcggagcagcggcggtcgaggggcggggacgggggcggagcccaggaacgccggcccccagggctggaggctggggcggccctgaggacgcgtgcggggcaggtcacgcttgggcctggctgcctcaggagccaccctgcacggcgccgggcgaggctgtgcgcgccctcccggaccctccactttggggctttgcggtgtagcggcgcgccccactcccttacgtgttcagtcccgaatcacgtacgggccgctgcagctccaggacggcggacgccagcgctctcggatccccaggcccctccgtgctcatcccggaccgctccgtccctgaggaaaaaccgccccgtgcccggaaccgcggcttctcccacgcggggcaggccggggctgtgagggggcagcccgcctgcggactaggccgggggtttgaggaggcggctctgccggggacaaagccgggggcgtgaggggcggttctgccgggttcggggcgcgcggggcaggttgcgtgaagaggcggaaagtcccactcgccctcggcttctccctgcccggccgccggtgtcccgcccgccgcctccccgcgcagcccggcccgacccgcggcgatggcccagcccggggacccgcggcgcctctgcactgcgccgcgcgccacgggcatcgggacgtgctggcctatctggccgaggcctggggcatggacatcgaggccaccaaccgagactacaagcggcctctgcacgaggcggcctccatgggccaccgagactgcgtgcgctacctgctgggccggggggcagcggtcgactgcctgaagaaggccgactgggtcctcacagaaggcacagaggttgccggtcaaagctgttttcctgcctgccagacccctgaatcctctaggttttccatctgtgccaaggatgtgtgtgttttgaagacctggcccctggcttctaatgtctcagctgcctccatctgacagcttctcctggttggccttaggactcctctgatgatggcctgcacaaggaagaacctgggggtgatccaggagctggtggaacatggcgccaatccactcctgaagaacaaagatggctggaacagtttccacattgccagtcgagaaggcgaccctctgatcctccagtacctgctcactgtttgcccaggtgcctggaagacagagagcaaaattagaaggactcctctgcatactgcagcaatgcatggccatttggaggcagtcaaggtgcttcttaagaggtgccaatatgaaccagactacagagacaactgtggcgtcaccgccttgatggacgcaatccagtgtggtcacatcgacgtcgctaggctgctcctcgatgaacatggggcttgcctttcagcagaagacagcctgggtgcccaggctctgcacagggcagctgtcacagggcaggacgaagccatccgattcttggtctctgaacttggcgtcgatgtagatgtgagagccacatcaacccacctcacagcacttcattatgcagctaaggaaggacatacaagtacaattcagactctcttatccttgggagctgacatcaattctaaagatgaaaaaaatcgatcagccctgcatctggcctgtgcaggtcagcacttggcctgtgccaagtttctcctgcagtcgggactgaaggattctgaagacatcacgggcaccctggctcagcagctcccaaggagagcagatgtccttcggggctctggccatagcgcaatgacataaggatgtttccaagaggaggcaataaagtgcatgagttgctgggagcctgagcacctttcgtttttcggctcagagaaagccaagtgcaacttgcttcagtcatcctgaacctgagttcaaccaaccgcagccacctacgtttgaccccagcgagatcaaagttgtatatctgaggtgtaccagtggtgaagtcagtgccacatctgcactggcccccaaggtcagctccctgggtctgtctccaaaaatggttgctgatgacatcaccaaccattgactggaagagtctgaggatgatagtgaaactgaccagccacagcagacaggcccagattgaggtggtgccttctgcctctgccctgatcgtcacaaccctcaggaaccaccgacagaaagaaagaaacacaaaaacatgaaacacagtggtagcaccacttctgatgagattgtcaacattgcctaacagatgcagcagcagtctttagccagagaactctctggaaccattaaagaattcctgggggccggttgcggtggctcatgcctgtaatcccagcactttgggaggccgaggcgggaggatcatgaggtcaggagatcgagaccatcctggctaacgtggtgaaaccccgtctcttactaaaaatacaaaaaaattagccaggcatggtggtgggcgcctgtagtcccagctactcaggaggctgaggcaggagaatgctgtgaaccctggaggcagagcttgcagtgagccgaatatgcgccactgcactccagcctgggcaacagagcaagactccgtctccaaaaaaaaaagaattcctggggcctgcccagtctgtgagctgccatgttgatagtatcacagatgataccaacagtgaagctgtggaatgcccagctagttaaagaatgcaaaggaaaatattttcacaaagggttatctgataaccaaaaaataaaaagacatttcatctaagccactt

SEQ ID NO: 215002 - DNA, 2619 bp, Homo sapiens
cccagagttccttcgagctccccgagtccccgcggagcagcggcggtcgaggggcggggacgggggcggagcccaggaacgccggcccccagggctggaggctggggcggccctgaggacgcgtgcggggcaggtcacgcttgggcctggctgcctcaggagccaccctgcacggcgccgggcgaggctgtgcgcgccctcccggaccctccactttggggctttgcggtgtagcggcgcgccccactcccttacgtgttcagtcccgaatcacgtacgggccgctgcagctccaggacggcggacgccagcgctctcggatccccaggcccctccgtgctcatcccggaccgctccgtccctgaggaaaaaccgccccgtgcccggaaccgcggcttctcccacgcggggcaggccggggctgtgagggggcagcccgcctgcggactaggccgggggtttgaggaggcggctctgccggggacaaagccgggggcgtgaggggcggttctgccgggttcggggcgcgcggggcaggttgcgtgaagaggcggaaagtcccactcgccctcggcttctccctgcccggccgccggtgtcccgcccgccgcctccccgcgcagcccggcccgacccgcggcgatggcccagcccggggacccgcggcgcctctgcaggctggtgcaggagggccggctgcgcgccctgaaggaggagctgcaggcggccgggggctgcccggggccggccggggataccctcctgcactgcgccgcgcgccacgggcatcgggacgtgctggcctatctggccgaggcctggggcatggacatcgaggccaccaaccgagactacaagcggcctctgcacgaggcggcctccatgggccaccgagactgcgtgcgctacctgctgggccggggggcagcggtcgactgcctgaagaaggccgactggactcctctgatgatggcctgcacaaggaagaacctgggggtgatccaggagctggtggaacatggcgccaatccactcctgaagaacaaagatggctggaacagtttccacattgccagtcgagaaggcgaccctctgatcctccagtacctgctcactgtttgcccaggtgcctggaagacagagagcaaaattagaaggactcctctgcatactgcagcaatgcatggccatttggaggcagtcaaggtgcttcttaagaggtgccaatatgaaccagactacagagacaactgtggcgtcaccgccttgatggacgcaatccagtgtggtcacatcgacgtcgctaggctgctcctcgatgaacatggggcttgcctttcagcagaagacagcctgggtgcccaggctctgcacagggcagctgtcacagggcagggaaggacatacaagtacaattcagactctcttatccttgggagctgacatcaattctaaagatgaaaaaaatcgatcagccctgcatctggcctgtgcaggtcagcacttggcctgtgccaagtttctcctgcagtcgggactgaaggattctgaagacatcacgggcaccctggctcagcagctcccaaggagagcagatgtccttcggggctctggccatagcgcaatgacataaggatgtttccaagaggaggcaataaagtgcatgagttgctgggagcctgagcacctttcgtttttcggctcagagaaagccaagtgcaacttgcttcagtcatcctgaacctgagttcaaccaaccgcagccacctacgtttgaccccagcgagatcaaagttgtatatctgaggtgtaccagtggtgaagtcagtgccacatctgcactggcccccaaggtcagctccctgggtctgtctccaaaaatggttgctgatgacatcaccaaccattgactggaagagtctgaggatgatagtgaaactgaccagccacagcagacaggcccagattgaggtggtgccttctgcctctgccctgatcgtcacaaccctcaggaaccaccgacagaaagaaagaaacacaaaaacatgaaacacagtggtagcaccacttctgatgagattgtcaacattgcctaacagatgcagcagcagtctttagccagagaactctctggaaccattaaagaattcctgggggccggttgcggtggctcatgcctgtaatcccagcactttgggaggccgaggcgggaggatcatgaggtcaggagatcgagaccatcctggctaacgtggtgaaaccccgtctcttactaaaaatacaaaaaaattagccaggcatggtggtgggcgcctgtagtcccagctactcaggaggctgaggcaggagaatgctgtgaaccctggaggcagagcttgcagtgagccgaatatgcgccactgcactccagcctgggcaacagagcaagactccgtctccaaaaaaaaaagaattcctggggcctgcccagtctgtgagctgccatgttgatagtatcacagatgataccaacagtgaagctgtggaatgcccagctagttaaagaatgcaaaggaaaatattttcacaaagggttatctgataaccaaaaaataaaaagacatttcatctaagccactt

SEQ ID NO: 215003 - DNA, 1777 bp, Homo sapiens
cccagagttccttcgagctccccgagtccccgcggagcagcggcggtcgaggggcggggacgggggcggagcccaggaacgccggcccccagggctggaggctggggcggccctgaggacgcgtgcggggcaggtcacgcttgggcctggctgcctcaggagccaccctgcacggcgccgggcgaggctgtgcgcgccctcccggaccctccactttggggctttgcggtgtagcggcgcgccccactcccttacgtgttcagtcccgaatcacgtacgggccgctgcagctccaggacggcggacgccagcgctctcggatccccaggcccctccgtgctcatcccggaccgctccgtccctgaggaaaaaccgccccgtgcccggaaccgcggcttctcccacgcggggcaggccggggctgtgagggggcagcccgcctgcggactaggccgggggtttgaggaggcggctctgccggggacaaagccgggggcgtgaggggcggttctgccgggttcggggcgcgcggggcaggttgcgtgaagaggcggaaagtcccactcgccctcggcttctccctgcccggccgccggtgtcccgcccgccgcctccccgcgcagcccggcccgacccgcggcgatggcccagcccggggacccgcggcgcctctgcaggctggtgcaggagggccggctgcgcgccctgaaggaggagctgcaggcggccgggggctgcccggggccggccggggataccctcctgcactgcgccgcgcgccacgggcatcgggacgtgctggcctatctggccgaggcctggggcatggacatcgaggccaccaaccgagactacaagcggcctctgcacgaggcggcctccatgggccaccgagactgcgtgcgctacctgctgggccggggggcagcggtcgactgcctgaagaaggccgactggactcctctgatgatggcctgcacaaggaagaacctgggggtgatccaggagctggtggaacatggcgccaatccactcctgaagaacaaagatggctggaacagtttccacattgccagtcgagaaggcgaccctctgatcctccagtacctgctcactgtttgcccaggtgcctggaagacagagagcaaaattagaaggactcctctgcatactgcagcaatgcatggccatttggaggcagtcaaggtgcttcttaagaggtgccaatatgaaccagactacagagacaactgtggcgtcaccgccttgatggacgcaatccagtgtggtcacatcgacgtcgctaggctgctcctcgatgaacatggggcttgcctttcagcagaagacagcctgggtgcccaggctctgcacagggcagctgtcacagggcaggcatcctggctaacgtggtgaaaccccgtctcttactaaaaatacaaaaaaattagccaggcatggtggtgggcgcctgtagtcccagctactcaggaggctgaggcaggagaatgctgtgaaccctggaggcagagcttgcagtgagccgaatatgcgccactgcactccagcctgggcaacagagcaagactccgtctccaaaaaaaaaagaattcctggggcctgcccagtctgtgagctgccatgttgatagtatcacagatgataccaacagtgaagctgtggaatgcccagctagttaaagaatgcaaaggaaaatattttcacaaagggttatctgataaccaaaaaataaaaagacatttcatctaagccactt

SEQ ID NO: 215004 - DNA, 373 bp, Homo sapiens
taaaccctgttcttgggtgggtgtgggtttaatactaagttgaaatgatatcatttacgggggaaggcggtgtggcagaagggaaagaaggccctcattcttatataataaatctatcgtccagtgctgattacctgtcatactgaggttttgatgaggcccagagggttctagcttatgatgtgccttttttcctgattggttaatattaatgtatacaccaagacttcattataacctaggaacacatgctagcaaggtagaattcaaaagcccaccagaattaaacagtttgaacggcagctagttttaattttcaggttcattcccatttctctccattggcaagttgtatttgttttaaccataatct

SEQ ID NO: 215005 - DNA, 430 bp, Homo sapiens
tgatgttcaaacccaaaggcataaaatgccacgatgtgttgtcagtttcccttagtaagtggagattccaaattgtctgtttctgtgtctagcagattcttgtcaacattgattgggattcccatttacagttggcaagggtcatcagtaagtcttccaggagactcttcatactcaattcgtgggaactgacttactgtatctagccaaaactaacttcttaagccaaaagcagtttggttttatgggtttaaaaaactttaggtaggaaacatgaaatacatttctcttactaagttttccttgattagttgttcattctctgtgcacttgttccttttgggatagtagggtaaatgtagcatgatgttgccaagaaaacaaatggacttttaattcagaacaagcatagcacttctcagttaaatgt

SEQ ID NO: 215006 - DNA, 408 bp, Homo sapiens
atcccatccatgtcctaccgagtatggcctgggccaatcccacccacgtccgtccccattcacgtcctttacaaacagcccaccacaccctatatctagatgcccggtcctggcctagtgaggtgactcacacctataatcccagcactttgggaagccaaggcaggaggattctctgagcccaagagttcagaccagcctgggcaacaaagcaagaccccgtctctacataaattaaaatagttgggtgcggtggtgtatgcctgtagctccagctaagcaggaggctgaggcaagaggatagcttgagcccaggagttcaaggctgcagtgggctacgattgcgccactgcggtccagcctcggtgacagagcaagacaccgtcattaaaaaaataaaattaaaaa

SEQ ID NO: 215007 - DNA, 569 bp, Homo sapiens
tcaagaacaaaaatgaccaaagtctccttccttgtggagccacagttaagtaggagagagaaaataaacacatatgtatataaggtacgcagaatatcaaatgataagtccatggagaaaaaaggtcaagagaagctgacgagaacatgcccaggggaggcgagaggaatgcagcgctgaaggaatgtaggagaacattctagaaagaagcggtagcaaggacaaaagtcctgaattgggagcagccagtgaacaaggagggcagggaagatgaggccagttctggtagggccttgctcagaatccagctgccgttctgcgtcaatcagtcatgtccagagtcaaaattatcgtaatttaaaaatgatttttcaaagtacatagagcctaaatctgaaatcaatgactgcaaccgcagatacccagagaacccaaacaggtaagaattagtggagtaggtatgctaatagcagggactccacccggtgccattcaggaatggtctccgtgttgctaggtgttctgatttttcaaaatctgaatttttaagagaaatgtcccgcttttaa

SEQ ID NO: 215008 - DNA, 516 bp, Homo sapiens
gctagtctgagctttctcacataatggtttcagtgttcccagagcagataagccccaaggtgctagtgctgttgaagcctctgcttgctccatgtttcctcccatcctcttggtcaaagcaagtctcatggccaagggtagagaaactgattcaaagggtagagagaccgacaccacttcttgatgggacgtgctgctaagaatttgttgccatttgttgtaatcaagtatagtctgtctctgacaaaaattattcacatttcttttgcaagaaaaatatgctccctcccatcccaggattccccgaagtctcatcagattatagtattagcctcgaagtctagagacttatgcctgatctgcatgagatctagatacagttcagactcctcagagatagctcttcttatgctgatcctcttgatcccaagacaatgaacaggctgtctttcccatacacatccaacatataatgatgagataggaaaaggataacaaaagtagacaccccattta

SEQ ID NO: 215009 - DNA, 834 bp, Homo sapiens
attaattctttaataaaaaaacacacagaaattaaggtagtcaagaaagatagcagagtgattgaactataaagaaaataagatctcttccaggttttaaataatcacaatattagagaatctatatagtcttgccaggtcctatggtacaatgcattatataagtatattgtaacgaattacaaagatacatcagagagaattccaatcttcttagagtacagtctggtaagaaaaaaggcagacatacaaatggatataatgaaagatataaaataggatcgcaggggaggtgaaaatagaagtcatggaaacttcggagtggaaagcttacttctggctgtgggaaattgggaaagcttcaagaagaaagttaagtatgaattagggcttaaaggggatttagaaacgcagttgtaaatatcagagtactccaagcagagagagaaaaaaaaaagagtatgattagaggcagtgaggtaggagagcataaatgcaaagagcaagcagttaaaggatgcgtgaaagtgaatagggcaaaacctgcatgattgacctctccactgggatgtctaatcgtgttttccacccacacaccaactctgttcttttctgtcttccaccagccagttgctaaaactctaaaggtaggagttttcattgatttttctattttcttcatggttttaatccaatttatcagcaaatcctgttgactctacctgtaaagcacatcctgacccacccacttttttccatctttacataaaacacctgaaatacaagtcatcatttcttgcttgagttactgcaatagcttccctccttccactg

SEQ ID NO: 215010 - DNA, 499 bp, Homo sapiens
gctgttggcttctacaaaccacatgtgattccctggttctgtcagtgctggaaaattcagaagaaaaataagagcaaatcgattctgaaaagtagttatttaatcagaatgggggtagtgtgtgctttcccttccaaagcacaactatgagttgcccatcaaagcttataatcatctcctctaggagtgttcctcaacatgaacgagtttcaaatgttggcaggtcatacttgttgaagaccccctgtagtctggagcagtatttcccaactaagaatttaggaaagagtctaattccataattttacttaaatctgtcccagggggcctggtttaggtctgataccatatgctcttgtccatgatgacagtagctgtgccccagctctgtttcagggattctgcaaatttaattatacaacaataatagcttacactgttgagcacttactatattctgggtaccattctaagaatgctattactattatactcatgt

SEQ ID NO: 215011 - DNA, 367 bp, Homo sapiens
gaatatcacactctgcggactgtggtggggtggggggaggggggatggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaaagaaaaagaaaaaaaaaagattgagaagcgggtggggcaagccatgagggggaaagaaagcagatgaacgaacactctttttacagaacaaatccctttcttatcagttcaaccatcaatctttagttttctgaacactgttgctatatgctcaaattgtccaaggtatgatgagggcatga

SEQ ID NO: 215012 - DNA, 1092 bp, Homo sapiens
aacaaaaatataaaaattagccgggcatgacagcgtgcacctgtagtctcagctacttgggaggctgaggtaggaggatggcttgagcccaggaagtggaggttgcagtgagctgagattgtgccactgcacaccagcctgagcaacacagccaggccctgtctcaaagaaaaaagattcactccatgaattatgtcatccagaaccaggtgtgaaactcacctacatttttttctttcattgaaaaggtgcatgaaaccatcagggttattgactttatctcatatggagaaaagagcttgtagctaggttttaattatagctctgcacatcctcttggcctaattaaagtttgctttactccaaggaaggaggaagtgtataaagctttgcagtggtactgtttgtatctcagttcctcagaaaaaagcctgcaaataatgcccctgggtggttcttggagttggcagtggtatggaaaatttcgttaggtagtggttagctgtttgtgatggcctgctttttcattatagtatagtcctgtcctctttcgatctgattctcagaagcccaaggtagacagacacctgcccctattttcagtacttcaccttctccagcctactgggtcctctcaccctgtggtgtctacttaacacgcaacttgaagaatttctgggaaattgaccaaaacagctctttggaaagaagctaggcctcagtcccaaagggaaaggtggctgatgtgactttgacttgaggattgtctcctgtgatgtgctcctagtggggctacaggggtcagtcctttgctttgagcacctctgtagtccactacccatggacacattgctatcctctgagggggatggagggagtagagccctctactgctagcccattttatggaggtttgatgagggtcttaggtgaataagcttcaactcaggtccttggtcttggtttgttaaattattctatcctttctgaagccagggagatttgagaatttccatgaccccattatgaaattgatgatgaagagttttcatcttgtgaacagagttcagatgaatatgatcacaaagtcaa

SEQ ID NO: 215013 - DNA, 1025 bp, Homo sapiens
gtccttcccttttcaaaaactcgaggatagatgaatttagacagtattcccacagttggtggtactgactgataggcatcttcgtaaatatccagttggtatctgatcttcagtactgtaggaggggcctggtggaaggtgactggatcattggggcagatttgcactttgctgttcttgtgatagtgagtgagttctaacgagatctggttgttgaaaagtgtgtagcactttcccttcactctctgtctctctgtcctcccaccatgtgtagatgtgcttgctttcccttagcccttccaccatgattttaagttcactgaggcctccccagtcatgtctcccatacagcatgtagaactgtgagtcaattaaatatcttttgtttatacattctcttgtctcaggtagttctttatatcagtgtgagaacagactaatgcagtattacctctttctttcctcaaatatcaaagttcaaattttgtaggcctctaagaaacattatatagcagtgcagctgtaaaatgagcaggaaaggttgggaaggcaaaccttaggcacacctgtgcagacgtaaacctgctgaaggcttaggtttacttctacacaggtgttttctgtagtatggcaccaaatggacatgtcagttacagaaagctaactctccaaggtcagcttaagtcctgtccgttgactcaagtatcacaccatgaacacatttaacttaaattaggtgtattcaggaatgagtgggtttggatgcagatgtcaatcacttcacagtgaatgatgaatttaatttaacggttttgatgtctcagatgacatctttatcataatttgtctctttttgtttttttgacagcctgctaccacagcgttgataaccttcctggttatctccttatgttaggcagtgaacttcctgacagtaagcagcgtaactgcaatgtattctttttaaagaattgcaactacgtggtaaaataggatatacctctagatattattctgtcataagt

SEQ ID NO: 215014 - DNA, 401 bp, Homo sapiens
caataaataactgagttaaatagataaggaaaggcatgttcacctggtctactgatattttttaaattccagttgagtagagagcaatgttaataagactaaggttttgggccagtcccatttttgcctacttgctttgcacctggaaaaatatttgtaactgcatgcaaactctttcccctcctcgtcttcaacaatctgtaaactttccctgagcagctaccaagtgtaacacaaagtgggaatgaaggaccattaagaaatcatctctgtgccatgcgcggtggctcaagcctataatcccagcactttgggaggccgaggcgggtggatcacctgagctcgggagttcaaggccagcctggccaatatggtgaaaccctgtctctactaaaaataca

SEQ ID NO: 215015 - DNA, 372 bp, Homo sapiens
aatcactgggcatggcagagccttgatttgtaatgtttgctaatttacgtggtacaagtgctccagtacggccagtttcacactactaatgtgaagccactgatgagttgagaagtgatacacacagctcttgcaagctggtacgaacagaatccagcacaccactgtaactaaggtgtctctcagcagttaggactgacggtcaagaatgttggaatttgtagcttatcttccctactaagaaacaaatctattggtttcaacactgtatacctaggacctaaatgttatttaatgaataaatgatactcctttcccccatgaagtgttttatcataatatatagagatgcaggaaacccttattattaga

SEQ ID NO: 215016 - DNA, 432 bp, Homo sapiens
ttattttactgatagatcaccagtgcccacaataatgccaggcacataacaggcaaatatttgttttattcattcatccaacaaatatttattgagcatatataatatgctaggcattgctctatatgctggggatataacaaaacatgacaaaatttgctgtcactgttaagtttactatgagcaaatacattaaatatgcttagcctagagaagaaaaggtgagaagaggaagacaaactagcagctttcaatgatgtatagggcaattaaatgcaggggtgattccaagagcctgaaggaggaacagtgagctaagattaccgagtagctgctttcagctcaacctaagagtcagaactgggggaggaccaaacaggagcaaccagaagtagaaagctttctgtcactgaagaaatctggccagtgggc

SEQ ID NO: 215017 - DNA, 515 bp, Homo sapiens
tgtctccaggactctggggggctgtattgctggcagtggaggctggaagggtgggaaggggaggaggacagctgaggctcattcttccctttcacttggggagggggtgctcagatagggcaggatgtggtggggctgtgggctgcagaggcagtgaggctaggggagggagaattataaaacaggaacaaggttcaaggggagaagggaaggcaggactggatgatgcagagtgcacttcatagaggccgggagtactgccctccaggaaggctgagaccccctcatgtccagggaccccgggtctaaggccttgggccgtaaccatggctgggccaaaggcagcagcctccttcagggctcccaggctgcagccatgcccaggaaagggaagaggggttgccactgacttttcgtctcaggctagcaatggccaaagaaaaggctcctggacatcattttgtcctcaccatgttcccaagcaggacagtgatgaatccagaacttgggtgtga

SEQ ID NO: 215018 - DNA, 425 bp, Homo sapiens
tgtctccaggactctggggggctgtattgctggcagtggaggctggaagggtgggaaggggaggaggacagctgaggctcattcttccctttcacttggggagggggtgctcagatagggcaggatgtggtggggctgtgggctgcagaggcagtgaggctaggggagggagaattataaaacaggaacaaggttcaaggggagaagggaaggcaggactggatgatgcagagtgcacttcatagaggccgggagtactgccctccaggaaggctgagacccccccatgcccaggaaagggaagaggggttgccactgacttttcgtctcaggctagcaatggccaaagaaaaggctcctggacatcattttgtcctcaccatgttcccaagcaggacagtgatgaatccagaacttgggtgtga

SEQ ID NO: 215019 - DNA, 438 bp, Homo sapiens
actctgcttctgatggttgtctggctgttgactagggcagtgggggaaactggattccgtatcttgcatcctccagcaggctagcttaggcttgtttacatggctatgatagcagatcccagaaggtaagcagaaacacacactgtctcttggtctcagcttctctggcataaagtcatttctgccacattctgttggtcagagtaagtcacatgactcagcccagcttcatagggtagggaaatagactgtacttcctgatgagaatctttggaaagtgacactgaaaaggagcatgggccaggcacagtggcttacccctgtaatcccagcactttgggaggccaaagcaggaggatcacttgaggccaagagttcaagatcagcctgggcaacataatgagactccgtctctccaacaaaaacaaacaaacaaac

SEQ ID NO: 215020 - DNA, 883 bp, Homo sapiens
  misc_feature (877)..(877): n is a, c, g, or t
ggtcccccctcccccgccaaaatctgtagaccataagtcttggcctacactgacctggtttgtaaaatatcttcctctgtgtacttttcccttcagcctcaggctcttggctgattcgctcacaacagaagcagcttggctttcctctggaagtaccaatttgaaagcccaccagcctgcaaacctagagtgtattctccacccctgggtcacagaacttcgttctccccggctctgtaacccaaggaccctacagcctctgaggcctaacacccaagctcttccttgcagaagagctgagatgctaaggagaccatctggagtgtcataataagcccttgggatttgctgagctcccacatggctttcttcaaccacctggcccactttcttcaaccacattccactttggaatgcgtgtctttaaggcaccaagtgatcttaagaatgggctctgtttttgaattcagcaatccaagttcctatctatctcggtgggacctccaaaaaaaagaaaaaggattggcttggcttctaatgtaaggcctgccttttacacaccagttgtgtgtttgttagtggctgctggatgccagtccacaccctcaaacacctcacagtcccaaacggggtgctcctacaggtcccagggtcctgttagtggaagaaaggcagttccaggaagtcttcctctagccttcatgacaggaagtagttaatcctctgggaaatagacttgcagccctgggaagaaaagagttgttcctccttggggacatacaccatcatctgggctatttcatccagtgtctcttctttatacaggagctcctggctcaggaaggcatcccgtgcacacagcctcacgtgacggtantccaaa

SEQ ID NO: 215021 - DNA, 383 bp, Homo sapiens
tcccagctggtctcataccacaagataggagatgtttcaggacacccagcctcccctacacctcagacatgcgtgaggacacaaggcctgggatgccaaccccagcctgtctaaattctcccgggctcccgtgcacagctgacatttccaagggaacgtccgcggctgggctgaccctcacagcctctaagtagccagaataacctcagcggccccagcactgatgagtacgttttgtggcatttaaggcaggtttaaagttaaagataaaaaaagcccatgacgcttctttggtcaaccggcaagggcgcaatagtaacggtacgagctcactgaattctctttcatttaaggtgtctctttccccataaatctcccataaa

SEQ ID NO: 215022 - DNA, 138 bp, Homo sapiens
atcctaaatttattatttaaattgaagcgacaattaaatgccttcccctaaatttaatttcagaccaatattgctttagcaataaattcttccaaatgtttatggaagaaataatgccagtgttacacaaactcttat

SEQ ID NO: 215023 - DNA, 876 bp, Homo sapiens
ccttcagtctggcatacagggtagacccactggtacctggtacctcactctgggggtgaggtggccacccacctaggtctgggtcctgtagcagtttggcagcaacatctgggtgataagagaaggcgatttgacctactcccagggacaagaagctttgactcttcaagatcataaagtcttccctcctggccttgggtcctcctgttgcgggagaggtgaggtggggtgagggtcctccgggagggcaggcttggcagagcccagcaccatctcagcagacactgctcttctcctactctcagcacctccaaggcagtgagtggctttctcttgtctagaggacaaaatccgttcctcacctggacacaatgaacctgtctgtgggatttagggagcatcaaggagggaatttagtttccgcagacttcaaggaagactttctggaggaggtgatgcctgagagctatccaggagagaagagtgaaaaaatgttaagcagtggaaaaacatgaaccaaactgtggctgcatcttcccatagggcaacagggacttagcgcgtgcaatcaaggatctccagatggggataacccaggtgtgcccaacctaatctcagtgtccttggaagagggatgcagaaggagtcagaatcagagaagaaggtgacacgatgaaggaatccgaaattagagtgatgctctttgaagatggaggaagggaccacaagctgagaaatagaggtggccactagacactgaaaaaggcaaggaagtggattctcccctggagcctccagaaggaaccagctctgccgacaccttgacattagcccattgagactgatttaagggctgctggcctccagaattgtaag

SEQ ID NO: 215024 - DNA, 622 bp, Homo sapiens
tctattagtctcagatcttctttgctttgcttttttcctttttctgcttccttcagactagtttagtaatttttatgatttagttacatatctgtatatgcataacttttttagttattaatctagttttacatttctttacaatttagtcatatcttttttggtataagtttatttggtattaggtataactctttgctgtcttagtagttgctttaggatttataatgtatgaatttacctcatcacaatccaccttcaagtaatattatatcatatcatagatggtataagaaattacaatcatattttcacttcttttctatcaaccagatcccagcctagatctgtgggattatggctttcgttaagtttagaacatatttagccaatttttcctcaaatttttgattctgcctctcctcctatctctttggggacttatatactacctgctggaagtttgctcatcgttcactagtgtctcaaatttgtgaatcttttctttcatgatggcgaattaatctatgctcatatctactcagtgtagctttcatctccagcattgtaatttgtatctctaaaagtgcaatttggtttttaaaagtatcttctattgctt

SEQ ID NO: 215025 - DNA, 1138 bp, Homo sapiens
tgaggagtctcgctctttcgcccaggccggagtgcagtggcgctatctcggctcactgcaacctccgcctcccgggttcacgcgattctcctgcctcagcctcctgagtagctgggattacaggcgcccgccaccgcgcccggctaattttttgtatttttagtagagacgcggtttcaccgtgttagccaggatggtctcgatctcctgacctcgtgatccgcctgcctcggcctcccaaagtgctgggattacaggtgtgagccaccgcgcccggccagtaacagcattttttaattcagacaccaggaaaaaaaaaaagtaaaagaggactttaaaggagagttaaaatgaggagaactgagataggtgcaatggtcattttctaccaaggaattttccttcacagttatctttagcagtagttttcaacccttttttcactatgacacatgtgagggtcattcacatacaaagcattctcatgtatatactcatttagcaacaaagtgaaaaaaattaaatggattagtaaagctccacaataattgacaatcactaccacactggtgtacgtactaatatttctatttcagtgactgacttctgtgaatttgttcacctcaagagagtagggcatgaaattcaggttattaaaaaaaaaaatctattcagcacagatactgaccaaaaggaaagaggctggtggaaaaaccaatacagccaacctcttgttaactggtggaataccagccctggacacaagacttccacagctacaggttacccaactcccagcaagctagttgtcatcagttctctcttcctcccaaacaaagtacatgaagatacaagagcatgaagcatacacagagacaaattctcccatttgaatatgctctatttcattaaaaaaggagattcaggaatttaattactttataatattacagtattcataacagtgttcttatgacactgtgacataacatcaacactgaggcagctaaactttccaaaaatcctttctgtgatattcatagctctgtgtaatatagcctgacctatttagccaaaatatatcttagttatttcttccactataacaagcaaacctattttaccattcctaaaaaaa

SEQ ID NO: 215026 - DNA, 384 bp, Homo sapiens
atcttagccagggccaaattatgctccagggtctcctgggcctgaaactggtagtagcccaggcgggcctgctcccgagtgagtgttgcctccacttgctgcagcagcaggtccgtgggcagtccccggcaatgcgccagcccatagtgcagaacagcccagagccaggctgccaggctggctgcaggtcggctcactgcccgcagggctgcatcgtccatacctggagccttcagaattagatgtaactttatcagctctgagtctgttatcttctccttggggaagaacaccagctcctggaaggatgtatgttaacgggatggggaagccacggatgctctggaccttgacccaacagtttagccttgccaagtgtccctt

SEQ ID NO: 215027 - DNA, 402 bp, Homo sapiens
tagtaggtggtgtgtgcctgtagtccagctactccggaggctaaggcaggaggatggcttgagctggggagatggaggttgcagtgagccgagatcataccactgcactccagcctgggtgacagagccagaccctgcctaaaaaaaagaaaaagaagaaattttggtggagattttggagcagaagccagactcaggatagggagaagtggatacaatgcagataagaaggaaagaaggaaatagaattgacagacttggtgattgactggtaggggtgaaagagggcaaaatcaagggtaatccccaggtttcagctttggcagctgagtgagtggtgtcagctgatgaagcagatgtgtgtttggagggggatgtgcgcagatcagtagtctatgatga

SEQ ID NO: 215028 - DNA, 416 bp, Homo sapiens
gtgtgtgtgcatctgtgtgtgtcttagtccttttcagcacacatgctgaagtaggttccaatgaaatgaaatgaggaagtgcttaacagggaagctgtcgcctcagcagggagagcagctctctccctcctccgcacagaggatgccggctccggggtagagagtcctcgtgaaatccaatgggcttctctgctggagtgagttcaccagtctccccactgagaagtgtgtttaaattattcagtgagcttctttgatcctatctgttgaactatgttttgttttgttttgctctttgcagagggaagtgtttgtagatgctgggccaccttccaaagcaataaaaggcccatcctagagcatctgatgtgcccagcatggtctagattctaatggcctggtttattgccacaaac

SEQ ID NO: 215029 - DNA, 643 bp, Homo sapiens
taatttaactttcaagacttgacttggaagttactttgaaacagtctaggaaaatgaaaaactaaaccactcagcacctatggacatactaaagatggtgactatggtgatgccaaacttcacagaaacaaattctaaaatgaggacagtctgtacttcctgctgattatataaaatcactgccaagaaaaacacactacccgtactttcaatctttcaatgttacaacctgttactattcaaatgctttagtcactgctcaattcttgccttatctagtaatgtaaatctacgtaggctctgtctgctttaaaacagctaacacatgtaagtctgaagaaaccaatgggtacgaaagcacaagtgagcaaaattaaagagcagaattgtactgagtggctttatatgttcatctagtaccagaggctccacttttttttcctttgccaacaggccaccaagctacccctgaaaactaccatatgcctcaaatagtagttataaatgcttataagtacactagactgtaagaactccactaaattgttataggctggtatcttttgagatgacaccaaaattaaaatttggagcattaaaaataaaactaaattttactttacaaacaagagcaaagagattt

SEQ ID NO: 215030 - DNA, 824 bp, Homo sapiens
acaggcatgcgccaccacacccagctaatttttgtattttttagtagcgatggggttttactgtgttgcccaggctgttcttgaactcctgacctcatgatccacccacttcggcctcccaaagtgctgggtgggcgtgagccaccgcacccggcccccaattttttttttccaaaaaagtaaccagaaaagtcatctcaagacagtgttagagaaagcgttgtgtttcctcctctgagtcttttgtgggggctttatgggaaagggaggatgactcacttactctgaaatctgggcttccaggaagggcctctcccatccttggagcctcctcattctcctgtctctcactgtccccccacctctaccatgatgtcctcattctggaaaccccgagcagggatagtggcttgggcccttcgtctggcttttctccccacacttgctcccttctaacattttctccctcatctgacatggaaggggcaatggttaacccaggagggagggcagagaacaagggccccacatcctggctctgcctctgacaagctgtgtgaccttgggtatcagctgactcatcggagaagtgaggaggacggacttgggccgtgtctggatattaaactttgttgggtccctgacctctttgagaaactgatgcatgcttctcaagaggccgcaagtgcattttacacactatttcaggcaccccacagatcccccagattcaggctccacaggcttcatgttgaaaactccttaagtgacagtggtcaaggtacccaccaacacttatttaaccttgacagtttgcaaagttc

SEQ ID NO: 215031 - DNA, 775 bp, Homo sapiens
ccttgcacagccagcatcaggctggcctgccttcctgttcccgtcactgggtgacattgatcccagacacattctgatgactagtaaagttgcttttagtagccccagagccaggaggaataattcatatggaatttttaaagacgcccactcttggcgttaattacagcccaacgtacatttcttggggagattttcctgtgacaagtgaataccctctacattttcttaactggatgggaaaaggattttatgcccatacatcttgctaataaaccaaatcccttcttcagattcttgagtgaaacatttaaaatgtagtttctttagaaataaaagtatgaggcattttaaattatatgacagacaaaaaagtcaatgctcttgagctctttacagtaaataggttgtgtttactcataggatacagaatcatggatatcaaacatcaaaaataaattataaaaataatgtctcattttctgttgcatattattagcctgtctctcattccaccatttgttcttttgaactggaaaattgtgggctcctagtcactgcactaatctatctgaatatccaactaccagaaagggtttatcccatctcaagtttgtcagttgctttatatcgttaagggtgtttttgccaccctggttgtgttcataattaccattgagaaatgtcactgttattaaaatacattctgtgttccaactaactgcctctctgccctagcagtttctctcttacctccctcaaatcattgactagg

SEQ ID NO: 215032 - DNA, 452 bp, Homo sapiens
tcagataatcaggcagtagattctcataaggagtgtgcaacctagatccctcgcatacacagttcacaataaggttcacgctcctatgagaatctagtcaccgctgatctgacaggaggccgagctcaggcggtcatgctcgctcacctgctgctcaccttctgctgtgcagcccggttcccaacagaccatggactggtctgtggcctgggggttggggacctctggtataaagattagaggcagatatacctattaattaatgattatataattatgagaattaaactggtaatatctattatgtatttgggatttgctaattaatggtgataatagagattgtttctgccctgggggtagttcaaggataacacttaactaacagactaactaaactaacagaataatatgagaaaattaataaacatatgattcaaaaattggagaaa

SEQ ID NO: 215033 - DNA, 288 bp, Homo sapiens
tcaatctccagccttgacttcctctgtgagttccaaacttctgtatcctgatacctctatgtggatgtctggaaggcagtttgcaccatgtccaaaacagaagtcttgattttttttcctcccacgctgattttttctctacctgctcaatcatccacccagtttcttagaccccaaaccaaaaagtcatcctttgttcctcttccccatcatccatccgccagcccacgacagcgtctctcctcctctgccctgaccctactctcagcccccttctgtcgtcttctc

SEQ ID NO: 215034 - DNA, 171 bp, Homo sapiens
agtcacaatgagaaaagcctttatgcttttatttttcacacgttaattactgagaactttagtgagggaatattagtctagtctttttatttttaacaggaagacactgaaaggtaaagtaacttcaaagtcacagaactattttattgaatggccttttcgctattatta

SEQ ID NO: 215035 - DNA, 238 bp, Homo sapiens
caggttaaagtgaattatcctacagagagctgctgggaaaaaaggctgtttcagatctgctgagctgaaacccaaacccaaggagcccttcatcttacaaaaatccaggaattctggatgtggcctgcatgaagcatttggtgaaatgtatctattattttattttattttgagacagagtcttgctctgttgcccaggctggagtgcagtggcgccatcttggtgggttcaagcgat

SEQ ID NO: 215036 - DNA, 256 bp, Homo sapiens
aattagagtcctaagttagtggaccttaagttacagagtagtccccagctgacagccagcaaggaaacaaagaccttagttctacaactccaaggaactggattctgccagcaacctaaataaacctggaagcagcttcttccctagagtctccagataagagcaaagctaccaacaccttgattttaatcttgtaatgcacagctgagcttgcgtcgacgcggccgcgaatttagtagtagtagtaggcggccgc

SEQ ID NO: 215037 - DNA, 732 bp, Homo sapiens
tgtgtgtggccactgaagtgtctgcttggctagcttagccaaagactagacagaggtttcattaagtgattgcacccaatgagtctaccagtctttgctggaggggtatatacataaatttttctggaactattttagagtcacttgctggcatacaggacaacataggctcccaaccactgtggagcaccaaagacaaaccagagcagctgcacatcctcagcagctcccaaattccaaaatcttgggggatggaaccatctctcctggagtctcacctctgcacagtgaggccctggtggctactgtcctgacttctggtgattattttgcactggagtctctctttgttttagtcagtagaatctctaatgcccactttcactttctggtttaaatacaggctaaaggttccccactgctcccccagccccaaactctgtttcatcccagcacctaccttgggcccaccttcaatcctcattcctgctcctattactttctttttcaccccagattaaggcttctggggtatcctttcctaggacgcagaatgaggtatagtctgtcaccccaattgaagctcaacatttgttgagaatttctagtttttactctgtaattcagagatcttaggaagaattttgtcttccatctcccaaccttgttcagtacagcctggcctcccaggactatgtgccattttctattcttcctagagaatttcctata

SEQ ID NO: 215038 - DNA, 578 bp, Homo sapiens
tgagggtgacttataattttagttcttaatctagagaacacctcttatataccatgcatgttagtataatacttataaaaacctcaatggaaccatagatgcaaattaagtgaaagaagccaatctcaatgttgacatactgtatatgatgtgacattccaaaaaaaaaaaacaaaactatagcgataataaaaagatcagtgattcccaggggttgagggaggagatgaacaggtgcagtagagaggatttttaggacagtaatactattctgtataaaatgataatggtggatacacgtcattatccatttgtccaaactcaaaaactgcccaacaccaagtgtgaaccctaacataaatgatggtctttgctgataatgctgtttcaatgtaggttcatcaactgtaacaaacacagctctctggtgtgggatgctgatagttagggaggctgtgacaggtcaatggggaggggtgtggagagaaggtatttgggaattctctgtatactccactcaattttgctaactctactaaacctgtaactgctgtaaaaaaaaaaatagtctattaaaa

SEQ ID NO: 215039 - DNA, 340 bp, Homo sapiens
tgcattatggccagttgaaagttactgtaattttaaaggaggagggtgaaagggacctctccaaactcccaatccctccagtctcccctgttttactgaattcaaattgtgccacaaagactttagaaatagttaagaaaaatgagattgcttttaataggcattactttttcttctgttgctttattttttaaaatcatcatcacagacttaagtacgcctttaaaacattttaaacagggatacacatacatagtaaaatttttttttgaatatcaaaaaagagtgtattcctttttactgaaacccctagttcctcagtcccttctgtcgtcttctc

SEQ ID NO: 215040 - DNA, 672 bp, Homo sapiens
tcatttttggatcatgaaaaatgtgtttgtatcttttataagaaaaagccattgaacttattgatgttaaaaatgcaactatacttggtaaaataaaatcaagctgtgaactgatgcttactgcatattctgttagataagaggtgttagaaacatatttgatttttccatgagtcctgcacacaagtacacgcacagccccttattacagcactatatattcaaaagagtatgcaattgaaaacaatgtggttttttttcttgttgttccttagtagaatatcagagagcctaaactatgaacattggtgttactgtcctgatttctaccaccgtctgcatctttggcctgttttcattggaagtatcatagattgtcatttggacagaccattcctagcgaatactggcctttcgcggagcttggaaaaccctgtgggaaaatcagaaagctggtaagataagaggaagaagagatgtcacggtgtcagattatgtttgtattctgttctgtccaaagttctttacatcagtaaatgaaaaacaaaacaaatgatgcataggccacgccctgcagtgaaagatgcaagaacttgttcatattggtatgaatcgttcactgtatatgattcaaacatgtggaaataaatgtttgattacagtcattccaaa

SEQ ID NO: 215041 - DNA, 432 bp, Homo sapiens
tctgcggccgggccttcaccactaagggcaacctcaagaatatcagagagcctaaactatgaacattggtgttactgtcctgatttctaccaccgtctgcatctttggcctgttttcattggaagtatcatagattgtcatttggacagaccattcctagcgaatactggcctttcgcggagcttggaaaaccctgtgggaaaatcagaaagctggtaagataagaggaagaagagatgtcacggtgtcagattatgtttgtattctgttctgtccaaagttctttacatcagtaaatgaaaaacaaaacaaatgatgcataggccacgccctgcagtgaaagatgcaagaacttgttcatattggtatgaatcgttcactgtatatgattcaaacatgtggaaataaatgtttgattacagtcattccaaa

SEQ ID NO: 215042 - DNA, 610 bp, Homo sapiens
ccgggtcacctcttagcggccatgtctctgaatccggctaggcagaaaagtactaactcgcaagatatccaggaactcttgttgtcttgtgcagaagggggaaattgaggcatggtgtggttaaaaagccaagatcacgggccaattcctgcacactttgttgagcgtaagaatcacttggtttaagttttaaaatgaagattcctgggtccccaactaccagagattttgatctgacctatatccctttaatctctatttaaacaaatttctctggcgattctgatgctaaagatgcagaccattcttgagaaacatatgttacactactctgaaaaataaacataggacagacttctttgttctgtccgttttatgaacctaggaagctcataaatgggaacgaaagctctggtatccacttagcaagccagaaccaccactcacacttggtctcctgctgacacaaagctacattcctagctccaggtggcatgtcatgggtgttttacttcagccccagattttcagtctttttttaatggcaagggtaatgcagaccgtcttgtgccaaataaagaacggacgttgttgagttttgcttggaaaa

SEQ ID NO: 215043 - DNA, 664 bp, Homo sapiens
cctaagaaaggtgcttgcccttgctgggtatcagcattctcacttgttacggtgaggattataacaatatcaaactcacagggcagttgccaggtttagatgaaataatgattcatgacaaaaagtgcttggtggtaaggattcaataaatgatcacgaaatccctttgggattagctaattaatctcctcatcttgaccacaatcatatgtactataagccatcactgtcggactaaactgcgacaaacactcctgttacagagcaccaggaatctacgtttactcacaccaaactaaaacatacgggttcagcttttaaggctctctaaaagttttccccacgctacctatacaattattaataccaaccccaaaacaatctgtttttgtcctgctattcttcattcctcaaacaaaacagccccaaatttttgtgtccacctctgcagcaagctcagtttaaaagtcccgttttccaggcacttctcacctctactttcactcctttttttttctttttttctttaagacagagtctcaggccgggcatggtggctcacgcctgtaatcccagcacttgggaggctgaggtaggtatgtcacctgaggtcaggagtttgagaccagcctgggcaacatagtgaaaccttgtctctacaaaa

SEQ ID NO: 215044 - DNA, 297 bp, Homo sapiens
agtagagacggggtttcaccatgttagccaggatggtctcgatctcctgacctcatgatctgcccaccttggcctcccaaagtgctgggattacaggcatgagccaccgcgcctggcccaaaattagcattttcaaaggtgttaattgctttcttgaaaatagatgtgtatataaaaatatgtgattttcaggatgctgaggcaggagaatcgcttgaacccgggaggtggaggttgcagtgacctgagattgcgccactgtgctccagcctggtggcagagcaaggctccgtctca

SEQ ID NO: 215045 - DNA, 572 bp, Homo sapiens
acttacccctgagccctatcaacctaggtctacagccagtggagtctattgtacactgtggaaaaatacccatgggaccagatcctgccaaattcttccagctcactttattctcagcattcctaggacattggacattggttttctggagggttttttttccatctttgtatttttttaaatttgattcttttctttgcaatgctatctaaccagaatacataggggaactgtgggctaggcaaacaaaatagaaaaaagtgtgaaaaacagtaaagttgggagaggagcatctattttcttaaagaaataaaacacccaaaacaatataaagttgtccagaatgtatgtcaagaattttagataggcctttcagtaacacaggtgacgaaatttttaaaaatacattgattattatctaggttagacttaaagtgaatctcaaataaaagaatcaggaatacaacttaagtaatcatgaggtccttccatatttagattgggtaagcatgaatgtgtattttctacaaaagaccttgagaagagttcaataaaaaatgttagcattataa

SEQ ID NO: 215046 - DNA, 283 bp, Homo sapiens
aagtaacgtatacaatcgagcctttaccgtgttctgtgccctcacacctaaacaagacaccataatatcatcctatttaattctttccagtttttttgtgtgaatttatcccaaaagcaatcgatagtttttctggtgtatgccctccaaaatctcctggccattatcactgaataaaacttctagatttggaaaacaggcaccataaggttaaaccctaatggtacactttgtattatttctttcttgtgggggccatgtatcaattcattgatttgattca

SEQ ID NO: 215047 - DNA, 239 bp, Homo sapiens
gcttcacacccaatactgccggatggggcaaaaagtgaaattgtgttttgaatttgatgaagatttcagaggtaaattataaaaatcttaaatttggccagtctgctccatgtttcaatccaatatgcagggcaagagagatgaatcttggtgttcatttcctttatgtttatttcatgcaaattttatgtgtatgtgtattgtgtgggcagtattgggtgtgaagcgtggtgcgtatg

SEQ ID NO: 215048 - DNA, 378 bp, Homo sapiens
tcatctacaagttgtgtgaccttaagatcaaaattataaagaaagaaagggatgaagaatggaccaggataaaggaggattaattaagaggacaaaataggataagtagaaaggggagaggtatcaacaataagtaaatctctgctttgtgttctataaatgtgttatcccttacacttgtattacttgatgtgtctagactggaactgattgatcagtggcttgattcctcagaaaataacacacttatcctccttgcttccctgctttcttcattccatcctctctaccccagttacattgtgtaatataattttcatagagctcagaccctctataatatagctaaatttataacacagttgaaatagttaaaag

SEQ ID NO: 215049 - DNA, 603 bp, Homo sapiens
aacatgcgtaaagtagtctcacccccttttttggtacagcacattcccccatttttgcataaaaacttccctagtcatagtgttggcttttaagttttggagaagttctgtaggactgaagctgcatgccacaggagatgcctggggtggggagttaaaacaatacaaactgtagcaacatgcaaaaatgctcatggcttgatgtaaagtgaaaacaagatgaaagcctttcctctaatatttctacaagtatgtgaacagagactttccacctaaccaagttgccactgggacgaatgaaggccagattgtattgaaacaggactatgagtcactcctgggaaggccctaggacagaggtcagagagtttccatatttcagtctgggacctgggcctgtcctggtcttctcaggttcctagctatagagacctctaggtgcctgctctcaccacagcccagtgctggccaaggttagtggtgtagggcacctgctctttttccaaagagatggaggagttagactcatcaaacagctcctcattaatctgaatgcggctctgtaaacagtgcccagcagccaagctaaaaaagattgattgc

SEQ ID NO: 215050 - DNA, 436 bp, Homo sapiens
cggtttcattttcatgtgtttgaaatttctttacttatcctgcttggtattcagtttgcttcctgaatctgaagattcctgtctttaatcaattctggaaatttttcagccattatctcatcattatctgcctcttttggtttttctcttttctctcctggaattctcattaggagtatggtagagaccttaacaatctatccccatgtctcttaagcttgctttcatttttcctgtctctaggctgttctcagtaatttcttttggtctgtcttccagtttactaattttctcttcaattgtgtgtaatctgctatttaaccaaacattggctttggtttcagttattctttgtttctagaaattctacttaattcttttgttgttgttgtttttgttttgagacggagttttgctcttgttgcccaggctggag

SEQ ID NO: 215051 - DNA, 203 bp, Homo sapiens
tctttctcttgtgcttattcttcctgggagtggtgtaagacttcttcttccttttcttagcaccaccacgaagtctcaacacaagatgaagagtagactccttttgaatattgtagtcagacaaagtacgtccatcttccaactgcttgccagcaaagatcagtctctgctgatcaggaggaattccttccttatcctggatc

SEQ ID NO: 215052 - DNA, 477 bp, Homo sapiens
gaacaataaacactggggactgctgggtggaggagggctggaaaactacctattgggtactatgcttactacctgggtggtgggatcattcgtaccctaaacctcagcatcatgcaatacatccatgtaacaaacctgcacatgcaccccctaaatctaaaataaatgttgaaattatttaaataacacaaacgctggttctaacaggtccccttccatcaaacattaaaatattcttgatatttgcttagattatgacaaagaaaaatattttatctgggaaatttactaactttattagttcactcattttacccagttgagaaaaatgtgtaggttttaaaatcatgtagatccaggttggagtcttggttctgttcctcattggcccagagatgcgaggctactgacttatcctctgtgtttgttttacctataatttaaggatgacagtaactatctcagggcattattagg

SEQ ID NO: 215053 - DNA, 532 bp, Homo sapiens
aaggtaaacaaaaatgctttattatttaatattacgcaaaacttttgtttaaaggagaaaatcaaattttatttttgttgaagttaatttttaataaaattttacgtaaaatctatggaattttaatcagtttgactctaaggtaagatttttataaagtttgcataacatttatagttcttttaaagaatagattaatattctaagaaaaccctgctattctgatacatgaacccaaattaaggccttgtatcagagtgtttttaatgaatgtttaatttctttaaaaacaaaataattccttaaattttaaccaatgcttttttttgtaaaatttttatagaactaatttttacaaatcttttacaacttatttaaaccttgagtcttgtcttgttattttttatttttgaatttaacataactttttagaactgcaaaactagacaaaattactgttttttataaaaactatatgttcatgtctttttataactttttattaaaaatacattctactttttcatatact

SEQ ID NO: 215054 - DNA, 401 bp, Homo sapiens
tactaaataaatattagttttactatttttaaatttttatttacatttataactgtcactaagagagtttttcatgttttggcaaaaaattttaaaggccgtggaacaattataattttccccattgtgattattaaaatggcttcgcatggtttcagcttgcacagtcatttttatgttcctgtagtgctgtgcaaagcaaggacagcctctctatataattgcatttatataaagagctactaaaaattgagaaaaagcccaacagtacaatacaaaaacaagcaatgtttatgaactatcagtgctcataatggaatatgcacttagtggatattatgcagctaaataaacagaagctctctatgtagtgatgtaagatattataagtatttggagtg

SEQ ID NO: 215055 - DNA, 431 bp, Homo sapiens
tcatatgctattcttcatttattcttccataatgaacattttcataatttaaaaaatcctcccattatccacagacccgattttcaggaggtgccaccatctggttcacaggcatatgcccaaaagtaagcgaggagctctgagcagccagcgtggcagtcaccaagccctccaggctgcagctcccaaggtgggtgtttattgattgagctcaacgtctgctcccccttcccatctgctctgacttccgtttggagatccacgtggtttaggagaagctggctcccctccaatctgaatattctatcccctgaccacagagagtcagggacacacatgtgatctaaggcagtccagtccccccacagggggcaggagttgcccacaaccagctcaagaatgaaggggaaccaaccctaagcaaagccaat

SEQ ID NO: 215056 - DNA, 474 bp, Homo sapiens
  misc_feature (474)..(474): n is a, c, g, or t
agtcacacactggacagtctaagtgtcacactcatcaaaaccactgcctcctaggatgcatcacatgtggcatcaattacacagtgacattaaaagcaattagtgccaccgggttgactgcagattgctcctaccaaagttatttctctggtgcctgctgccctttgggggtgaaattatataggctgggccctaatggcatccggatctactggcaagcctccaggggctctgccaattacagcactgacctctatggctccaaaggcattttcacgtgcaccccgagtgctggcctcagtttctgtgatgtcactgagataccctgtggggatgtatacactgtgatggtctcaccagttgctaaaacaggattgaagcttactttctgtccaaaaaaaatatattcagtaacttgctctggaagtacactcggaatgtcggaatgggtgcagggtaccgagctcgaattcn

SEQ ID NO: 215057 - DNA, 510 bp, Homo sapiens
gggtaacactgtttctgtcctttttaaccaaaaacaatctgtgattataataacctactaaagccctagcaattccaacaggaataactcttttgcctctgaaatcttcaagagcctgacagtcatctctgaagcaacatttcctaaactgacggatccttttgtgaaggaatgtaaatgttaagtaagcactactgaaaactaaaaccacatttccaaatacccctagttgaaatctacttcatttcaaacttaaaacatccacaggaataggaattctgagtctggtttgtaatgcaactacatctgaagacatgccaccaacatttcagaagcctgggaactggttaaaaaaatgttggtctgttctgaacagcatcatcatggaagtatggatattaggtacggctactccactgatttaagcaattttcttttcttttcttttccttttttttttgagacagagtttcacactgtcacccgagctggagtgcaatggcgggatcc

SEQ ID NO: 215058 - DNA, 419 bp, Homo sapiens
ttagaggatcccctcgaatcgacggttcctccatatccttgccaacatttggcacagccagtcttttcaatcttttagttattctaaggtttgtagtgcttactgtggctttaatttgcatttccctagtgactaatggtgtgaagcatttttcatgagtttgccatttgtacacctcctatggtgaagtaactgtacaaatcttttggccatttttatgtttaaagttgattaaataattttgtaaactgacaaagaaaaatggtatatatttaggttgtacaacatgtttttttttgttttgagatggagtctcactctgtcgcccaggctggagtgcaatggcgcaatctcagctcaccgcaacctctacctcctggattcaagtgattctcctgcgtcagcctcccaagtagctg

SEQ ID NO: 215059 - DNA, 670 bp, Homo sapiens
cttccgctggagcctctcgggaggcgggtaacgttatagtatttgtcagaagttggggtctccgtgggcattgtgatccgtcccaggcagtggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaaaaaaaaaaaaaaaaaaacaaaaaaaaaaaaaaaaaaagaaaaaagtagaaaaaaaaaaaaaaaaaaaaaaaaagggggggggcgccaaaaaatccaccgaggggaggaccccacgattgacggcgagcacacacacggagtttgttggctgcacagggagggggcccccatggggg

SEQ ID NO: 215060 - DNA, 714 bp, Homo sapiens
cttccgctggagcctctcgggaggcgggtaacgttatagtatttgtcagaagttggggtctccgtgggcattgtgatccgtcccaggcagtggattaggaggccagaaggagatcccttccacggtgctaggctgagatggatcctctcagggcccaacagctggctgcggagctggaggtggagatgatggccgatatgtacaacagaatgaccagtgcctgccaccggaagtgtgtgcctcctcactacaaggaagcagagctctccaagggcgagtctgtgtgcctggaccgatgtgtctctaagtacctggacatccatgagcggatgggcaaaaagttgacagagttgtctatgcaggatgaagagctgatgaagagggtgcagcagagctctgggcctgcatgaggtccctgtcagtatacaccctggggtgtaccccaccccttcccactttaataaacgtgctccctgttgggtgtcatctgtgaaaaactcgagcaagcttatccattcggcccaaattcgagcttacttgggcaattcgccctatagggggcgtattacaattaattgggccccgtttaaaaaatcgggactgggaaaaccccggggttccccaattaaatgggttgaacaaattcacttttgacagccggcgtaaaacaaaaaagccccaccatttggcttccaaaaatgggcaccttgcgcg

SEQ ID NO: 215061 - DNA, 126 bp, Homo sapiens
agggatgattaaattttaacagcggttttgtatatagatttacctgcctttaggtttgtccttgatatcttaatgaactgtttctcagatagtcataacttatacttcacttgtttgccaagcttt

SEQ ID NO: 215062 - DNA, 417 bp, Homo sapiens
gaaaagaaataacacataatactatataatatagtttcttaacaagtggggctaaaaatcattttatagtaatttttcacattgatattaaacttcatgagtttcctttagtcattattattttttaaaaagaaaactccccccacccctaatataccattttgtatctcaaaattttactttgttgatttttaaagagtaatttctacttttatcttttaaataaaacatttttgtgtatttttcaagacaaaaagcttaacatttagtgtttttggaaatgtattaacgttttcttgaagtatgtatagttttccaaattattttactgatctgttaacgcactttacttgtttttaacttattttttcatgacccctttacaaggtgagtccatttaatcatctgtggtataaa

SEQ ID NO: 215063 - DNA, 401 bp, Homo sapiens
tggcttaaagtattttttggctcacagatcccttggaaaatatgatgcaagctgtggattcttgcctgagccccatcaatctggattatttgaggtgttggcctgccaggcctattgcactaaaatcttgggatgtcccctcaccttatcttggagttatcctctgtcactttctcgtgatggctccagtttcctccatcccatatgtaagtcgtttttttttgttaattctcgttttggcagagcatatgcttcctgagaaaggattcatagaaaatacattctttttttgagattacatgtttgaaatttctttcttttactctcttattatttggctgagtatataattctaactggaaataattttcccacagaattttgaggacattgcctcattg

SEQ ID NO: 215064 - DNA, 135 bp, Homo sapiens
ttttctttctttctttctttctttctttctttctttctttctttctttctcgctctcgctctctcgctctctccctcgctcgttttctttctctttctctttctctctctctctctctccctctctgtctctctc

SEQ ID NO: 215065 - DNA, 446 bp, Homo sapiens
cgcagtggcacacgcctgtaatcccagcactttgggaggctaaggcaagaggattgcttaagctcaggagttcaaatccaggaccagcctgggcaacatagtaggaccccagctttataaaaaaatttaaaaaattagccgggtatggtggcacacacctgtagtcccagctgctccagaggctgaggtgggaagattgcttgcgcctgggaggtcgaggctacagtgagctgtgattgcactactgcactccagcctgggtgacagagtgagaccctgtctcccaaaataacaaaaaaccacaaacactcactagtgtgtttagccatacatgtgtatttttatatattatgtaaacacatagtagctgatattttttgacctcttatgttgggcgtgattctaagcattttacatttattagctcatttaacttgagctaattg

SEQ ID NO: 215066 - DNA, 394 bp, Homo sapiens
gcttttctattttctacactattataaataactgtgatgaatatctttgtaagtctttgatgatacatgtgatgatttccttaggacagattcttagaagtggaattcctggatgcaagaacatgatttttctttttctttctttctttctttttttttaattttatttttattatttttttattttattattattatactttaagttttagggtacatgtgcacaatgtgcaggtttgttacatatgtatagatgtgctatgttggtgtgctgcacccattaactcgtcatttagcattaggtatatctcctaatgctatccctccccccttcccctaccccacaacagtccccgacgtgtgatgttccccttcctgtgtccatgtgttctca

SEQ ID NO: 215067 - DNA, 413 bp, Homo sapiens
tgtcagtgtttcctttttacagtaaatgtgtttctttcttcgtaggaaattagaaccattgaaaattttagacactgattaagtggaactctggacagtagttcttttcctatttctgccagtaaaagttcttaatgtctttatttcccttattttgcaaaataaggcactatgaactatttgcttgataaaaatggctatcaatgtcagagagagaattgtggattctttatagcacagaattgagataacttagattctatccagtatagttaatttaaaatactttaacctgtaacattatacaactgccagaatctcaaaagaactgctttgtggttcattaacattttatatagtgccactgcaggaataagtaatagacatttgttcagtagttcaacatattccga

SEQ ID NO: 215068 - DNA, 849 bp, Homo sapiens
gatggggctgagacttgcttgtgcctttgttgatggcagggcacttttattgaaacttgttgaaaggagctagcttcgaaggctcctccaagattctacaccacagggggaagcaggactttgatttaagatactcacatctgtcaaccacaggcattcattcagttttctctttcatttggggaaggaagggagaaaatgaatcagaggctgattttttttttttctggcctgttttccccaagctccaggaaattaagaaacatgccattagttttagcaaacaatttgaacaaagtaaaaccagatctcccaccaaaggccgaggaccatgaggggtctgagtgcccctggccctgtttgtggactctgcgggtcgtggaggagccatgaagtgggaagagagcttgggtgatacaggatggtgtgcgtgacagtcctccctgtgtcttctttgctaccatatttatcatagcttagatgtgtgtggcctggtggcaccaaaggtgaacagaaagcatttttggggcgccatggcccagacctcagcctgaacgttgtgggaagccagtgggtgtctgcatgtgttggcgagaaccagtgggcatctccttggaagccagtccccaaggtggctctagatggcttactcctgcatcttgccaaatccacagggtccagctgtgtctccagggctgcgtggcttattgaaaaagagagtgtatggtggatttcaatatctatattctacaaaaaatgtaaaaggggcaggggacgggaacaaagaaaccagtgctggtgatcctgcccccacagtaaggtctgctttagtgtggacatgggacaggg

SEQ ID NO: 215069 - DNA, 429 bp, Homo sapiens
cagggaagagacacttctactgagaatcacctcgttccctccaaaccaagaaatgcccagctctatgttcctcattctgcaattgccaaactagtggctaatgaggaggtgctattactctgtttctcacaggagtcttctagaacatgtggcagggatgatggatgcttccatgctcctattgaccagctagcagaggaagtgagaatgacaaagtttataccttataaacaacaccatcagctatcactgggttatgatttttacattcataaacatcatgatcataaaaatgtcttcattgatttttatgtttcatgttttcatgtttataaagatagttcatgcttattttaaacatagaaagtagaaaactgaaaactttcatttatcctgctctccaataaatattatttaacagtttggttt

SEQ ID NO: 215070 - DNA, 360 bp, Homo sapiens
ttctagatacaagtctctcatcagatacattatgtgaaaatattttctgttctgctacgggttgtcttttcattttcttaatggtgtcatttgatgcactaaaaatttttaatttggatgaagtccagcttatcttttttttccttttgttactcatgctttctggtcttatctaaaaaccatttccaagtccaacgtcatgaagatttataaacatgtttacttgtaagagtttgcattgaggcattcactctgagttcattttgtatatggtgtggtaggagtccagattcattcttttgtgtgtgactatccagttttccagcaccattcgttgaagagactcttctttccctgttg

SEQ ID NO: 215071 - DNA, 569 bp, Homo sapiens
gcccagatccgaatcggagtcggtaccctcgcgaacgtgttatccatacatgtccagggaccacagtttgaaaacctccacggctgacatgtaatgggatgacatggtccaataaatgaaggaaaaataacaggtggcaacctcaggcagcttcatcccaaccagtaagaaagtaaatccttttgtaaactcagaggaagtattaatatgggtgtttgagcaaacatttaagtgttaggagaaagaattaaaaactagcacaggcacccctgaagcatgataggatggcaacagaagggctgatttagtttccaagaaataactgacaggcagtgttgtgtgtgtgtctactacttaggaacccaaaacaaaccttcagaccgttttcatgagtactgagaccaagaaaaccactgggcagtgggtggtctggaaatgtaaatgttgatggtactccagtaatgagtcatggaacaatgtttcatattgaaaatgtttttgtaaatgtgggtttcagggtttcaaagtgaacccatatgtgttaggagaaaggataacaccaaagaagt

SEQ ID NO: 215072 - DNA, 245 bp, Homo sapiens
gcaatctaaccactacatttcaccattacgttccttggctaaactcttgaaatctatttaaagagaggaaaaacagtctaattactatcagaaccacagatgagatgcatgcgtaactctgctcagatcctaattcctctgccatgccttagttacagtcacttaggcttcaactatctcctagtcctaaattcctgctagacaatcaatagaactattcattttgcctgatattgtcagtaatc

SEQ ID NO: 215073 - DNA, 1351 bp, Homo sapiens
cgtgacccgggctgcggggcgcagcattgtgcggtcatggtgggccagatgtactgctaccccggcagccacctggcccgggcgctgacgcgggcgctggcgctggccctggtgctggccctgctggtcgggccgttcctgagcggcctggcgggggcgatcccagcgccggggggccgctgggcgcgcgatgggcaggtccctccagcctcccgcagccgctcggtgctcctggacgtctcggcgggccagctgcttatggtggacggacgccaccctgacgccgtggcctgggccaacctcaccaacgccatccgcgagactgggtgggccttcctggagctgggcacaagtggccaatacaatgacagcttgcaggcctatgcagccggtgtggtggaggctgctgtgtcggaggagctcatctacatgcactggatgaacacggtggtgaattactgcggccccttcgagtatgaagtcggctactgcgagaggctgaagagcttcctggaggccaacctagagtggatgcaggaagagatggagtcaaacccagactcaccttactggcaccaggtgcggctgaccctcctgcagctgaaaggcctggaggacagctacgaaggccgtgtgagcttcccagctgggaagttcaccatcaaacccttggggttcctcctgctgcagctctctggggacctggaagacctggagctggccctgaacaagaccaagatcaaaccttctctgggctctggctcctgttctgccctcatcaagctgctccctggccagagtgacctcctggttgcccacaacacctggaacaactaccagcacatgctgcgtgtcatcaagaagtactggctccagttccgggaaggcccctggggtaggtgggtgtgggtgtgtctgggggatgagcaggtgggtgggcacacacgtggggagtggtcctaggaggtttgggccttggaaaccctcccaacacacggagtcactgcagggatattccaagagttcattttggttttgtttttttctttttgagttgggtgacagtgcaagaccttgtctctaataaagaaaaaaacagttttacagtcaaggccaaagtcctccatagtgccacatccttcatcccaggccccagcatcagccccagggataccactgccaaatgtttgcagtacctccttcatggccaaatgtaaaaacttgatgggaccaggagctggtgaggaggtggggaagtgtccagccttattcattgctaatgggagtatgcgttggcacagctacttttaagaggaatccagctggcatctaataaaattcaaaatctgtc

SEQ ID NO: 215074 - DNA, 738 bp, Homo sapiens
caagaagtactggctccagttccgggaaggcccctggggtaggtgggtgtgggtgtgtctgggggatgagcaggtgggtgggcacacacgtggggagtggtcctaggaggtttgggccttggaaaccctcccaacacacggagtcactgcagggatattccaagagttcattttggttttgtttttttctttttgagttggggtcttgctctgttgcccaggctggagtacagtggcacagtcatggctcactgtagccttgacttcccaggctcagattatcctcctgcctcagcctcccaagtatctggaactacaaatgtgtaccaccacactcagctaatttgtttatttttttatttttaagagatggagtctcactatgttgcccaggcttgtctcaaactcctgggctcaagtgatcctcctgacttggcctcccaaagtgctgtgattacttatgtgagccaccacgcctagccagttcatcttgttttacatgtttattgccttttttattttacctattgctgcttaaccagttaccccaaaatttaaaacaacaacagcttaaataaccgctatttattttttgctcctgcctctatgggtcagctaggtggttttggttttctgggctgggccaggctgatcttggctaggctcactgatgcatcagcagtctgctggcaggtcagctggggtgggatggctggaatgggatggcctcttctcctg

SEQ ID NO: 215075 - DNA, 1023 bp, Homo sapiens
  misc_feature (999)..(999): n is a, c, g, or t
cgtgacccgggctgcggggcgcagcattgtgcggtcatggtgggccagatgtactgctaccccggcagccacctggcccgggcgctgacgcgggcgctggcgctggccctggtgctggccctgctggtcgggccgttcctgagcggcctggcgggggcgatcccagcgccggggggccgctgggcgcgcgatgggcaggtccctccagcctcccgcagccgctcggtgctcctggacgtctcggcgggccagctgcttatggtggacggacgccaccctgacgccgtggcctgggccaacctcaccaacgccatccgcgagactgggtgggccttcctggagctgggcacaagtggccaatacaatgacagcttgcaggcctatgcagccggtgtggtggaggctgctgtgtcggaggagctcatctacatgcactggatgaacacggtggtgaattactgcggccccttcgagtatgaagtcggctactgcgagaggctgaagagcttcctggaggccaacctagagtggatgcaggaagagatggagtcaaacccagactcaccttactggcaccaggtgcggctgaccctcctgcagctgaaaggcctggaggacagctacgaaggccgtgtgagcttcccagctgggaagttcaccatcaaacccttggggttcctcctgctgcagctctctggggacctggaagacctggagctggccctgaacaagaccaagatcaaaccttctctgggctctggctcctgttctgccctcatcaagctgctccctggccagagtgacctcctggttgcccacaacacctggaacaactaccagcacatgctgcgtgtcatcaagaagtactggctccagttccgggaaggcccctggggggactacccgctggttcccggcaacaagctggtcttctcctcctaccccggcaccatcttctcctgcgacgacttctacatcctgggcagtgggctggtgaanttgagacaccattggaaaaaaacc

SEQ ID NO: 215076 - DNA, 986 bp, Homo sapiens
caagctatcagtgggggacacggggccagccatggactccagagctcgagatcacatgacaggacctgggtggaagactttcaagaacaagtatgcaggatgcaatcaacagagcgtaccactgcgtgagaggctgaagagcttcctggaggccaacctagagtggatgcaggaagagatggagtcaaacccagactcaccttactggcaccaggtgcggctgaccctcctgcagctgaaaggcctggaggacagctacgaaggccgtgtgagcttcccagctgggaagttcaccatcaaacccttggggttcctcctgctgcagctctctggggacctggaagacctggagctggccctgaacaagaccaagatcaaaccttctctgggctctggctcctgttctgccctcatcaagctgctccctggccagagtgacctcctggttgcccacaacacctggaacaactaccagcacatgctgcgtgtcatcaagaagtactggctccagttccgggaaggcccctggggtaggtgggtgtgggtgtgtctgggggatgagcaggtgggtgggcacacacgtggggagtggtcctaggaggtttgggccttggaaaccctcccaacacacggagtcactgcagggatattccaagagttcattttggttttgtttttttctttttgagttgggtgacagtgcaagaccttgtctctaataaagaaaaaaacagttttacagtcaaggccaaagtcctccatagtgccacatccttcatcccaggccccagcatcagccccagggataccactgccaaatgtttgcagtacctccttcatggccaaatgtaaaaacttgatgggaccaggagctggtgaggaggtggggaagtgtccagccttattcattgctaatgggagtatgcgttggcacagctacttttaagaggaatccagctggcatctaataaaattcaaaatctgtc

SEQ ID NO: 215077 - DNA, 417 bp, Homo sapiens
tgtgagagggaaatgtctgttgtctgagccatcagtctttggtgttgggctatcacagcctgaacagacagagatgcctcatttaggccgagctcctgggtgggccacacgggtgtggactggacgctctgcatttggccgccagatttgaccccctgaaggtctttagtccattgttggggctggtctccagacttctcgggactctggatccagtccccaaagacttctacatcctccactcatgacctacaggggctgaagcagagctggccaggttgcagagcattgcggagtggatggagtagcaagccctggctagtctcttttgatgtttgactggttaagggagggtgtccttacgggagaatttatagtgctattaatttaaaaataaactataataatattttataa

SEQ ID NO: 215078 - DNA, 484 bp, Homo sapiens
aggttagtgtccagctgagcatggtggcatgtacctctagcaccagctactcaggagattgaggggggaagattgcttgagcccaggagttcgaggcagtagagtgctttaaaggcacttgtgggccagccatggtggctcatgcctgtaatcccagcactttgggaggccaaggcgggaggatcacttgaggtcaggagttcgagaccagcctggccaaaatggtgaaaccccatctctactaaaaacacgaaaattagctgggcgtggtggcccacgcctgtaatcccagctgcttgggaggctgagacaagagaaatgcttgaaaacccaggaggcagaggttgcagtgagccaagatcatgccactgcacttcagcctgggcgactagagtgagaatccatctcaaaaaaaaataagggcacttgttaataggcactgcatcccagcctgggaaccacaacaagaccctgcctcttaaaa

SEQ ID NO: 215079 - DNA, 965 bp, Homo sapiens
taaaaaaagcaaaaatatagagggcagagggcacttaaaggaatcatgttggtgaaaagtaaaagatgttaatataaaaaaaaaacacctatggaataattatgcgtcaattgtacatatgtatcccagtgatcacagctgacgtgacccatgcaggacaccccaccttcaatgcctccagatgtgctgcatggggagtgcacagcccagtgtggttctcctgcaaaatgcgtggcctgagtgccactgtgagtctaaccccacctgagggaaggaagctgtatcacctatcacgatattccactcttcaaaactagccacagcatgacaaacattgagaacccaaggaggaagtgttaagagatgggacaactaaataagaagcaacgatgctggatcattattgttttaatgtgaaatttcctcaatgtgataactgtattgtggttaagagattgtccttgtgtttaggaaatacgctcctttggcatgaataagggggcacaaacgtctgcatctaactgaagatttggggaaaaatagaatgagggggtgggagtgggtaaggaagagagagggagaacggggaaagtgaaggaaagggtatttggaagtctctgtactgttcttgccatcttccctaactttaaaattaattccaaagaaaaatttggaacaaggactcttgcctgtacatatgaatcacaggcatcttagtaaaaactctgactcagtaggtcggggtggagcctcagaggctgtatctgaatgagcccctaagtggatctgctgctcggaagaggtcagtgtggaaaagcctgtcttcccaggctgttccacagaatccaaaacaggcctcgggaagccactggatttcattacaaggacctgtgggagtcaacttgatgttggtttcttaaatggggaaaaaatggtaattgccccagtgacaaaaaatacaaaag

SEQ ID NO: 215080 - DNA, 1026 bp, Homo sapiens
gggaattcatggccaggcatggtggctcacgcctgtaatcccagcactttgggaggccgaggcaggtggatcacgaggtcaagagttcgagttcaagagcctgactaacatggtgaaaagtaaaagatgttaatataaaaaaaaaacacctatggaataattatgcgtcaattgtacatatgtatcccagtgatcacagctgacgtgacccatgcaggacaccccaccttcaatgcctccagatgtgctgcatggggagtgcacagcccagtgtggttctcctgcaaaatgcgtggcctgagtgccactgtgagtctaaccccacctgagggaaggaagctgtatcacctatcacgatattccactcttcaaaactagccacagcatgacaaacattgagaacccaaggaggaagtgttaagagatgggacaactaaataagaagcaacgatgctggatcattattgttttaatgtgaaatttcctcaatgtgataactgtattgtggttaagagattgtccttgtgtttaggaaatacgctcctttggcatgaataagggggcacaaacgtctgcatctaactgaagatttggggaaaaatagaatgagggggtgggagtgggtaaggaagagagagggagaacggggaaagtgaaggaaagggtatttggaagtctctgtactgttcttgccatcttccctaactttaaaattaattccaaagaaaaatttggaacaaggactcttgcctgtacatatgaatcacaggcatcttagtaaaaactctgactcagtaggtcggggtggagcctcagaggctgtatctgaatgagcccctaagtggatctgctgctcggaagaggtcagtgtggaaaagcctgtcttcccaggctgttccacagaatccaaaacaggcctcgggaagccactggatttcattacaaggacctgtgggagtcaacttgatgttggtttcttaaatggggaaaaaatggtaattgccccagtgacaaaaaatacaaaag

SEQ ID NO: 215081 - DNA, 698 bp, Homo sapiens
cagaccctccaggggcagggcccaggattgaagagggaagccctgctccacacgtgttcatcaggaaggacccacagactgctgctcctggaggcctctcggtttatggatgtgtgtttgttccataaaccctcagagggtcacctggagacccgctaaaatgcaggttcttgggccacatcctagaccttctgaccgacccagggagtggggcccaggaagctgcatttgacagatatccccgtgtgatcatcatgcacacaggagtgagagaaccagtgttctccccgggcagaagggaagctcgtgtgcaggacacctcacacctcctttcccattcccctgccaggctctccctgctgacattgtttttgcgggagagctgtgaattctgaagattaggttgcttctcaccccaagctccagaagtccaggctgagccaaaccaagcttcaagttgtgcctggacttggagaaccaggaggtgaggggactgactacttgaagatcacatggaggaggagtctgatccaggcccagtcttgctctgttgcccaggctggaatacagtggcatgatctcagctcactgcaacctctgccccccaggttcaagcaattctcatgcatcagcctcccaagaagctgggactgactacaggcatgcaccaccacacccagctaatttttgtgtctaac

SEQ ID NO: 215082 - DNA, 699 bp, Homo sapiens
cagaccctccaggggcagggcccaggattgaagagggaagccctgctccacacgtgttcatcaggaaggacccacagactgctgctcctggaggcctctcggtttatggatgtgtgtttgttccataaaccctcagagggtcacctggagacccgctaaaatgcaggttcttgggccacatcctagaccttctgaccgacccagggagtggggcccaggaagctgcatttgacagatatccccgtgtgatcatcatgcacacaggagtgagagaaccagtgttctccccgggcagaagggaagctcgtgtgcaggacacctcacacctcctttcccattcccctgccaggctctccctgctgacattgtttttgcgggagagctgtgaattctgaagattaggttgcttctcaccccaagctccagaagtccaggctgagccaaaccaagcttcaagttgtgcctggacttggagaaccaggaggtgaggggactgactacttgaagatcacatggaggaggagtctgatccaggcccaggcaccaaggaaaggccatgcaaggacacagggagaagggcagctgtctgtaagccagaaagagccttcactagaaaccaaatcagccagaaccttcatcttggactttccagccttcagagatgtgaaaaaataaatttctgttgattaacctacccag

SEQ ID NO: 215083 - DNA, 410 bp, Homo sapiens
atgccctgggaaggacagggttgcatttaacagaaacagctaaacctgaagggatgagcttgcctttccccggggccatgggatggtttatagaaagttctacccatcaggacaaagacctcacatgacaccatcagaggaactgatttcacaccacagagggaggaagagggcacatgccataggtctgctggtcacagcacacacgcactcctgggagcttcagacccagcagtggtggctcaggtgccaggtcaggatgtgggaggacacagtgtctgggtgaatctgtcacctttgctagctgccttgtcccaccaggtagaagatgtggcaatgggagcacagcagtaggaagcccagtgtcccccaaccttccacctcacagccaggacctctgaggtcgacgc

SEQ ID NO: 215084 - DNA, 797 bp, Homo sapiens
gtggggtttcaccatgttggccaggctggttttgaactcctgacctcaaatgatccaccggcctcggcctcccaaagtgctgggattacaggtgtgagccatagtacccagccagaaataaatttattgactgatataaattaaaattcctgtgtatagctggcttcaggaaagcctgaataggtgttcaaagaatgtcatcaggaacttgtctcaccaatcccttacctgtgttagcttcaattaaaaaaacatatttttgggccgggcgcagtggctcacacctgtaatcctagcactttaggaggccgaggtgggtggatcacctgagatcaggagtttgagaccagcctggccaacatgatgaaaccgtctctactaaaaacataaaaattatcgggcgtggtggtgcataaccgggcatggtggtgcatgcctgtaatctcagctactcgggaagccgagggagaattgcttgcatctgggaggcagaggttgcagtgagctgagatcgcaacattgcattccagcctgggcaacaagagtgagactccatctcaaaaaaaaaccaaaaaacaaaaacaaaaaacatttttttaagagacagtttcactctgtcgcccagagctgggtccagtagtgcaatcacagctcactctaacctcaaagtcctggactcaggcattcctcctgtcccagcctcccgagtcactgagactataggcaagcaccagcacgcctggttactttttttttttgaaacagggtctccctctgttgcctatggtggtatgcag

SEQ ID NO: 215085 - DNA, 223 bp, Homo sapiens
aacagggtcccgacccatgccaaccaggagggagcctttgggcagcagcccttgctgcgcacctgggccaacttggccagcactctctgtgggagaggccactcacccccatgccctccctgggcaaggctgaggctcttgaggggtggaacatcaggcatgttggggacataatcgaaaacaaaaatctcctgccaatgcagaaaacctttccacaaaagaa

SEQ ID NO: 215086 - DNA, 305 bp, Homo sapiens
tggtctcgacagaacatcaaattagctacagtattccccttaagtcaaagcctaacctaaagaaaggctttcttcagttatttgaaggctgagagaggtgagaagctacaggaagaaagctggaagccagcagaggttgttggttcatgacttttaaagaaagaagccatctctataacataaaagtgcaaggtgaagcagcaagtgctgatatagaagcttccacaagttatccaggaagatctagctgacatcaaggaggtgggtacagtaaagagattttgaatgtatgtgaaagtcttcta

SEQ ID NO: 215087 - DNA, 374 bp, Homo sapiens
ttggtgttccaccttaatcctgtcatatcactaatacccaccctctgtccccattccaacagtccatatctatgactctccatggaggactgcccttgaccacctggaactgctttgtctctgtaaaaagaaccagaagtgcttgggagtttttattccctgatatcaaggcaaaatctaatgactggctagtgcagtcatgaaaccccagctcctgtgcatcagtcatgactattctaaggtgctatttagggtcatgcagaaactatcttcagtgggactttacaagaagtcactcctttgcttgacttcatctctgactcctttgttgatttctcccaagatgacttcaacaatcacttccaggcaaatct

SEQ ID NO: 215088 - DNA, 146 bp, Homo sapiens
tgctatttaggaggctttttcctaagtcccacagttttctgttcttcatgttctatgtaatgctacatactttgtagattcttttctgaaggatgtaagagaaataatagatggagttcacagagttctccccttctttgtccttg

SEQ ID NO: 215089 - DNA, 434 bp, Homo sapiens
ttctcgtattcagaaaagcggagggaatagtacaatcactttatgtataccatcatctagatataccagtgatcactttgccatccttgcattttttttttgctgaagtattttaaattacaaacatcatgacattttaccccttaacccttgagtgtgcaccttcaaaaaccaaagatgtcccccacagaaccgcaataccatcaacatacccaataaaattttaataatcacttaatagcatctaatacccagattatactcaaatctcccaactgtcccccagatttccttatgatcacacattctttccttaaaatgtattggttgtcatggacagaagccactctgactctggattttggggtggaaaaggaaggtattcaggaactagccagatcatgtttaggggaacagaaagagttcataagttc

SEQ ID NO: 215090 - DNA, 1350 bp, Homo sapiens
tccggctgcccgcgcacctctccacgccggccccgttccgcggctcgccctcggctgcgctcggctcccgcgggcgctcggccccgagcccctcctccccctacccgccggccggacagggaggagccaatggctgggcctgccatccacaccgctcccatgctgttcctcgtcctcctgctgcccctggagctgagcctggcaggcgcccttgcacctgggacccctgcccggaacctccctgagaatcacattgacctcccaggcccagcgctgtggacgcctcaggccagccaccaccgccggcggggcccgggcaagaaggagtggggcccaggcctgcccagccaggcccaggatggggctgtggtcaccgccaccaggcaggcctccaggctgccagaggctgaggggctgctgcctgagcagagtcctgcaggcctgctgcaggacaaggacctgctcctgggactggcattgccctaccccgagaaggagaaccgacctccaggttgggagaggaccaggaaacgcagcagggagcacaagagacgcagggacaggttgaggctgcaccaaggccgagccttggtccgaggtcccagctccctgatgaagaaggcagagctctccgaagcccaggtgctggatgcagccatggaggaatcctccaccagcctggcgcccaccatgttctttctcaccacctttgaggcagcacctgccacagaagagtccctgatcctgcccgtcacctccctgcggccccagcaggcacagcccaggtctgacggggaggtgatgcccacgctggacatggccttgttcgactggaccgattatgaagacttaaaacctgatggttggccctctgcaaagaagaaagagaaacaccgcggtaaactctccagtgatggtaacgaaacatcaccagccgaaggggaaccatgcgaccatcaccaagactgcctgccagggacttgctgcgacctgcgggagcatctctgcacaccccacaaccgaggcctcaacaacaaatgcttcgatgactgcatgtgtgtggaagggctgcgctgctatgccaaattccaccggaaccgcagggttacacggaggaacagggcgctgtgtggagcccgagacggccaacggcgaccagggatccttcatcaacgtctagcggccccgcgggactggggactgagcccaggaggttgcacaaagccgggcgaatagccgtaactagcagtgggagatcaagtaggggaacaagatggctgaggctgcagactcaggcccaggacatcaaccccaggacggggagccgctcggcgacatgagctgggtgga

SEQ ID NO: 215091 - DNA, 659 bp, Homo sapiens
ccggtttgggcagaaggtggggccagttggaccattcagagggccctggctcagggtgccatccctacccccagatcttccacctgcagccacaggcagaagtcttctccactgcaaggtgataaagcagacagcccagctggccgtcctctcctcactcgctgccatcctatttagtggccatctggctttcatctctgtgattctcggactgtccctcctcgaggtccctcttaaagaggcagacacactggcttcagtaaaggacctccactcccaagccaatgcatccccagcctttaccaggacaagcctaacaaagaaaaggccacacaacaggggtttctggtagcaacacaagtctatttcaaacctcggattagagtatccgaaagaattacctgttccaagcaaacacgttcccaccctctggcagaaatgcggttggagcagcctgacgccacggcagactccaaatactctccactgaagcttgctttatcctgtttgaaactcctctgtctgtccccagagagtctggaaatacactctttctaggagctgatggaaaattaacccacattatgagagagctagttgatgctgcattggggacaggaaggtccatttgaaagggggaaaaaacaacaacaaaaaaa

SEQ ID NO: 215092 - DNA, 292 bp, Homo sapiens
cctctcatgtgataccttgtactgcctcgggactttgcaaattacccactagcaagaaggccctcaccaaacatgaccccttgaccttgatttctcagcttacagaacgccatctggttggactgggggcactggctggcccccatcttccaggtatttgtctggagttttcttgactctcctgtatcctggaagatccttctcaggagaaaacaaactcacaagagaaaaggtctacagatatagacatctgggggtccctaataaaaaagctgattaatcctcaaactgc

SEQ ID NO: 215093 - DNA, 1056 bp, Homo sapiens
gcggccgctcgacaatatagagcgtggggtcctccatggctacccggagccgtgcgggaccggccgggtggggctggagctggagcgggagacccggagagaagcaggagcggaagggaggagagctagcgggcgagagcggagagcagaggaaactcgagccacgtccgtgcgcaccgggactccgcccagaggggcctcagcttttccaccactgctttctagtcctttaactcctagaggcaaacttttgggggataagaaagcctgggaggggcctgtgccaaaaccctctctgcctggggactgggcggtgattccgcttctgcctgggctcctgccatggcccccgagaggggctgacactttagctcccggtgcaggtgagaacccgcccggaggaagaaggaaggcgcgggccggggattaggagacggaggcggactcggagccagggaaccaggggtccgggctagagctggagtcgtgagcgcgcgcccgccccgctctgggaggaccgcgagatgcccgtgctgaagcagctgggccccgcgcagcccaagaagcggcctgatcgcggcgccctgtccatctccgcgccgctcggcgacttccggcacacgctgcacgtggggcgcggcggcgacgccttcggggacacctcgttcctgagccgccacggcggcgggccgccccccgagccccgggcgccccccgcgggggccccgcgctccccgccgccgcccgccgtcccgcagtccgcagcgccctcgcctgccgacccgctgctgtccttccacctggatctggggccctccatgctggacgcggtgctgggcgtcatggacgcggcgcgcccggaggcggctgccgccaagcccgacgcggaaccccgccccgggacgcagcccccccaggcccgctgccgccccaacgcggacctcgagctgaacgacgtcatcggcctctaggttccctcattccccgcgcccttcccgcccggcaccccacttctgtatacataaacggccaaggtgtgtgcccggaaaaaaaaat

SEQ ID NO: 215094 - DNA, 890 bp, Homo sapiens
gcggccgctcgacaatatagagcgtggggtcctccatggctacccggagccgtgcgggaccggccgggtggggctggagctggagcgggagacccggagagaagcaggagcggaagggaggagagctagcgggcgagagcggagagcagaggaaactcgagccacgtccgtgcgcaccgggactccgcccagaggggcctcagcttttccaccactgctttctagtcctttaactcctagaggcaaacttttgggggataagaaagcctgggaggggcctgtgccaaaaccctctctgcctggggactgggcggtgattccgcttctgcctgggctcctgccatggcccccgagaggggctgacactttagctcccggtgcaggtgagaacccgcccggaggaagaaggaaggcgcgggccggggattaggagacggaggcggactcggagccagggaaccaggggtccgggctagagctggagtcgtgagcgcgcgcccgccccgctctgggaggaccgcgagatgcccgtgctgaagcagctgggccccgcgcagcccaagaagcggcctgatcgcggcgccctgtccatctccgcgccgctcggcgacttccggcacacgtgtccttccacctggatctggggccctccatgctggacgcggtgctgggcgtcatggacgcggcgcgcccggaggcggctgccgccaagcccgacgcggaaccccgccccgggacgcagcccccccaggcccgctgccgccccaacgcggacctcgagctgaacgacgtcatcggcctctaggttccctcattccccgcgcccttcccgcccggcaccccacttctgtatacataaacggccaaggtgtgtgcccggaaaaaaaaat

SEQ ID NO: 215095 - DNA, 969 bp, Homo sapiens
gcggccgctcgacaatatagagcgtggggtcctccatggctacccggagccgtgcgggaccggccgggtggggctggagctggagcgggagacccggagagaagcaggagcggaagggaggagagctagcgggcgagagcggagagcagaggaaactcgagccacgtccgtgcgcaccgggactccgcccagaggggcctcagcttttccaccactgctttctagtcctttaactcctagaggcaaacttttgggggataagaaagcctgggaggggcctgtgccaaaaccctctctgcctggggactgggcggtgattccgcttctgcctgggctcctgccatggcccccgagaggggctgacactttagctcccggtgcaggtgagaacccgcccggaggaagaaggaaggcgcgggccggggattaggagacggaggcggactcggagccagggaaccaggggtccgggctagagctggagtcgtgagcgcgcgcccgccccgctctgggaggaccgcgagatgcccgtgctgaagcagctgggccccgcgcagcccaagaagcggcctgatcgcggcgccctgtccatctccgcgccgctcggcgacttccggcacacgctgcacgtggggcgcggcggcgacgccttcggggacacctcgttcctgagccgccacggcggcgggccgccccccgagccccgggcgccccccgcgggggccccgcgctccccgccgccgcccgccgtcccgcagtccgcagcgccctcgcctgccgacccgctgctgtccttccacctggatctggggccctccatgctggacgcggtgctgggcgtcatggacgcggacctcgagctgaacgacgtcatcggcctctaggttccctcattccccgcgcccttcccgcccggcaccccacttctgtatacataaacggccaaggtgtgtgcccggaaaaaaaaat

SEQ ID NO: 215096 - DNA, 563 bp, Homo sapiens
gcggccgctcgacaatatagagcgtggggtcctccatggctacccggagccgtgcgggaccggccgggtggggctggagctggagcgggagacccggagagaagcaggagcggaagggaggagagctagcgggcgagagcggagagcagaggaaactcgagccacgtccgtgcgcaccgggactccgcccagaggggcctcagcttttccaccactgctttctagtcctttaactcctagaggcaaacttttgggggataagaaagcctgggaggggcctgtgccaaaaccctctctgcctggggactgggcggtgattccgcttctgcctgggctcctgccatggcccccgagaggggctgacactttagctcccggtgcaggtgagaacccgcccggaggaagaaggaaggcgcgggccggggattaggagacggaggcggactcggagccagggaaccaggggtccgggctagagctggagtcgtgagcgcgcgcccgccccgctctgggaggaccgcgaggtaaggcgcggtggggacaggggtcctgggtcccggtcg

SEQ ID NO: 215097 - DNA, 561 bp, Homo sapiens
gcggccgctcgacaatatagagcgtggggtcctccatggctacccggagccgtgcgggaccggccgggtggggctggagctggagcgggagacccggagagaagcaggagcggaagggaggagagctagcgggcgagagcggagagcagaggaaactcgagccacgtccgtgcgcaccgggactccgcccagaggggcctcagcttttccaccactgctttctagtcctttaactcctagaggcaaacttttgggggataagaaagcctgggaggggcctgtgccaaaaccctctctgcctggggactgggcggtgattccgcttctgcgacgcggtgctgggcgtcatggacgcggcgcgcccggaggcggctgccgccaagcccgacgcggaaccccgccccgggacgcagcccccccaggcccgctgccgccccaacgcggacctcgagctgaacgacgtcatcggcctctaggttccctcattccccgcgcccttcccgcccggcaccccacttctgtatacataaacggccaaggtgtgtgcccggaaaaaaaaat

SEQ ID NO: 215098 - DNA, 945 bp, Homo sapiens
gcggccgctcgacaatatagagcgtggggtcctccatggctacccggagccgtgcgggaccggccgggtggggctggagctggagcgggagacccggagagaagcaggagcggaagggaggagagctagcgggcgagagcggagagcagaggaaactcgagccacgtccgtgcgcaccgggactccgcccagaggggcctcagcttttccaccactgctttctagtcctttaactcctagaggcaaacttttgggggataagaaagcctgggaggggcctgtgccaaaaccctctctgcctggggactgggcggtgattccgcttctgcctgggctcctgccatggcccccgagaggggctgacactttagctcccggtgcaggtgagaacccgcccggaggaagaaggaaggcgcgggccggggattaggagacggaggcggactcggagccagggaaccaggggtccgggctagagctggagtcgtgagcgcgcgcccgccccgctctgggaggaccgcgagatgcccgtgctgaagcagctgggccccgcgcagcccaagaagcggcctgatcgcggcgccctgtccatctccgcgccgctcggcgacttccggcacacgctgcacgtggggcgcggcggcgacgccttcggggacacctcgttcctgagccgccacggcggcgggccgccccccgagccccgggcgccccccgcgggggccccgcgctccccgccgccgcccgccgtcccgcagtccgcagcgccctcgcctgccgacccgctgctgtccttccacctggatctggggccctccatgctggcggacctcgagctgaacgacgtcatcggcctctaggttccctcattccccgcgcccttcccgcccggcaccccacttctgtatacataaacggccaaggtgtgtgcccggaaaaaaaaat

SEQ ID NO: 215099 - DNA, 461 bp, Homo sapiens
aacaagcattgttgcagagtgaattttctgcaaaccttcgggagaagtataagcacaggggactcagcagttacccacagtatgtgccagggctagagtcatttgtggggaccctcctggctctttggcctatttttttttttcaacatacttaggacaaggtcatttcaaatgcccagataagtgcagagaaatcagtcattaaattctaactcagcctgaagtttcactcggtgggaaatttttgaatataaatgtcttgtgttaccatataatagtagtgacttatagttttagccaacctttattgaatgcttactatgtatcaggtatgttctaagagatgtacatttattatctcattcagtctatgcatcaaccttatcaggtagttatgacagaagtagtattttgaattcaccaaatcccatttcatattcctccattctggacacatagaa

SEQ ID NO: 215100 - DNA, 352 bp, Homo sapiens
ttagctcttgtttttgtcattttgtcctctcaataacatctaccactattcttttttaaaaatatattttttaggccgggtggtggctcacacctgtaatcccagcactttgggaggctgaggcaggtggatcacaagttcaggagttcgagaccagcctgaccaacatggtgaaaccctgtctctactaaaaatacaaaaataagctgggcgtggtggcatgcgcctgtaataccagctactcaggaggctgaggcaggagaattgcttgaacccaggaggcagaggttgcagcaagctgagatagcgccactgcactgcagcctgggctacagagcgagacttggtctca

SEQ ID NO: 215101 - DNA, 891 bp, Homo sapiens
attcagataggattttaaaactacactatgtttacacacaaggcattaatattttaatgaaaatataagtaattatcaacagtatgaatgtttcttcataccatcataatcaagactgaaatttatcctgaatgggtatggtatgagctgggtttactgaaaggacacaaacacatttattaaggacacagaaaagataaacagttagcaaataagctacaagtggtgggcatcattcagaaatacactcaaaatattattttcaaatatattgctttatgccatttcaaatacatggaacaagaaatagttacaaaattaggtaatagtatagcagaatgctataatcaagctttattcactagccctgtttcacttttttatcactcaaaatgtctagactcattggagacagggagagttatgttgatctgcaatatattcccagtgccttgcatttagtagttgtttaacaaatatttaagaaagttttataaaggagtagctatacactgtgaattttcattcatatagaagaatttgtactctctccaatgacagcaaatagtctcctcataaattttaaatgtagctaaaattataatatggtttgtcaactatatttaatgtaagaagaatggaaacaattacaattttatgtctattttcgtaaaacatctgtgtgtaggcactccctttcttctgcaattgcaaaacgggactgattttgagaatattttatttttctatgatatttaatatatgtttatttatatttttgagcttgctaaatgctgacatttaaaattttaaagagatattactctgattgcaccatattttgtactatgtgtagaaatggtcattttttacataaataaaactacatgt

SEQ ID NO: 215102 - DNA, 630 bp, Homo sapiens
  misc_feature (26)..(26): n is a, c, g, or t
ggaccttgtagacaaatcaaccaccntggaatcaaatcttatctttactccttagggctttgtgaggtaaatgtcctcatctgtaaaatgggaacaattagagcatgatctccttaatatagttgtttgatgacctgaattagtttatgttcgcaaggtgactaaatagcggaagaaggataataagcattgctgatgggctggacccagtgctcctgcaggagtgactggagtagttgttagatggccttggacatgactgggaatacaatggggttcctctctagcagggctcaccacagacttgggactggggctgtaggcaatagttgttctgccaaccctcctgaagggaaggtggttaagtattctttgaattgttatcttctgaagtcttccagtggtcttttttctttttttcttttttttgagatgaagtctcactctgttgcccaggctggagtacagtggcgtgatctcggctcactgcaacctccgcctactaggtttaagcaattcttcctgcctcagcttcctgagaagctgggcttacaggtgcctgccaccatgcctggctaatttttttatattgtttagtagagacagggttttgccatgttggccaggctg

SEQ ID NO: 215103 - DNA, 413 bp, Homo sapiens
tagaaataaggaaatgtgacttagaagtttgtgattaggaaccactttgtagagcctcgcttatttgctgcattagatagtccttggaaataagctgagtggtctcattttgcagattcatttgtctaaccagatacactgtagggccagggtttgtggctaagtaaatgaaaatccagcaggattggagggagccaccccaggaccttgcccctcaccagccatcttgaagagccactcgcctgcctgcctgtgttcctgccccactgcctgaggagaccttttcagaattatgttagctattctaacagttcctttgcctttccttatgcattttatagttagcttgttaatatctattagaaaaagcttgctgggattttgatagaattgcattgaatctatagatccag

SEQ ID NO: 215104 - DNA, 131 bp, Homo sapiens
gaatcagagagaaatgccccaggggtagttagctggaagagggacttgggggaaactgaaatatcaaatagataattttaaaaagtttctatttttaaaattaatattattttaaattgacaaatcataat

SEQ ID NO: 215105 - DNA, 499 bp, Homo sapiens
aatttgaaatactagctatgttaatggaggtcaggattactaaggctggatttacagctacaaaaaagtgacccagatttattttctattactcaaaattagttatgtcgaaggaggagcaaggggcttcttggtctatagactattgctaatgtgtctctggacataaatcttctttggttttcattatctattctggagaaagcaatggtgactctgagtaagtggggcagcaattcaggtctttaccacaccacatgcagcatttgtacaggagtagctttggcctcccagaccttagtgacctgggcaggccacccatctctgccttttcttggagtgatttttacaggcacagagtaaactcctgccctcaaatacctactgccatttgcttcctgatgcttaacattccacatttatagaaaaggcctcaaatataaggaccacaataataacacgtgatttaaattcacatagagatgtattggctcctatt

SEQ ID NO: 215106 - DNA, 525 bp, Homo sapiens
attctacactgtggaaggtcaccatggatttttggtgaactgccagccatctttgcttagcacctttttgataagcaaggtgtttctcatcctgctttgcttaggaatcaccgttatgcactacccaggtgtatatttgttgtttgttgctgtgaaaaataatttcccaaaatttcatgacttaaaacaacaaatactttgtatctcatgttttctatgagtcaagagtgttgatgtggctcaaccggatgcccgtggctcacggtctttcatagacatcaacagacactgcagggaggatccacttacaagctcactttcctggccacttgcaggcctcacttcctcactggcggttggtggtagatacaggtgcctggccactaaggtctttccactgggaaactcacaacttggcagctggcttccactgtaatgagccatcaagagagtgagaaaggaaactcaaggtagaattcaccatattttgtagcctattcttgttagtttcatcctgtgaaatta

SEQ ID NO: 215107 - DNA, 469 bp, Homo sapiens
aaatgacatctgcactcctactgtatttctgctggacagcactgctttagtagctgcaattttgtttcacatcttgggtagcctcaatagctgctatggtttgaatgtctcctccaaagctcatgctgagatttaattgccactgaggtgattagatcacgagggctctgccctcatgaatggattcatattcttatcacaggggtttgacctccttcttcctgtcccgctctcctgccttccatccttccgctatggatgatcctcaccagatgctggaagcatgctcttggacctctcaggctccagaacctttgagccaaataaacttctcttctttgcaaatacccagtctgtggtattccgttatagcagcagaaaacagactaagacaatagctcagaatcaaacataacaaagagaaaaacacacaagaaggacagtagactggaaaagaggaattcaagta

SEQ ID NO: 215108 - DNA, 541 bp, Homo sapiens
acggctgccagaagactacagaagggcacttgaattcagccctctaccaggagggtgtgccctgcagacacaagtgatgaacatttgcttattcatgtattatgtattttctgcttgcttactaaaaggatttagtgatttggttcagctttcagtaaaaagatttctagaacgagagtcatcaaactggcgagatgattactgaaaaacttgacaggccaggtgtggtggctcatgcttgtaatcccagcactttgggaggccaagatggaaggattgcttaaggccaggagtttgagaccagtctggacaacgcagtgagactctgtctctacagaaaaaataaaattaaaaaaatcagctgggtacgagggtgcatacctatagtcttagctacttgggaggctgcagtggaaggatcatgagcccaggagtttaaggctgcagcctaggagtttgaggctgcagtgaaccatgattgcgtcattgcactccagcctgggcagccgagcaagactctgtctctaaagttaaacaaact

SEQ ID NO: 215109 - DNA, 99 bp, Homo sapiens
attgtacatgtgatttttttttttcctgttcatacatttgtgctgcccatgtactcttggcacatttcaataaaattgtttggaaaataaacacagcaa

SEQ ID NO: 215110 - DNA, 227 bp, Homo sapiens
tggaactcaaacccaggcaagccagctgtagaaaggaagagaataagtgacctttcatccgtttctccatatgacttatgtagatgtttcttttgcacagcacaggttggtagggtcagggacatgaagataggctttgtggcaggcagtgtctcttggcttgtcagcaggaggcctgccagataacttcctgcctatctggtcattctcaagtcttggcgtgtgag

SEQ ID NO: 215111 - DNA, 640 bp, Homo sapiens
ctgacctgccatcaggagatataatttgccagtaattacaactttaattccaaaccaaagcacaagaacatacgcacacacacctctgcttgaagactgtgaaaagttagtaaacttaggtaggttgcaggagcacacaaaagcaacagcctcacatatactagttagccatgtagctccaccataacataaggtcaactacctataatgaattctctattagttctctcattattatacccagttgtgcttctctgatcaaactatgactaatataccaaaactctacatcttagttttggtgttagctctacatgtataaaatctccatccatccattagcagtttccctactcacccatggttctctagctctccctatagtagattcaccagaaagggcacatgtgcacagtattctctgagttttgggacattcaaactgtttttctttaaccttgattgattcttgaaggacaaatggttggatataatctctttggtttatggtttacactcattaagattcctgaaatgtcactctactgttgccttgctttgtacgttatttgtgaaaagcatggccagtctaacttacatgtctttgtaagttacgttctttgtttttcaatgtttaaag

SEQ ID NO: 215112 - DNA, 125 bp, Homo sapiens
gagatcacgccactgcactgtagcttggacagagatagactctgtctcaaaaaataataattaaaaaaaataataaaaaacacagaagatcctaaagacaaataaagtcaccactactaaaattt

SEQ ID NO: 215113 - DNA, 117 bp, Homo sapiens
gtattcctccagcattggagtggaccactagtttttcggttaaaccacagatgaagctgttggcttgaatttagggtagtgttttacacacacacacacgcacgcacgcatacacac

SEQ ID NO: 215114 - DNA, 239 bp, Homo sapiens
tgcactgtcccatgacagagggcaaagagagggagagaggaaagaaagagagcaagcacaagtgtgcaaaggggccaaagtcatccttttataagaacccacttttgagaaaatactaatctattcatgagggtgatgcccccggatccacacacctcccactaagccctgcctcccaaccccactgcaccgaggatcgagtttccaaacccatgaacttttggggacacgaatgttca

SEQ ID NO: 215115 - DNA, 377 bp, Homo sapiens
caaacagctacactcggagtagaaaacaaatgaagcaaaagtttagcatcctctcatgtgtgtcaacattgtagttttacatttactttcttctaatctattaaacataagtatggctccatttttttagtattaccagaagccctcccaatacggcaatattaccttctgtgtaatccacttgccaacagctgttttctgttgaaatgggactcaagaattttgaatccaaggccaatgctgcctgctctgtttacaatggtttgtgttttgtggatacatatcaaatgctgtaatatatttttatgatagaattgatggttaatacagggaaaaagtatatattgtgattctgtccaataaagcctcctgttata

SEQ ID NO: 215116 - DNA, 410 bp, Homo sapiens
ccgaaggccccagtcctctccttgggagctggatcagggtttattttaaagcccattcttacctcttagcttggcaaagtattgccaagcctggggaaaaccagccattcatgtatatttctggcgagtgtaatgtacctcctctttggagggcaatttggctgttgtctattgaaattaaaaatatgcgtctcttcctggaaagggaattgttgggggaatttatcctacagataccctcccgtgtgtgtaatgatagccggaccaggatgttctttaaaagtggttctcagccagtttgttacaaaggtcatgaattattcagcaagatgataatggttttatgtttttaaaaatgataaattgtagcctgttgatcatcgttaaaaatatttgaatgctatttgtat

SEQ ID NO: 215117 - DNA, 480 bp, Homo sapiens
tatctttcataagcataaaataaacctaaaactaaataaaaataatataatctataaaaatcataactaaagcaaatacttaaagcattgttcaaggaatatgcttattatttacaataaaaataacaataatgattataatagatcactatttgactggatatctactatgttccagatgctctagtttatacatacatataaactacatttataaatgtatatgtaaatttatacattcccataaaatcctattgacagtcactaccaccaccatttacaaatgagaaaacaggtcaatatatattatgtctaagacaatggcaacctgggatttgactgtgtcttggtctgactcagagtccctgccttaatatcatgtaaatgctttctagttttaaaacctcaggttttaaaatctgatgtccagagttccctgccccctttttctagcctgtaatgattaagaataggagaccc

SEQ ID NO: 215118 - DNA, 264 bp, Homo sapiens
cggaggttgtggtgagctgagagattttaagcagtagagaattacagtcaggattgcattttagaaaaaccatgtttgtggttttttggaaaacaggagggaaccatactgcatgcagggaaagcagtttgccttcattcagatgtcacctactaatagtacaatggctggtgtgatgggagtagagaaaaagttgtggggtttgggtctccctatcctgtcacttcaaaaatcatttcataaaatgcacatatttaacaatgt

SEQ ID NO: 215119 - DNA, 373 bp, Homo sapiens
atatgtaaatgaatgggcatggctgtgttccagtaaaaccacaaaaacaggcagctagctttggtgtggggccctaagagcttggactttgaagccaggttcaaatcctggctttctcaccttctagctccgttaccttaaagaacttcattatcttccttgtattttagtcttttcatctctaaattagtgatagtacttaacagtgttgttataaagattaaacgagttaagtttgtaaagtacttaaacagtgcctaccaggtagtaagtgctatagcagagtgtgttagataatgaaacatcctgtgctgtggatatattattcccattacgatttggattcaaataaagaaatacatgacttagaaga

SEQ ID NO: 215120 - DNA, 423 bp, Homo sapiens
cacgccaggccacagtttgatgagttttgagaaagtaatatacgcatgtaaccaccatcaccacaatcaagatctagaacatttccatcaccccaaaattccctggtactcgtccctggtcccaggcaagccctgatctgttttctgtcactgtggatcagatttgtcttttctagagtctcataaaaatgtgatcttataaaatgtatagactcttgtgtgtaaggtttcttttcctcagcataatgtttttagacttgtctatgttgcatgaatgagtggttcatttctgtttatcactgagtatttttccagtgtatgtatataccacaatttgtttatataccacaaatgttgatggacatttaggctttgtccagttttgtctattatgaataaagccattatgaacatctatgtaca

SEQ ID NO: 215121 - DNA, 597 bp, Homo sapiens
caggcggattgcctgagcctaagagtccaaactagcctggacaacacagcaaaatcctgtctcaaaagaaattggcaaaaatgattaaggttacaaataccaaatgttacaatctgagctatttgaatgaatgaagagagaaagaataccaagtgttgacaagcatgtaagcaatcagaactcaaaaactgctattctatttataaaagaagttgacattatcttgctttaagctaaacatacacttaccccatgacttgaaaattctactcctagatattgtaatgtaacccagtgaaatattttgtggtagtgaaaatggattaactatagccacttggctattagatgaaaaatgcaagtcatagaatatacatagtacagatgcactaacaaaagtttaaaattaagcaaaactaataatgtattactaagagaaataaatgtaataaacatttaaagggaagcaagagaataaaaaatattcaggatagcgagtaactcttggtaggtaaaaggagaattaagattgattgaggaggccaggtgcacttggctcacggctgtaatcccagctctttgggagccaaggcagtg

SEQ ID NO: 215122 - DNA, 306 bp, Homo sapiens
cagatagatatacaggctaaaattcattgagcaagacacttaactttcacacattttacagcactgaatcgtgcctcaactcagggaaatgaaaaagacaggccttataccctacatactactctgttctcttgtccttttactttatttaaacctgctgccagttggtagatctgcatgataattttagtgactgcatagtatttcattctgtgatcatcatttgtatcttcagaccaactttgttccctggtagaaaacccttctgaaatgaggtaaaaggagaggggaccccagggcctttgg

SEQ ID NO: 215123 - DNA, 609 bp, Homo sapiens
caaatgatcaggtcaggaagccaggtggattctccttcctgtccttgaggaggtgaggggtccggggctggctttctcagacaggatttcccagatgatttccattactcctgactttggcactgcatcattctctgtgggaggctgtcctttgtactataggatgctcagaggccaccctagcctcttcccgatggatgtcagtgacacctccagccccacagttgtaacacctcggaacgtctccagacattgctaaacatactgggatcaggggcagaattgtcctgggttggcagtgatggctgtagagtagaggttgccagtggggcaaggtggcccacgcctgtaatcctagcactttgggaggctgaggcaggaggatcacttgagtccaggagttcaagaccagcctgggcgacaaagcgagacccccttctttacagaataaaaaattaaaaaattcgttgggcatggtgctgcacgcctgtcgtcccagctactcgggaggctgaggcaggaggatcacttgagctgggaggtcaaggctgcagtgagctgtgatcccgccagtgcattccagcctgggcaacagagcaagaccctgtc

SEQ ID NO: 215124 - DNA, 229 bp, Homo sapiens
ggaataagcccaaacactgcttttcattttagactaccccagaatattatatactatttctcagggtagctttaagtcttcctctttaaggaactcagtaaacaggtaagttatattaggtggctttatgaagaaatatacatgctctttaataatattctgttttaaggaagaaaaccacttattaatcagggatgtcattcaacccagaaatctggtacagttgctt

SEQ ID NO: 215125 - DNA, 376 bp, Homo sapiens
tcgtccaccttcctctttccgcgagggagaaacagatcctgagttcaaaattccagagctgaaagtcctctcttggatccttctggaaacagtaagcaaaagcccgtttttgctgagaaagtgactcggcagctatccggagctctctgcctgcaggtggggccattctcctatggagccgacccgacccgctcaaagctgccccgggaaccgcaggtttggttcgcgcacgccgggacttgccaaccgcacccggaaaatcggggccatgtccaaatgtttcgcttcgctgccggcagggagccgcgccgggctcgctcctgggatcaactgcacagtcctggctttggggagcgggaggcggtgagcctgcccg

SEQ ID NO: 215126 - DNA, 861 bp, Homo sapiens
attgtttccagtgggcattgttgttagcctttcagaattccatctgcacgtgaaacctaatggatttagatctttagtttctctcttacctgtaatccactattattgccaattcactgtattttgagcctaaaatctgagcccatgtcctctgacaggcatgaaatcttttgtccctctgccagaaaactaagaaagtactgtattttgtatgtttattattttgaagtgtctgaaatgcaatttacaacactgttgcaaagaactttacaaaaggtaatatttgtatcgtatatacattttttctcccagccttctcccatctcctccagaaaaatttcctataaagatggatttttttacactgaaattttactgaatatagtcaggatcatgggcaagagaagaaaatagtatacccaagatgataaaaatttaattcgtctatgcttgatcagtgtgagtaaaacatcttcctttatcatgggagctgcacagattcatgtgggaaactttagggaatgactgtagataccctttctctatgtactctctcacctaattttcagtcactcatatatgctagagtggagcccttaatttaaatctatttggaaggacttttttaagaggaaaaatattttttctaaattataaagctttaccttttgagtgatttcttttttagagtgctcttacactagtcagcattgctagtttaaagttgattaacttgaaagagtatgtatactatatttctattttgctaacaaattggtatattaattaccattggttcttaattacaagaaaacttgtgcttagaattttaagataaaaggctaagtgacaaatgcttct

SEQ ID NO: 215127 - DNA, 481 bp, Homo sapiens
aatacatttgatcagactaggaacaagttgataccaaaacctgaaaaggaaactacagaatgggaaagtcatagaagatctctcacagaaatataaatcccttaacaaatattaacaagtaagattcatgtctctataaaatagacagtatatcatgaccacactggttttttgttatcctttgattttgtttatgaaaagcaaggatagcttaattttcaaaaactcaatcaatgtaattcagtattttaacaaaaggaatgaaaaattatcatctcaatagacaaagcttttgtctgagcaccttttcatatagctgctgaccatttgtatgtcttcttttgagaaatgcctgttcagctactttgcccatgtttcaagtagtttttggtttcttgctgttgctttgttttagttccttacatatttttgcatattaaccctttatcaggtatacagcttgcaactattttctcccatt

SEQ ID NO: 215128 - DNA, 398 bp, Homo sapiens
ttagtgaggcattagattctgaggactttggatatatatgcagattgctttatacaaacagccaaacacgtcctttcacacatgtgcagaatctaagaactgaaatatgattgaagtcacacccccctttcctgagggaatcctgcattgacttactggtctgtgtgggttataaagacctagtccccttgccctgattcaggacatctctgaaaatccgttccagctccagagtgcccctttaagacatgggaaaacaaaacaaaacaaaacaaacaaacaaaaaatgccatgctgcatcacagtccaacatctccctatgctcagtcctgctttacttactccctcaacaatgttgaccctgagaacacttcccaatgaacttattgcattaaatt

SEQ ID NO: 215129 - DNA, 424 bp, Homo sapiens
ttaagtaaaatcttgttacagatttagccctggatatattagaactatagtgtgttgaaattgcgcataagaaaagcatccatcagcattcatgcaaaggctacatgtcatgactattaggagtaatttcaaaagcatattactatatattctgcattcatcctttctctggtcatcatcttttaggctcaggcccagctttctgaaattacataagttttgactttattattagttattttgctgcttcctttaagcaatggactcattgtgtacttttttctttttataaatgttatcattttgtcatacttttgtctttttttcgtaaatttgtatctacattgttgaacacatggtacatatagcttcctaatgctttttgttttgttttttttttttttttttgagagagggtctcact

SEQ ID NO: 215130 - DNA, 386 bp, Homo sapiens
acacaaaaatctaagtataaaaaaagttgggaagaaaagacaaattctgcggttacaatgtctaagacaattatcctggccacttcaaaaaagacaattttatgaaaaatgcaaaagatggaggggggctgttctagattaaaagagattaaatgcaatacttgaaacttatttggatcttaagttggaaaaatatatatatatgtccttttgggggcaatgggtggaatttaaatatatagataagataattcgtgaataatgtttttaaaagttttagtgtgataatagcattggtttatgtaagagatattccttattctgaagaaatggacgctaaactatttagaggtgatgtctgcaacttagtttaaaatggttccaga

SEQ ID NO: 215131 - DNA, 355 bp, Homo sapiens
tggggctggggcgtgggagatggttccaagaggaggtgtttcctgaattgccttttgaagtttttatattgggtttaataactgtattgtgagatatattatttataccaaagagtgcataaagcataagtacagtttaatgaataattacacagggacatccctacagcaccatccctgaagtgagtttggaagggtaggtagtagttagccaggttaagctggggaaagatccgggaggaggtaatgatgtgtgaggcaggagaatcgcttgaatctgggaggcagaggttgcagtgagccaagattgtgccactgcactccagcctggacaacagagcaagacttcatctca

SEQ ID NO: 215132 - DNA, 601 bp, Homo sapiens
ggatatatacttttgtttccctattggtgaagcagttaatactcaggtaagtgtagaataatctgaatagcaaaagttataattgcttagccaaagaagttgtatcaataatgcataaataaaataatatttaaataacacaaaactttagtaaaaattgttttaaatttatccattttggaaaaaatatacatgtttttcacatggtgaaaaagcactctttgattctgtggctcatgaaaatagcctgaatatttgacaattatggctgtagaaaagcttgttgacactttgacattcagtttgagggaatgtgttgaacttgctatttttttttcttcattttgttacaactttagttattctataatccaaggaactcaaacctttaattgtaggtattttaatctcattagtttgttatctgtttcctagctttggttacccaatgccaaaacattgcagtgatgactgaaaattttgttcagtcatccagctgttttcaaatataacactgttttagcacataggagtttggaaaattttcattgattgactttttctggatacttattatcgtctaaaattttcattagcaaat

SEQ ID NO: 215133 - DNA, 609 bp, Homo sapiens
ttgcttagactttaatagactagcctagtaccccaaccacaatttataagcagtttcaagaaagaaaatcagtttgtatcctaaaaatcataagctcatttataaattggaactgactaaagaaaaaagttgaggtacttcattgttaatttattgcaaatacttaaaataaacttatttttaaagattagcttttgagttccaaagacctgatattaaatgtccttactgatccagaggcctcatagctgaatatccaaaacatgcatgccacagggtataagtccttcgccacagaccagagcatctctgaggctaacctttgggtaatgtttgttcacacctggtgcaaattaagtggtctaaccaattatatatgataactttgataaataatattaatagatattatttgttgaatatttaaagataggccaggcaacttcacatggatcatttcatttaatggattcgaataagccatgagattcatgtcgtcattgctgttttacagtgtaggaaaccaaggcttaggatacttaagtgacttggctggagtcatacagtagataaatgacagctgaaattcagatctaagtcctgcgtaac

SEQ ID NO: 215134 - DNA, 528 bp, Homo sapiens
agaagggaaacagaaagcttgacatttggcattgcttttctccttgcggcatttgctgattcaaaacatacagcctaggagctgaaaagccaaggagttgaaaagccagggagcagagaagccaattggcaagtgctcaagccaaaagcaccaactaagaggctgacaagcccttaggtagtctcataggtctaggagaacaagtaagcttagagtccaacgagggatctgagggcacaggtgaacccagcctttcacatggcaattttaaatggcaacgtcctaaatggaagggcaaaccaaaaatagaccagcacttacaaagactgaagaccaattttaaattagctcaaactgagaatgggttaaggttaccaatccctgtaataactatctgccataagagaaagcaaatcttcttcagagaaagataaggacatccatgaggtacaattatctctctctcttttaaatacacccagtattcaaaacatcacttgatataccaagaaataagagtaaatgatc

SEQ ID NO: 215135 - DNA, 483 bp, Homo sapiens
gcggtagttcatgactgtaatcccagcactttgggagaccaaggcgggtgggatcacttgaggtcaggagttcgagactagcctgggcaacatggtgaaaccccatctctactaaaaatacaaaaaatgagccgggtatggtggcagatacctgtaatcccagctactcgggaagctgaggcaggagaatcacttgaacctgggaggtggaggttgcagtgagttgagatcgtgccactgcactcaagcctgggcaaaaagagtggaactctgtctcaaaaaagaaaaaaaaaagaaagtggttcaagtgacagagtagagtcttggctagatagaggagtaaagtgaatgcctgaggatactgacaagctggaaaacaggaggaaaaataagttaaatggcctgaggatgaagtccagttgaattttaaacccaagaaaatgagaaagatcgaaagattggtaattaaaataaaatcctcca

SEQ ID NO: 215136 - DNA, 321 bp, Homo sapiens
catttgttcattcaacaaatggcaggctctttgctagttgctagggtggcagcgttgtcttcgagggacaccgtgatgttcatcctcgtggtgctcaagcttgagtgagaagagaggtgctgaacaagtaattttcatgaattatgagagatcgggatgagaaatacagcatggcatggaggaggctgtggtggtcaggaaaagctggaacctgaataataaagggaataagattgaggaagaatggaggatacaaaggcaaatgtagaaaaataggcaaaagatgcagacaggcaatttacaagaaaacaattgcagatg

SEQ ID NO: 215137 - DNA, 524 bp, Homo sapiens
gattttgcaaaattatggagagtgcagactaggagaaaaaggacaggcatagttgtgacaaggagctcttttttctagttctgcattctagaaacagtactgatgagtccaaaaatatagagataaaatttgtcttttttcttgctttaaaaaaaaatgcttctaaatgtctacatacttgcctaagaaaatatttctcaactcctccagaatatttagggttaactaaaaattataaaaacataccacagagctagtccactctttatgcctagggtttacccaaaaggtctgcatgctctggcttggagaccctgaccccatctcaacttgctggttttaagtctacatatttggctgcaaagccctaatgccaggaggaatgcggaactgatgagtccaccccatctacaagctagaaggacatcttgattaaattagtgtcaaggggggtggagagaaaggcacagtgacacaaagggtgttttgaggagccctgtagcgcctgtggagaatgaatgttc

SEQ ID NO: 215138 - DNA, 142 bp, Homo sapiens
atgattaaatgaaggaggacctgaaaagagggagcatctgaattgggccttgaccaagtggtaggatttggacacaaagagatgggcaaaggaactccagagagaaggtacagtgtgagtaaatttccagtacaggggctgg

SEQ ID NO: 215139 - DNA, 413 bp, Homo sapiens
caataccatgcccaagtaaggtttattccacatgtaaggctggtttaatactcaaaagtcaatcaatatgattcaccctattgattgtctagattggaaacatcatacaattctatcaaatgattcaaaaaatgcttttaagaaaaactatacccattcatgatttaaaatttaaaaaccaactctcagcaatgtgggaatcgagggaatttcctcaactgtgcaaagaacatctacagaaacctatagctaaattgtatgtaatagtgacagactcaatgctttcccatgaaatcaggaacaaggcaaagatatcctctccaagtctttctattcaacaaggtactggaattgtttgctggtgcaataaggtgagaaaaggagttaaaaagcatatacattggaagtaaaaa

SEQ ID NO: 215140 - DNA, 217 bp, Homo sapiens
aactgggaggctgcagtgcagcctttagtctgtggctgaaggtctgagagcccctggtgtaggtccaagagtccaaaagctgaagacttggagtctgatgttcgagggcaggtagcatccagtaatggagaaagatggaggccagaagacttagccagtctagcccttccatgttcctctgcttgctttgatcctatctgcactggcagctgattag

SEQ ID NO: 215141 - DNA, 288 bp, Homo sapiens
catcttaaccccttgaagctgatggtatttaggaactggggaggtgattttggatagaattttgcccaagtccagggatgactgagtgggctgtggcagacagtgccttttgtattggatagctgacaagctgcatgggaatacgcactcctcctcagtcatacattatcttcctttggcaggctggcagcatagggctcggtgggaaaaccttaagcctcactttaataatggtagcacataaggcacagtgattctgactcagttgcaagctgagtgcaaaattgg

SEQ ID NO: 215142 - DNA, 428 bp, Homo sapiens
aggaaatgagcccaggaagtaagttgggcagccgcaagagtggtaggagagcttacccagaattttactgtcttaaatccccaagggtattattgagggtgtgagaccagccacgttaggccctgcagtggaaaagggggagggggatggggagtaaagaatgctgacttttctctgggcttttagggaaacctctgagctgggctgcaggggttctgtcctttgacattcttgtttgtgaagatggaaaatgatctctggagtcaagcttagtttatttcagataatgaactttttctcttaaggtatacccatagctttagagtacatatattctcaataaagagtttttaggaagattttggtatattgtatataattgttcaggtagctatgcgggggtagggggctcccataacaaagtttaa

SEQ ID NO: 215143 - DNA, 679 bp, Homo sapiens
tctgttagggcaagatcaaacagtgtcctactgtttgaatgtgaaattctctctcatgctctcacctgttttctttggatggcctttagccaaggtgatagatccctacagagtccaaagagaagtgaggaaatggtaaaagccacttgttctttgcagcatcgtgcatgtgatcaaacctgaaagagcctatccatatcacttcctttaaagacataaagatggtgcctcaatcctctgaacccatgtatttattatcttttctgcggggtcctagtttcttgtatacattaggtgtttaattgttgaacaaatattcattcgagtagatgagtgattttgaaagagtcagaaaggggaatttgctgttagagttaattgtaccctaagacttagatatttgaggctgggcatggtggctcatgccagtaatcccagcgctttgagaggctgaggtgggtagatcacctgaggtcaggagtttgagaccagtctgaccaacaaggtgaaaccccgtctctactaaatacaaaaaattagccgagtgtggtggcacatgcctgtcatcccagctacttgggaggctgaggcaggagaatcgcttgaacccaggaggcagaggttgcagtcagccacggttgcgccattgcactccagactgggcaacaagagtgaaaac

SEQ ID NO: 215144 - DNA, 343 bp, Homo sapiens
gagacggaatctcgctctttcacccaggacggactgcagtggcgctatctcagctcactgcaacctccgcctcccgggttcatgccattctcctgcctcagcctcccgagtagctgggactacaggcgcccaccaccgtgccctgctaattttttgtatttttagtagaggcggggtttcaccgtgttagccaggatggtcttgatctcctgacctcgtgatctgcccgcctcggcttcccaaagtgctggaattacaggcgtgagccactgcgcccggcctcatcattttcttgattgtactctatgctgcaagcattttgaattcccttcagtcctttcta

SEQ ID NO: 215145 - DNA, 430 bp, Homo sapiens
agacatgctaaaaggcaagaaacacagtttgaagagacagaacaagcatcagagccagtcagctatgacaggaatgttgaaattaccagacaagcaattcttttaaactatgattaatatgctaagggctttaatggaaaaagtagacaacatgcaagaacagctggatcctgtaagcaaagaggtggagagtctaagaaaaaaaacaaaaagaaatgctacagatcaaaaacaccataacagaaatgaagaatgcttttgctgaccttatagtagactgggcacagatgagaaaagaatctctgagcttgagtatatgatgatacaaacttccaaaactgaaaaacaaagaggaaaaagactgaaacagaacagaatattcaagaactgtgggacaacttcaaactgtgtaatgggaatatcagaagga

SEQ ID NO: 215146 - DNA, 683 bp, Homo sapiens
gactcctgcttccccactggactaggaaagactggggagcagggctgatgccagaatcctaatgcaggaggagcttaggaatgcaaatcaggctctggagatgtgggcttgtgggggtggggtcgtcttgatgctgcccttgcatagcaagcactctgcatttacttggactgtgtgtgacttatttgattggttttgggggtgatcacagtgccactgggggcagagaacatgaatgctttatcctgcctgaatctcttttccttgtctggtgactggtgcagaggtagtcacaataaatatctgatgaacctgaacactgagtccaataagtaagcttggagggaatttatttggcaggcagggagggattgtctggcaggtttttcaataactatttgagttaatgaataacacaatgaatgacggtaagcctgaattatgtaattgaagccaggtaaaacagtataaaattaggaaacgataaatagcccttgccaccttgtgttgcaaagtgctgggattacaggcgtgagcccctgcgcccggcctcaagtggctttataatataattattactacggaaggaatccgtggtcacataagcttggcaaatgttgattcaacaaagctaagccaacttctttgcagcctgggtgatagagtgatgagaccctgtctca

SEQ ID NO: 215147 - DNA, 343 bp, Homo sapiens
tctacagctagctttcatgaatctaagtgggtgttaatcattttaattaatggtttaaatataatggtttaataccttagtacaggttaaaagcttcattaattgtgttagttttgatgaaaaatgtaagttataatcttatttaaaaaacagacaaaccacagacttgcacttttatttgccctgggctgaaaatgtgccaaagtcccacttaaaattttttttttaatgcttgaagcttttctgaccatttgatcttgtgttggattgtgttttgtaataatctaagcaagattgctttatgctcttccccaattaaaaacaagaatgatgaccttcatga

SEQ ID NO: 215148 - DNA, 178 bp, Homo sapiens
tactcagcaatgcagatgccattattcctattttacattcagggaaggtaagaaccctgctggtagtcacagagttgagatttcaatccatgtttgattttaaaatgcatgttcttttcattatgcccataagtagcgtgtgaaatttctttcctttttttttttttttttttttttt

SEQ ID NO: 215149 - DNA, 325 bp, Homo sapiens
  misc_feature (309)..(309): n is a, c, g, or t
caagcatgtgttccagctcataccctgtgagagggctgcccagcaaggcatgtgagagcaccacaggtttcaaagtatgtcctgtggattggcaaagtgaggagggcatccacccatgggggcagttcaacatggggagtcacacatgaccgggttactaggacatgatcctgagggatgggcccaaggtggaattcagggccctactgggatgaggtgggagttgccaaagataagtagactagaacggcagaacacaagcatcgtgagagttttcacacaggtgggaggcagagcaagactctgtcncaaaaacaaaaaaaaa

SEQ ID NO: 215150 - DNA, 576 bp, Homo sapiens
caagcatgtgttccagctcataccctgtgagagggctgcccagcaaggcatgtgagagcaccacaggtttcaaagtatgtcctgtggattggcaaagtgaggagggcatccacccatgggggcagttcaacatggggagtcacacatgaccgggttactaggacatgatcctgagggatgggcccaaggtggaattcagggccctactgggatgaggtgggagttgccaaagataagtagactagaacggcagaacacaagcatcgtgagagttttcacacaggtgggaggcagagcacagggaatcagaactccagttataaggggacctacacagaagaaggtgacaacagagatggcatgttggttatgaacagggaaattgatcagatatataaatatatgaagggtgatggagctaagtttcacactgtgcaaatagggagttacttatatgaagaaaaagctaaaattaaccctatggtgtgtcactagaataaagaatcagagtgattgcactaatggtttttgataattgtatttcattgtaggaataaatgtatatgcaaatatgtg

SEQ ID NO: 215151 - DNA, 646 bp, Homo sapiens
tcatgcctcctgcacttcattcagcctggaagacagactcaaaaaaataaataaatacaatgtcaaaaagtgagcaaggttctatccccaatccaaatgctaactggtttaaaaaaaaaaagtagaagagagacaaggtctcgctgtgctgctcaggctggtctcaaactcctgtgctcaagtgataactcccaccttggcctcccaaagtgctgggattacaggcatgagccaccgcacccagacgtaagcgggtttctgtttgttagagaagccttttcttcaccaagttaagaggaccttaccacttcattttgggaggagtgtttttattccttctatcttggattcatgaacatccaggtgttctttcttacctcttcttacaggcaggggagaatttaaaagagcctgaaagaatagttatgtgccccttgacatttcagcaaatgtttcagtagaaaggagattggctctttcaatagttcacctaatggtctgtgaccgagctgaggtgtcttcttgaccctgtaaaggaggcagctccatgagtttgagggctacacacgtcaaatggctgtagttgcccaaagaattttggatcagatctctcacctttgatgggaatgaaataacaaagcctcac

SEQ ID NO: 215152 - DNA, 413 bp, Homo sapiens
ctgaacatgatgcaaaagccatcactctctgaactgtgatagcattttccaagccacacataaatctggtagtaaaaggtaaaaacctaattgtctaagggggtttatgcaccatctgtaactaataagcagcttaggcaactcatgggcaaccctaggtagccaggctaaaagaaaagatgaaaaatagatctgagtagtgatatgagacactgcacactacaggggaaacagactttacagaattagctcagccaagtcacgaaacagataatcagccaaccaaccaacaacaatgccctggggggacacatattcagaactgctataatatattgtctaaaatattcagccaacaaaaaattgaaacataaacaaacaaacaaacaaacaaaaagagtgtaaccaataag

SEQ ID NO: 215153 - DNA, 487 bp, Homo sapiens
gcggccgcctaggagggagcccgccggggcggggcggggccgggtgcccatgaacagcggggtcccggccacgctggccgtgcggagagtgaaattcttcggccagcacggcggggaggtgaggtccagcgggctctgcccagactcccggctttggatgcagagtggttcctggttctgtgtagtgggggttccagaatgttctctgggcagtggctcaggacattgagtccagagtagactttgctaacccaagaaggatcgaagtaggttctcagctccagtgccgggccccagctccagagcagctctaggttctaagctctgcctgtaaaaagagccccgggctctgggctctgcctcgagaggggcacaaagctccctgctgactctggtgttttctggggccctggctctaaagtgaactcagaacttagagtagattctggactctccgttgtcagctgcggctctggaatgggctctt

SEQ ID NO: 215154 - DNA, 1145 bp, Homo sapiens
gcggccgcctaggagggagcccgccggggcggggcggggccgggtgcccatgaacagcggggtcccggccacgctggccgtgcggagagtgaaattcttcggccagcacggcggggaggtcaactcttctgccttctcccctgatggccagatgctgctcacaggctcagaagatggctgcgtgtatggctgggagacccggagtgggcagctgctgtggaggctgggtggccacacaggccccgtgaagttctgccgcttctcccctgatggccacctcttcgccagcgcctcctgtgactgcactgtccgcctgtgggatgtggcaagagcgaagtgtctgcgggtcctgaagggtgagtgagctgggagccaagcagccaggccagcgttccctttcagatggtgctgtgtcctgtgtcacgtcacctttccaccttccccgaccccgggctggtgcctgcaggtcaccaacggagtgtggagacggtcagcttcagccctgactcgagacagctggcatcaggtggctgggacaagcgggtgatgctctgggatgtgcaggtacgttgaggggctggggccaccagtctgggattcaaggaccagttccagagaggatgtcaccagtcttgccctcccagctcaaaccctccactggttcccatggcccatgcccacagcaggcaaccaaggctgcccccacctggccacagccgcctctccaggcttccttgcacacagcagccctcaggctttttgcacgaggtccccctttcctggactgtcaaggccaggtagccggctgccctctgctgccttctgcagctcagggctctctctagtccggccagatgctgcgcctcttagttgggcaccgtgactccatccagagcagcgacttctcacccacggtgaactgcctggccaccggctcctgggactccaccgtacacatctgggacctgcggatggtgaccccagcagtctcccaccaggcgctagagggacacagtgccaacatcagctgcctgtgctattcagcatccggcctcctggcatccggctcctgggacaagaccatccacatctggaagcccacaaccagcagcctgcttatccaactgaagggccatgtcacctgg

SEQ ID NO: 215155 - DNA, 529 bp, Homo sapiens
aagtgatccgcccgccttggcctcccaaagtgctgggattacaggagtgaaccaccacacctggtccaaagaatactcttaagaagagacccagtttggttctcttaccacctgctgcagaatctcccagggaagcttgtgaaaatgcagggtcctgggccctaccccagagatcctgaatccatctctggcagggacccaggaacctacattttaaccaagctcccaagtaacaaagtaaccattactgtccactgtccagattcctgaggcccaggaatctgcatgtttcacacactccagagtggattgcccggtcccatctcacagctggagtcactgggacccacccaacagaaggaaatgcactgagtgacaggaaagcaaataatcaatgagtgttgtcattcatttatttgctaatttcatcaggtccccaaacaagggcacttgtacactcccagatgcctcagcctagaatcagaatctctctcaattgtgctcctagtattataatattttaagcctc

SEQ ID NO: 215156 - DNA, 612 bp, Homo sapiens
ggatgggatctagtcttattcttttcatttaaaaaaataaaatataacggttccaatactttgcactcagggtaacttactgttgctagagaccatgatgacaaaaaagcagagaagggtaaaggcaatctgaaaacatggaggcatattaaaggcatttaacaatgtgttattatttttttaattgccaatctcacatcttaataaacaagacaatgtcctgagtgtggctgtatttgttctccggagaaaaatgaccaataggatatatataaataagtagagatatacaagagggatataccatgagaattgattcatgtgattatgagggccaagaagtcccacaacatgccatcagcaaggtggagaatcagggaggccagtgctgtaagtcaggccaggttcaaagacctgagaaccagaggagccagtggtgtcattgtcagttcaaggcagaaagcctgagggactggaggcctactggagtaaagacccaagaacctgcagctctcatatccaacgacagcaggtgcatgtcccaaagagacagtgaatttgcctttcctctgccttttctttctatccaggctctcaatggattggatcatg

SEQ ID NO: 215157 - DNA, 756 bp, Homo sapiens
aaattcagattgctaaataagggataccaatcagatgttttctatcttccctggagaaactaaggaacttcaagtttaaaacgcctcatgaagaattgggataaaatataaagaatttcctgaagaaagggaggaagatgattgtgtactgaatgattgcaatagaacatctgaaaatgtaaaatgaaaaggataactgaacttttctatgaagagcttgattatggccatacattgaattaatgagcattcagtgagtccacagttctttgttgagggtctcctgcatgccatacactgtgctacgtcctggggctccataaattctttgttaacaaaataaaaatacccccatacagagaagcactttcagatacattacctcatctctaacagaacacacagtcaacagaaccatgcggaggctgatcaatattctaaacaatagtttcataaatactgtccctagactcgtctactcactgggagctgcaggggttggtattctagctagcaaatgaaacaatctgcatacatgcttaaatcaagtttgtttaaaattagaaaatggcataatgtattcaaaagtttttatgcagtatttgcatggaatttaaaatatgctacatgctttgaattaggagagcagagcgatgtgtagctcatctattggtctgatcgaatgtttaaaaatcaaattttagagagctctgtacttaaataactgtaaaagaaaataaaatcagaatgcataaa

SEQ ID NO: 215158 - DNA, 357 bp, Homo sapiens
aagcccctggcctccgggttctgggatgtgggctgggctgaggtccgcccaggtttctcgcttcttggagcccccgtcagttatctgcgttctccattcttctctggggcacagcctgcttgtagtgggtccctggcaagcaggaagaccaggctgcccttgctggcacattccaaacctttgcccatttcaaatctgctaccttcccactagccagagcacgtcactcgccaagcccaaagtcaagggaggagagcccacccaccacctagagaccacagcaagcagacggatgtaaaattctgctacgggggagtgaaaaaccaatgattaaattgctaattgaattgtaagtta

SEQ ID NO: 215159 - DNA, 506 bp, Homo sapiens
ccctgcatgcacattcgaatcacctgggggcacaatgcctaggctccaaccccagacactcttatttcattggtctgggtggacctggcatcagaagtcatgtagctcctcaggggactgtagtgtgtggtcagcactgagggctcctctatgaggcctcaagcccaggtgactctgtgaggtctgcagagggagaaaagaacccacaagggaagaggtggaggtcaggcacggtggctcacgcttgtaatcccagcactttgggaggccgaggtgggtagatacctgaagtcaggagttcgagactagcctggccaatatggtaaaaccccgtgtctattaaaaatacaaaaattagctggctgtggtggtgggcacctgtaatcccagctactcgggaggctgaggcaggagaatcgcttgaactcgggaggtggaggttgcagtcagccaagatcgtgccactgcacaccatcctggatgacagagcaagactccatcacaaa

SEQ ID NO: 215160 - DNA, 406 bp, Homo sapiens
tggagtgcagtggtgcaatctcggttcagtgcagtctccgcctcctgggttcacgccattctgcctcagcctcctgagtagctgggactagaggtgcatgccaccacccctggctaattttttttttttgtattttgggtagagacagggtttcaccatgttcgctagggtggtctcgatctcctgacctcgtgatctgcccaccttggcctcccaaagtgctgggattacaggcgtgagccaccgcgcccagccctcattgtggttttaattctttatatattctggatctctagcccttttaagtcttattactcatttttttaagtttgtcttacttggcatcttagtagttgcttcttattcgcattttacttttttggtcatcatagcactctatttttgt

SEQ ID NO: 215161 - DNA, 181 bp, Homo sapiens
gcttcacgtttttctttatatcaggattattaccacttcctaggttattgtgaggattaaatttagatgatactgtaaaaagaccaacactatacttgcatatactttggccatttttattcagaatctgattcatataatttatttcaaaataactacacacacacacagatacatatgt

SEQ ID NO: 215162 - DNA, 249 bp, Homo sapiens
gattcaagatatgatgcctgctctcgagtggcttaaactctccatttgggtgaaggttagagaggaagagggaaaaacactcttgtttgaatgcatcaattttaggctaaatatctagaagcatatgcattataaacacatgatccatcacaggtataaacatgaaactccacttatctggtgttcacttattcaatcagctcagctatccagaaaaaagctgagatctcagagcagacacagtttatt

SEQ ID NO: 215163 - DNA, 811 bp, Homo sapiens
aatagcttttatgtagaatgattatgcttatgcataggttgaaggtttgaaggcaagaagataaagtttggggaataaacaggggacatgttataggaatggatgaaggataaaactgtggtggggacacagggttaaaggagaggcaaaattgggtttggggattaagatcgcagaagagggatacgagtatgagattgtgtgagactgtcctacatgtcattggcagtgctcatgttagagggaccatctggatgtgctcatgaagttgttgggtgagaaccagatgggcctcagggtagggaaaattaggtggagtttggcctcctcagatctacaaaggcagacaacccagtgaattacttacttaatttgactcttgtagaggctcaaagaagcccgtcctggaaggtctagctgcttgtttcacaaaggccaaagacagggaagtattttgtttactggattcattcagaaaagtatttattgagcatatactatgcaccaggcattgagaacatagagattttgttttccctcaaggagttcctagtctagtggggggaaacaaagacataaaaagtaaatgcaacagtgtgttacaatggagaaagaatcccgtgtggggtattatgggggcacaaagcagggagggataggttcacctcgaggagatagaaaaggcttctcagggaggcaacttggcgtctgggttttaaatgtgggagaatttataccgttttttgggaatttagggcacattttggagagaggttggcttttttggcaaaaacacacccaaagttttgct

SEQ ID NO: 215164 - DNA, 349 bp, Homo sapiens
tttgaaggccgaccgaaggggctctacatttgaaggcctactgaaggagatctacatttgaaggccgactgaaagggatccacatttgaagctgggcactgctgcatggtaggtttcctttcgtaactagtgcgagggaaattgacctctaaccccaacgcagaaggctgggcaccgtcctcagcacagagacctccctgcctgctctgggtttcctcaaacagttcattccatgaccctggaaagcagctccctaacattttacttgacagcccgtcaagctctgagtgtgggatcagacaccatgagcatgccgatgcaccctcggacttgttttcagcccactctt

SEQ ID NO: 215165 - DNA, 2575 bp, Homo sapiens
aggcggtggaggcgcgggcgctgtccagcgtgctgaagccggagcgagctagccgcccggagccgcgccgacccagctgagcccagcccacgggacgccagacctcgaccgtcgctcctaccccggccaccgctcggagccgaggcggacgcgtcccgatcttcccctgtccccaccctgccccgaccctcctctccacctctcgcgtcgtgacaccagctgtctccggcagcctcttggtcatgaaagccctcagattgtcggcttccgccctcttctgccttctgctgatcaacgggttaggggcagcaccccctggtcgccctgaggcgcagcctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgcacacgctgacccgagtgaatctggagagcccggggccagagcgcgtatggcgcgcttcctggggagagttccaggcgcgtgtcccggagcgcgcgcccctgccgcccccggccccctctcaattccaggcgcgtatgcccgacagcgggccccttcccgaaacccacaagttcggggaaggagtgtcctcccccaaaacacacctaggcgaggcattggcacccctgtccaaggcgtaccaaggcgtggccgccccgttccccaaggcgcgccggccggagagcgcactcctgggcggctccgaggcgggcgagcgccttctccagcaagggctggcgcaggtggaggccgggcggcggcaggcggaggccacgcggcaggccgcggcgcaggaagagcggctggccgacctcgcctcggacctgctgctccagtatttgctgcagggcggggcccggcagcgcggcctcgggggtcgggggctgcaggaggcggcggaggagcgagagagtgcaagggaggaggaggaggcggagcaggagagacgcggcggggaggagagggtgggggaagaggatgaggaggcggccgaggcggaggcagaggcggaggaggcggagagggcgcggcagaacgcgctcctgttcgcggaggaggaggacggggaagccggcgccgaggacaagcgctcccaggaggagacgccgggccaccggcggaaggaggccgaggggacagaggagggcggggaggaggaggacgacgaggagatggatccgcagacgatcgacagcctcattgagctgtccaccaaactccacctgccagcggacgacgtggtcagcatcatcgaggaggtggaggagaagcggaagcggaagaagaacgcccctcccgagcccgtgccgcccccccgtgccgcccccgcccccacccacgtccgctccccgcagcccccgcccccgcccccgtcccgcacgagacgagctgccggactggaacgaggtgctcccgccctgggatcgggaggaggacgaggtgtacccgccagggccgtaccaccctttccccaactacatccggccgcggacactgcagccgccctcggccttgcgccgccgccactaccaccacgccttgccgccttcgcgccactatcccggccgggaggcccaggcgcggcgcgcgcaggaggaggcggaggcggaggagcgccggctgcaggagcaggaggagctggagaattacatcgagcacgtgctgctccggcgcccgtgactgcccttcccggtcccgcccccgcgcgcccccgccgcgcgcgcgcgccggcgcccccctccgtgttgcccgctccccctcggtgtttgcatgcgccccggccctgccccttggccctgcccctgtccccgggctgcgtcgggacctgccagacccccctcccgggtcctgagcccgaactcccagagctcacccgcgggtgaccgggggccagcccaggagggcgggtggtttgtgcgagttcccttgccacgcggggccccggccccatcaagtccctctggggacgtccccgtcggaaaccggaaaaagcagttccagttaattgtgtgaagtgtgtctgtctccagcccttcgggcctcccacgagcccctccagcctctccaagtcgctgtgaattgaccccttctttcctttctctgttgtaaatacccctcacggaggaaatagttttgctaagaaataaaagtgactattttattagga

SEQ ID NO: 215166 - DNA, 2638 bp, Homo sapiens
aggcggtggaggcgcgggcgctgtccagcgtgctgaagccggagcgagctagccgcccggagccgcgccgacccagctgagcccagcccacgggacgccagacctcgaccgtcgctcctaccccggccaccgctcggagccgaggcggacgcgtcccgatcttcccctgtccccaccctgccccgaccctcctctccacctctcgcgtcgtgacaccagctgtctccggcagcctcttggtcatgaaagccctcagattgtcggcttccgccctcttctgccttctgctgatcaacgggttaggggcagcaccccctggtcgccctgaggcgcagcctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgcacacgctgacccgagtgaatctggagagcccggggccagagcgcgtatggcgcgcttcctggggagagttccaggcgcgtgtcccggagcgcgcgcccctgccgcccccggccccctctcaattccaggcgcgtatgcccgacagcgggccccttcccgaaacccacaagttcggggaaggagtgtcctcccccaaaacacacctaggcgaggcattggcacccctgtccaaggcgtaccaaggcgtggccgccccgttccccaaggcgcgccggccggagagcgcactcctgggcggctccgaggcgggcgagcgccttctccagcaagggctggcgcaggtggaggccgggcggcggcaggcggaggccacgcggcaggccgcggcgcaggaagagcggctggccgacctcgcctcggacctgctgctccagtatttgctgcagggcggggcccggcagcgcggcctcgggggtcgggggctgcaggaggcggcggaggagcgagagagtgcaagggaggaggaggaggcggagcaggagagacgcggcggggaggagagggtgggggaagaggatgaggaggcggccgaggcggaggcagaggcggaggaggcggagagggcgcggcagaacgcgctcctgttcgcggaggaggaggacggggaagccggcgccgaggacaagcgctcccaggaggagacgccgggccaccggcggaaggaggccgaggggacagaggagggcggggaggaggaggacgacgaggagatggatccgcagacgatcgacagcctcattgagctgtccaccaaactccacctgccagcggacgacgtggtcagcatcatcgaggaggtggaggagaagcggaagcggaagaagaacgcccctcccgagcccgtgccgcccccccgtgccgcccccgcccccacccacgtccgctccccgcagcccccgcccccgcccccgtcccgcacgagacgagctgccggactggaacgaggtgctcccgccctgggatcgggaggaggacgaggtgtacccgccagggccgtaccaccctttccccaactacatccggccgcggacactgcagccgccctcggccttgcgccgccgccactaccaccacgccttgccgccttcgcgccactatcccggccgggaggcccaggcgcggcgcgcgcaggaggaggcggaggcggaggagcgccggctgcaggagcaggaggagctggagaattacatcgagcacgtgctgctccggcgcccgtgactgcccttcccggtcccgcccccgcgcgcccccgccgcgcgcgcgcgccggcgcccccctccgtgttgcccgctccccctcggtgtttgcatgcgccccggccctgccccttggccctgcccctgtccccgggctgcgtcgggacctgccagacccccctcccgggtcctgagcccgaactcccagagctcacccgcgggtgaccgggggccagcccaggagggcgggtggtttgtgcgagttcccttgccacgcggggccccggccccatcaagtccctctggggacgtccccgtcggaaaccggaaaaagcagttccagttaattgtgtgaagtgtgtctgtctccagcccttcgggcctcccacgagcccctccagcctctccaagtcgctgtgaattgaccccttctttcctttctctgttgtaaatacccctcacggaggaaatagttttgctaagaaataaaagtgactattttattaggaaaaaaaaaaaagttcaactctcttaactaccttatgtattaaatcaataatgaaaaaatggcg

SEQ ID NO: 215167 - DNA, 2848 bp, Homo sapiens
aggcggtggaggcgcgggcgctgtccagcgtgctgaagccggagcgagctagccgcccggagccgcgccgacccagctgagcccagcccacgggacgccagacctcgaccgtcgctcctaccccggccaccgctcggagccgaggcggacgcgtcccgatcttcccctgtccccaccctgccccgaccctcctctccacctctcgcgtcgtgacaccagctgtctccggcagcctcttggtcatgaaagccctcagattgtcggcttccgccctcttctgccttctgctgatcaacgggttaggggcagcaccccctggtcgccctgaggcgcagcctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgcacacgctgacccgagtgaatctggagagcccggggccagagcgcgtatggcgcgcttcctggggagagttccaggcgcgtgtcccggagcgcgcgcccctgccgcccccggccccctctcaattccaggcgcgtatgcccgacagcgggccccttcccgaaacccacaagttcggggaaggagtgtcctcccccaaaacacacctaggcgaggcattggcacccctgtccaaggcgtaccaaggcgtggccgccccgttccccaaggcgcgccggccggagagcgcactcctgggcggctccgaggcgggcgagcgccttctccagcaagggctggcgcaggtggaggccgggcggcggcaggcggaggccacgcggcaggccgcggcgcaggaagagcggctggccgacctcgcctcggacctgctgctccagtatttgctgcagggcggggcccggcagcgcggcctcgggggtcgggggctgcaggaggcggcggaggagcgagagagtgcaagggaggaggaggaggcggagcaggagagacgcggcggggaggagagggtgggggaagaggatgaggaggcggccgaggcggaggcagaggcggaggaggcggagagggcgcggcagaacgcgctcctgttcgcggaggaggaggacggggaagccggcgccgaggacaagcgctcccaggaggagacgccgggccaccggcggaaggaggccgaggggacagaggagggcggggaggaggaggacgacgaggagatggatccgcagacgatcgacagcctcattgagctgtccaccaaactccacctgccagcggacgacgtggtcagcatcatcgaggaggtggaggagaagcggaagcggaagaagaacgcccctcccgagcccgtgccgcccccccgtgccgcccccgcccccacccacgtccgctccccgcagcccccgcccccgcccccgtcccgcacgagacgagctgccggactggaacgaggtgctcccgccctgggatcgggaggaggacgaggtgtacccgccagggccgtaccaccctttccccaactacatccggccgcggacactgcagccgccctcggccttgcgccgccgccactaccaccacgccttgccgccttcgcgccactatcccggccgggaggcccaggcgcggcgcgcgcaggaggaggcggaggcggaggagcgccggctgcaggagcaggaggagctggagaattacatcgagcacgtgctgctccggcgcccgtgactgcccttcccggtcccgcccccgcgcgcccccgccgcgcgcgcgcgccggcgcccccctccgtgttgcccgctccccctcggtgtttgcatgcgccccggccctgccccttggccctgcccctgtccccgggctgcgtcgggacctgccagacccccctcccgggtcctgagcccgaactcccagagctcacccgcgggtgaccgggggccagcccaggagggcgggtggtttgtgcgagttcccttgccacgcggggccccggccccatcaagtccctctggggacgtccccgtcggaaaccggaaaaagcagttccagttaattgtgtgaagtgtgtctgtctccagcccttcgggcctcccacgagcccctccagcctctccaagtcgctgtgaattgaccccttctttcctttctctgttgtaaatacccctcacggaggaaatagttttgctaagaaataaaagtgactattttattaggactttgttctcggttattcacccgtccccttgggcctgtgtggtccttcccaaggggcggtgagggaagcgccagccacagtccccgtctcctcctgcttcctgcccccaaactaaggcgaggggtaagtggggaaagtcctcaaactgtttttagaggagaagaatgtggctcgcacccattaagaaacccgaaattccacttccagcttgggggctggtggtaaagtcatctttccccagggcttgacagagagaggcccagcggaatgcaa

SEQ ID NO: 215168 - DNA, 2508 bp, Homo sapiens
aggcggtggaggcgcgggcgctgtccagcgtgctgaagccggagcgagctagccgcccggagccgcgccgacccagctgagcccagcccacgggacgccagacctcgaccgtcgctcctaccccggccaccgctcggagccgaggcggacgcgtcccgatcttcccctgtccccaccctgccccgaccctcctctccacctctcgcgtcgtgacaccagctgtctccggcagcctcttggtcatgaaagccctcagattgtcggcttccgccctcttctgccttctgctgatcaacgggttaggggcagcaccccctggtcgccctgaggcgcagcctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgcacacgctgacccgagtgaatctggagagcccggggccagagcgcgtatggcgcgcttcctggggagagttccaggcgcgtgtcccggagcgcgcgcccctgccgcccccggccccctctcaattccaggcgcgtatgcccgacagcgggccccttcccgaaacccacaagttcggggaaggagtgtcctcccccaaaacacacctaggcgaggcattggcacccctgtccaaggcgtaccaaggcgtggccgccccgttccccaaggcgcgccggccggagagcgcactcctgggcggctccgaggcgggcgagcgccttctccagcaagggctggcgcaggtggaggccgggcggcggcaggcggaggccacgcggcaggccgcggcgcaggaagagcggctggccgacctcgcctcggacctgctgctccagtatttgctgcagggcggggcccggcagcgcggcctcgggggtcgggggctgcaggaggcggcggaggagcgagagagtgcaagggaggaggaggaggcggagcaggagagacgcggcggggaggagagggtgggggaagaggatgaggaggcggccgaggcggaggcagaggcggaggaggcggagagggcgcggcagaacgcgctcctgttcgcggaggaggaggacggggaagccggcgccgaggacaagcgctcccaggaggagacgccgggccaccggcggaaggaggccgaggggacagaggagggcggggaggaggaggacgacgaggagatggatccgcagacgatcgacagcctcattgagctgtccaccaaactccacctgccagcggacgacgtggtcagcatcatcgaggaggtggaggagaagcggaagcggaagaagaacgcccctcccgagcccgtgccgcccccccgtgccgcccccgcccccacccacgtccgctccccgcagcccccgcccccgcccccgtcccgcacgagacgagctgccggactggaacgaggtgctcccgccctgggatcgggaggaggacgaggtgtacccgccagggccgtaccaccctttccccaactacatccggccgcggacactgcagccgccctcggccttgcgccgccgccactaccaccacgccttgccgccttcgcgccactatcccggccgggaggcccaggcgcggcgcgcgcaggaggaggcggaggcggaggagcgccggctgcaggagcaggaggagctggagaattacatcgagcacgtgctgctccggcgcccgtgactgcccttcccggtcccgcccccgcgcgcccccgccgcgcgcgcgcgccggcgcccccctccgtgttgcccgctccccctcggtgtttgcatgcgccccggccctgccccttggccctgcccctgtccccgggctgcgtcgggacctgccagacccccctcccgggtcctgagcccgaactcccagagctcacccgcgggtgaccgggggccagcccaggagggcgggtggtttgtgcgagttcccttgccacgcggggccccggccccatcaagtccctctggggacgtccccgtcggaaaccggaaaaagcagttccaagtcgctgtgaattgaccccttctttcctttctctgttgtaaatacccctcacggaggaaatagttttgctaagaaataaaagtgactattttattagga

SEQ ID NO: 215169 - DNA, 1594 bp, Homo sapiens
aggcggtggaggcgcgggcgctgtccagcgtgctgaagccggagcgagctagccgcccggagccgcgccgacccagctgagcccagcccacgggacgccagacctcgaccgtcgctcctaccccggccaccgctcggagccgaggcggacgcgtcccgatcttcccctgtccccaccctgccccgaccctcctctccacctctcgcgtcgtgacaccagctgtctccggcagcctcttggtcatgaaagccctcagattgtcggcttccgccctcttctgccttctgctgatcaacgggttaggggcagcaccccctggtcgccctgaggcgcagcctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgagacgagctgccggactggaacgaggtgctcccgccctgggatcgggaggaggacgaggtgtacccgccagggccgtaccaccctttccccaactacatccggccgcggacactgcagccgccctcggccttgcgccgccgccactaccaccacgccttgccgccttcgcgccactatcccggccgggaggcccaggcgcggcgcgcgcaggaggaggcggaggcggaggagcgccggctgcaggagcaggaggagctggagaattacatcgagcacgtgctgctccggcgcccgtgactgcccttcccggtcccgcccccgcgcgcccccgccgcgcgcgcgcgccggcgcccccctccgtgttgcccgctccccctcggtgtttgcatgcgccccggccctgccccttggccctgcccctgtccccgggctgcgtcgggacctgccagacccccctcccgggtcctgagcccgaactcccagagctcacccgcgggtgaccgggggccagcccaggagggcgggtggtttgtgcgagttcccttgccacgcggggccccggccccatcaagtccctctggggacgtccccgtcggaaaccggaaaaagcagttccagttaattgtgtgaagtgtgtctgtctccagcccttcgggcctcccacgagcccctccagcctctccaagtcgctgtgaattgaccccttctttcctttctctgttgtaaatacccctcacggaggaaatagttttgctaagaaataaaagtgactattttattagga

SEQ ID NO: 215170 - DNA, 2244 bp, Homo sapiens
aggcggtggaggcgcgggcgctgtccagcgtgctgaagccggagcgagctagccgcccggagccgcgccgacccagctgagcccagcccacgggacgccagacctcgaccgtcgctcctaccccggccaccgctcggagccgaggcggacgcgtcccgatcttcccctgtccccaccctgccccgaccctcctctccacctctcgcgtcgtgacaccagctgtctccggcagcctcttggtcatgaaactctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgcacacgctgacccgagtgaatctggagagcccggggccagagcgcgtatggcgcgcttcctggggagagttccaggcgcgtgtcccggagcgcgcgcccctgccgcccccggccccctctcaattccaggcgcgtatgcccgacagcgggccccttcccgaaacccacaagttcggggaaggagtgtcctcccccaaaacacacctaggcgaggcattggcacccctgtccaaggcgtaccaaggcgtggccgccccgttccccaaggcgcgccggccggagagcgcactcctgggcggctccgaggcgggcgagcgccttctccagcaagggctggcgcaggtggaggccgggcggcggcaggcggaggccacgcggcaggccgcggcgcaggaagagcggctggccgacctcgcctcggacctgctgctccagtatttgctgcagggcggggcccggcagcgcggcctcgggggtcgggggctgcaggaggcggcggaggagcgagagagtgcaagggaggaggaggaggcggagcaggagagacgcggcggggaggagagggtgggggaagaggatgaggaggcggccgaggcggaggcagaggcggaggaggcggagagggcgcggcagaacgcgctcctgttcgcggaggaggaggacggggaagccggcgccgaggacaagcgctcccaggaggagacgccgggccaccggcggaaggaggccgaggggacagaggagggcggggaggaggaggacgacgaggagatggatccgcagacgatcgacagcctcattgagctgtccaccaaactccacctgccagcggacgacgtggtcagcatcatcgaggaggtggaggagaagcggaagcggaagaagaacgcccctcccgagcccgtgccgcccccccgtgccgcccccgcccccacccacgtccgctccccgcagcccccgcccccgcccccgtcccgcacgagacgagctgccggactggaacgaggtgctcccgccctgggatcgggaggaggacgaggtgtacccgccagggccgtaccaccctttccccaactacatccggccgcggacactgcagccgccctcggccttgcgccgccgccactaccaccacgccttgccgccttcgcgccactatcccggccgggaggcccaggcgcggcgcgcgcaggaggaggcggaggcggaggagcgccggctgcaggagcaggaggagctggagaattacatcgagcacgtgctgctccggcgcccgtgactgcccttcccggtcccgcccccgcgcgcccccgccgcgcgcgcgcgccggcgcccccctccgtgttgcccgctccccctcggtgtttgcatgcgccccggccctgccccttggccctgcccctgtccccgggctgcgtcgggacctgccagacccccctcccgggtcctgagcccgaactcccagagctcacccgcgggtgaccgggggccagcccaggagggcgggtggtttgtgcgagttcccttgccacgcggggccccggccccatcaagtccctctggggacgtccccgtcggaaaccggaaaaagcagttccagttaattgtgtgaagtgtgtctgtctccagcccttcgggcctcccacgagcccctccagcctctccaagtcgctgtgaattgaccccttctttcctttctctgttgtaaatacccctcacggaggaaatagttttgctaagaaataaaagtgactattttattagga

SEQ ID NO: 215171 - DNA, 1232 bp, Homo sapiens
aggcggtggaggcgcgggcgctgtccagcgtgctgaagccggagcgagctagccgcccggagccgcgccgacccagctgagcccagcccacgggacgccagacctcgaccgtcgctcctaccccggccaccgctcggagccgaggcggacgcgtcccgatcttcccctgtccccaccctgccccgaccctcctctccacctctcgcgtcgtgacaccagctgtctccggcagcctcttggtcatgaaagccctcagattgtcggcttccgccctcttctgccttctgctgatcaacgggttaggggcagcaccccctggtcgccctgaggcgcagcctcctcctctcagctctgagcataaagagccggtagccggggacgcagtgcccgggccaaaggatggcagcgccccagaggtccgaggcgctcggaattccgagccgcaggacgagggagagcttttccagggcgtggatccccgggcgctggccgcggtgctgctgcaggcactcgaccgtcccgcctcacccccggcaccaagcggctcccagcaggggccggaggaagaagcagctgaagctctgctgaccgagaccgtgcgcagccagacccacagcctcccggcgccggagagcccggagcccgcggctccgcctcgccctcagactccggagaatgggcccgaggcgagcgatccctccgaggagctcgaggcgctagcgtccctgctccaggaactgcgagatttcagtccaagtagcgccaagcgccagcaggagacggcggcagcagagacggaaacccgcacgcacacgctgacccgagtgaatctggagagcccggggccagagcgcgtatggcgcgcttcctggggagagttccaggcgcgtgtcccggagcgcgcgcccctgccgcccccggccccctctcaattccaggcgcgtatgccgaaggggccttccgaacacagtcgggagggtgtttccccaaaaactagggagattggaccctgcaagcgtcaggggcgccgtccaagggccgccgaagcaatctgggggccagggagaagcccttcaacagctgcagagcgggcgagggagcaaacgagcgggaaaaaggggcccccagacatatgggaccgcggccgtgggcggggagaaacgaggcgggcgggagaaaaacactgcgatcgccgcgttctatcaatattcttcttcgcaccggaggacaaa

SEQ ID NO: 215172 - DNA, 537 bp, Homo sapiens
atgaatgaacattgacgtcaatggggcggggcgcgcccacgtgaccccgcgcgctcccctttataaggcggtggaggcgcgggcgctgtccagcgtgctgaagccggagcgagctagccgcccggagccgcgccgacccagctgagcccagcccacgggacgccagacctcgaccgtcgctcctaccccggccaccgctcggagccgaggcggacgcgtcccgatcttcccctgtccccaccctgccccgaccctcctctccacctctcgcgtcgtgacaccagctggtaaatactccgctgttcgtccctcaaaccctcggcagccagccgtgggcgtgagggagggttctctctcctctcgatgggggtgttgcaaacacagcggggagccccctggtaagggtccccggtaaacgggggagtcgcagctttttctcttgctgctgaagtcgcccacgcaccatccggggagtcctacggggagggagcagagatttttttttcccccatattgctgctgcttagtacgtgggcg

SEQ ID NO: 215173 - DNA, 607 bp, Homo sapiens
atttcaatgcgatattgaagcttttggtttgatgttccactttggagttaactcctagggttggccccaggccaggttctgaaggggcacccgggtcctcattggctgagaatgttattacttatggtcacatgacctccacaagctgaataaatgtagtgagttctaacgggagacagaattgggaagtaagtataatttttccagacccttgtggcacctttcaacattctcgccccttttgtgttcccctcctttcttagacatcaagtgttcactgtaatgttctctttccaatttcatcccttcaaattttgctgtcaggaaagatttgataagctttcactagaaattttagtgttagtaagatttaacatgttaaccctaaatgggcatttatatttaacaataattacttcaggtcaaaagggtgaatctccacttggagaacctagggcgatagccaggtagtagtgggcgaatatttggggaatgggagaggaaccctcactgccctccattatttcataatgtggctcttattcataaggcagccttgtttatgtgttgctaatttgtctatgatctagaggatttcccttggctt

SEQ ID NO: 215174 - DNA, 362 bp, Homo sapiens
gagtccttgtggacaaacggtaacctacctgaataggtggacgagattgaaaacctaactcaggagtatgtacctgagcacctcaccaacagctgagcgttggccaatttcagcagccatacctcaaccactcatacactcttgagtgtgcaaactgtgtttaaataagacaaacatcagcctgtaaccaatccagctgtttctgtacctcacttctgatttctgtacataatttaaaaaaatgtataaatcttcttcaaccacatggctgcactgaagtctctttcaatctgctgtgattccgggggctgcccaattcatgaatcatccattgctcaattaaactcctttaaatttaattt

SEQ ID NO: 215175 - DNA, 401 bp, Homo sapiens
tatgggtgtgaggcctggctccacccttcctgtggtgggacctggggcacctcaactggccaagcctcaactgcctcacctgtaaaacggagagatggcaataaaaactacttcccaggggctttgtgagacttcagtgagcatgtacatccccgtccggtgcctgtgccccacggtcctgggtggtgcatctcccaccagccctagccggtgcctgtgctgctggccccatgccacatgttgagtagcgagagtttaaaattctttgtttaaggctaggtgcagtggctcatgcctgtaatcccagcaatttgggaggccgaggcaggcggatcacttgaggccaggagtacgagaccagcctggccaacatgactaaatcccgtctgtactaaaaatac

SEQ ID NO: 215176 - DNA, 264 bp, Homo sapiens
ccatagtcctggaggtaccgcgtgaaaatgtgtctcacgatggaggttttaatgtagtaccactgtgtgtaagttccaggcagcccaggacatgcagagagcaaatattgacaccaggaacagaaactttccacatttttgttgactacagcgatgggaactgcagtgaattatttgccttatatagtgtctgtaaagctggaaaagaagtaggtagtttctggtctttgtgtcagtagcataaataaataaacttgaaacatt

SEQ ID NO: 215177 - DNA, 350 bp, Homo sapiens
agagcttctttttgtcataatgaaaatattgtgtatcatatggcagtggctatctgacaatataaatttgcaaaacttattaaactatacagtttaaaatgggtgatttttatatcacaaatttaaatgcttattaaatttaagcttattacacaaaacttatgaaatcatacacttaaaatgggtatagctaatttaaataaagttagttaaaaaacaagagtctatagtgccttcacccttgttttaatatgataaaatttctaaaaatattctaaattagggcttaatctgtaatcttaaaatatcattattttatgatttctttgcttcttttctaaagttgataa

SEQ ID NO: 215178 - DNA, 99 bp, Homo sapiens
atttgttacccaatggtaaataaccaaccaaagctttagttttatagaactccattaggggttgaattgcttcattgggtccctgcattgtgtcttctg

SEQ ID NO: 215179 - DNA, 672 bp, Homo sapiens
ccaacctcctctccattccaacatttacaatgtttaccatttaacacatcttttttcctctagccacaggcctgtttctaaaataccatctataggacacaatcccagaacatgtaatacaaagccctttacaactaacattctttacaatttactttacagctggctgctcctcaaacacatcaaggcccctcacaactcaatctttgttacatgtgtcatctttgacctgtgagttcttgaagatttgtctatttctaatgcactgacatattaatatatttagccatggagtaataacagcactctgaaaacctctaagaatttcatactcgttacttatatactgtattactagtcatgcaccacatacaaaatgtgctaagtttaaaaagtcctcagaaagaccattgaactaaaccagtctttttgaaccaggtttcttgctcaccaagtctccgctgtcataataaagcctgttatcaaacctgccatttattggcagtttctatttcgtgttgcccaaagttctccaaataagaattaaagaggccaggaacgatggctcacatctgtaatcccagcactttgggagggcgaggtgggcagatcacctgaggtcaggagtttgagaccagtctggccaacatggtgaaaccccgtctctactaa

SEQ ID NO: 215180 - DNA, 347 bp, Homo sapiens
gagggggtattccccctctatcctggagaataaagttgctgtgaaacctcttatggctgcaaggaattcagttacagagtttatgactcccagaggcaagatgtttggaggcagcctgggaggaggctcacaggacttctgccagaagaggagtatttacagtgaacctgcctgggatcaggaaacagagactacagaaaaagccaccggcccagccccatagcccagggcagaagtgccaggattcaagttcagatctgcctccctccaatgcccctgttgtttccacctcatcatgctgactctgtgaaggctgacactgcagaaataaaagtcacaaggtgaaa

SEQ ID NO: 215181 - DNA, 367 bp, Homo sapiens
ttctgtggagtcttaattaggcaaaaggaatcaggctggcaggacgaggagaaaccgaaaagaaaaagcagataagctccaagtctgcctttcttcatggtccaggacacacagccctcctgcacaaataactcacaatcttcctgtgcccacctatcaccagacacctgcatgctagctcactgcaaccatagtgttatcggtattgcacaaaaccctcttcagcacacagcataaacactatcctataaaatctcaagcaagcctttgtttcttggcagtcagcttctcttctgctgatcctgcctatgggcaacatatcttcctactttctctaataaatctgcctttatttacctacaattgt

SEQ ID NO: 215182 - DNA, 681 bp, Homo sapiens
ggctcagttgagtacctatacttttcgttttttgattgggtttaggtggttatgtcaaagttaaatggcaaaattaggaatttaacccaggtctggctggttcctttacaatacactgctttcttaagtacaaataatttaattgcaatatttaggaaaagtaggtacctttgaataatgataagaaacagtcttggttaagaatatgagttccctcttcaaaatgtaaggggtggcaaaatgtaaacactgcttcctattactgtgcaagtttttttatgtcaactttactatttcatgtttgttgtggagattacaaaatatagcttagcaaaaggaaacaatctcacttgaaggatatgttaaataatttaatgatattttaaagattttcttttttagttaaactttcctatgattctcttaatgttttttctgaatacaaaagtaataaatatttattgagtaaaacacacacaccccaaataaaaattgcctgtaaggccactatctagagaaaactattcttaacatcttgtggcatagtgactatgtatgtaaatgtattttattttattaaaaaagcgttgtatcatacatactctttgataacctgatttttaaacttatatttggtacaaagagctccacattaataaatacaatattctatcaaaaaga

SEQ ID NO: 215183 - DNA, 298 bp, Homo sapiens
gaggtgtggggaaggggtcgttttgaaggtggacctagagctggatgaaaggcagaaggtaggggagaggcaagacgatggctactaaatttctggcccagcatctgggtaaatggctgccgtctgggaatcaggagagtagcatttgggacgtccatgtagagcaggtagtgacctggagcacaggagcgtgtgctagagccatcgagttaggaattgttggcacagagatggcttgggaggccccagaagatatccacagccgagtccctggaacccgtgaaggttacttaccttc

SEQ ID NO: 215184 - DNA, 354 bp, Homo sapiens
actctaaaaacattatttattagatgctgtctttaggacagtgtttttgagagagcattagatgtggattccagcttggggtcggggagtagggtttctccccttgcaaatcctccacccgagcatttgagggtttaaattttccagtttgatctaatgcgaacataaaagcactgcgacaatcttgggctgattttaattacgaacacaggcaatacgctgagagcacagctggtgtgtggccctaaccagcttcccagaagagagtggcgctatcagaaatgacaataatagaccaggtttttaaaaccatttacatgcaagttgcaaaattcccctccatagtttggggat

SEQ ID NO: 215185 - DNA, 243 bp, Homo sapiens
atttgtgtcacccagatcctggtaccaaaaaaaaagctatcaaggaaagaaatggcaacaccagctaggcgttaaagatgcagtcactggctcactcccggctctaagcgtgcccagcaccagctgcagctcggctctgctgaattcctaggtgttcacacaggcaggcgtattcacccagaaagctcaggccaaactccaaactctagacacctttgctcttgtcacacagcccagtccgga

SEQ ID NO: 215186 - DNA, 527 bp, Homo sapiens
gcacacagtttataaatttgaattagttgcaaatattttaaacattgagaactttcaataaatatcctacttttcagtaggacatttatcttaagaattagcagacctggcaaaacaatatgctttctgtgtggcaacagtttcctgacctgagtagcagctatgccctttgcctattcgccacaatccctgcaactccctgttgtccctgcttcactcatttgttatgtgcctttaattcttgtaggcatttgagtttgtgaactcctctctgggttatgtcactttgatttatttttctttgtagcaaccacttctgactgtataaaaatcaccaaaaatattataatatctgttctaacagatcctgttaatatactgccaaatatagtttttcaagtttttatgtttttacaattgctaaatggcaccattagaaatggttaagttttagagaatgcatggttgaaaagtaatatgttgttatgttgttttaacctaattcctgagagtaaaggatttcatgg

SEQ ID NO: 215187 - DNA, 468 bp, Homo sapiens
caggtggaattttgatagaattgtgttgaaactgaacatgggatgtctttctatttatatagttatttaatttctttttttttaatcaattgagtaccaaaatagactttaatttcttttaagaatgttttgtagtttttatggtatgttttgtattacttttgttaaacttacacctaagtgttttattctcttggatgcttcagaaatggagttattttcttaatttcatttttggattgttcattgttattgtatagaaatgcaattaattttggcgtattgattttgtaccctgcaaccttgttgcacttgtttacttaattattataaaacattactattaataaaatcttaagtattaaactgctatgtaaactgttgtatattttcaagtctcctgttgacttatcttgtatctagttgttgtattcattattgacatggagtattaaaagtctcccaacc

SEQ ID NO: 215188 - DNA, 430 bp, Homo sapiens
tccatctttttgctcttccattctcagtgtttcggttgagctcccttccaaggtgtagcctggctgctccagtgtccgacactgtatacagacatgacagtgtccagcctaataagatgataggagtggtccacccatatggaaaaaataattcatcactgcattattgaaaattgttgatacccagtaatgataaagagccatctgactcccagctggttccattatttcaaaattctccctacccctaccctgagtggacacctcctagcctccctgcatccaaacatcttccaacaccgtttctgagtcagactacctggatttgaattccacctctgtcctctgtaagtgatgttcttaaaaagacacttaatttttttgagttttaatgtcctcatctaaaaataaagatcataaatacctccct

SEQ ID NO: 215189 - DNA, 332 bp, Homo sapiens
atttccgttcctttggtagcgggggtgggttaatgggagactacagtcggccatgttcacacaatgtctgaaggccacttattttgagaaatgtgatctcaaagccgcctcttcaacaaagttcaatgtttgtaacagactaaagacacctgcaggccatccctcaaatcctgcgccagtgagcctaggttcagtgacctgaaatcatcatcgaacccaactgtcagtttcagaggccctaaaagtaggaagccagaagcctagtgctcagcccagctccttaggctatttctggaaagttctggacacagctgaaattaaccacactagcc

SEQ ID NO: 215190 - DNA, 364 bp, Homo sapiens
caaggcaagtcacccttcttccgaggcacagtttcttcacctgtaaaatgaagggactgggcaagacggtttctaaagttcctagggccaggtgcagtggctcacgcctatcttcacaatactttgggaggctgatgcagaaggatcactggagctccctcaagaccagcctggggaacacaggaagaaccttgtctctacaaaaaattaaaaatattagctggacatggtggcaggacctgtggttccagctactcaggaggctgagtggggaggatattttgaacctgggaggtcgaggctgcagtgagctgtgatcacaccactgcacttcagcctgggcaataaataaataaacaagtaa

SEQ ID NO: 215191 - DNA, 391 bp, Homo sapiens
attctacaaacttcacctactggaattgaacaacatgaactagtagacacttctctcatttgaaaagaataaaggtgacaaagaaagaattcccaagtcaatgcagacaactttcctaaaactcagggtgagaagaattgagggctattttctcctcagttttctactggttcaaacagatgaagctacactaaaaatttctatcttttaaggctgttaatagatgaactttcatactgtagatagaaaagagagatgtcttgtctgaaggtgaagctaacagcattaggaaaggattattctactttatacacggttcctattatacaaaatcctgagagtttttttgttgctagtttttctttttccttttttttttttttgagatgag

SEQ ID NO: 215192 - DNA, 477 bp, Homo sapiens
ccatgttggcttttgcattatacagctgtcgcttccccctgggtggagtgcatgtgcctctgtgacacctgttccctcattaccttgctgtgacatcggatgacagtttgtggactgttgggaaaaggtgctatataggaggactctgattccctaggaaccaacccctgtggagtaggtgatactgcggttcacagaggttgggggatttgccaagtagacacaccttggtcatcatgggtcagaatctgggtatgtctgccccaaagaccacgggcttctgctggagtgaagggccgcaaggagctccagcccagagcagagggacatggaggagattaagccaaattgtgtgtgtgtgcatgcatgtttctgtgtgtgcatgtgtacacgtctgtgtgtgtgcatgtgtacacatgtctgtgtgcatgtgtaaatgtgtgtgcacatgtacaaataaacacattgatcaacgta

SEQ ID NO: 215193 - DNA, 450 bp, Homo sapiens
caacagcagggctggggagctctgcctgagcgtagggaagcgggaggggacctgttcttgtcactggtgcgtggtgtcctcatcagaaaagtacagggagctgaggcaaggcctgtttctgagagctggggatagagctagatgattaactttatgattttctaagtgttttcccacacatagtctcatttgaagttcccagagaccttgaggggtggtcagggcagctattgtaatctgaatttagcaagtaatgaaactgagatgccgagaactgaagcaatgtgccgtctgtcagctgagaagcaaaggagacatttagaacccaagcctctggactgatgtccctagaccacggctgatgaattaggaacagaccccacgttcctcagtagaaatgcttctctgatatggccactcatgctttgaattaaatatgtccttccaatc

SEQ ID NO: 215194 - DNA, 476 bp, Homo sapiens
aatgaaagtcccagtgacaaactgcacaactgatgagcttctctgtgcaagggtgcctttttggagcaatgtccccattcggtccattgatatgaaccacttcattgaatgtcttagacggaaagaagactgaataatgattggaagaacgccggagtcatcaagctcttttgataactgcatatgtgaactaggtcaagtcactctccctcaacggatcaccagtttacccaactgtaaatggcaacaattttgaactgaacgttcttccttctacagccaaaattcttcgtttgctaggtttgtgaagtgcttttatatgtatgagcgctttcttaactatgaagatatctgagtcatcgaacttttggtgggggcaatctcatgatcagtcatgactagattttagagttttctcatccccatactcaaagttttttttttaagaataaaaatgaaaagaaacaataaaaaaa

SEQ ID NO: 215195 - DNA, 447 bp, Homo sapiens
aatagtttcagaaagaatggtaccagctcctcctcgtacctctggtagaattctgctgtgaatccatctggtcctggactttttttggttggaaagaagactgaataatgattggaagaacgccggagtcatcaagctcttttgataactgcatatgtgaactaggtcaagtcactctccctcaacggatcaccagtttacccaactgtaaatggcaacaattttgaactgaacgttcttccttctacagccaaaattcttcgtttgctaggtttgtgaagtgcttttatatgtatgagcgctttcttaactatgaagatatctgagtcatcgaacttttggtgggggcaatctcatgatcagtcatgactagattttagagttttctcatccccatactcaaagttttttttttaagaataaaaatgaaaagaaacaataaaaaaa

SEQ ID NO: 215196 - DNA, 451 bp, Homo sapiens
tcccacccgatctcatctcgcactattgtgggaaacctgtgaaccacctccagccctttgctggatataaacgaccaagtacaaacccttctctgagccgttgtgccagcacctccaacgctcttcccaacgctgaccactgggtgctggcccaggcccatgtaagaaagaacacttggattctgtggggccgtgggaggtggaggataacatttggagagtgccagcggtcagcagggctctgtgccaagtgtcttatatttggagtctgggtcagggccctgatttatcactgcatgtatggcttggccctggaggactgttcacacagccttgatgtagattttcatcacactccccaagtgagggaaacttgcggccatacttgtgtgtgttctatgtaaaatgtgataaatgttaaatatactgcaaatctggtaaccgtgtttta

SEQ ID NO: 215197 - DNA, 547 bp, Homo sapiens
  misc_feature (58)..(59): n is a, c, g, or t
  misc_feature (62)..(62): n is a, c, g, or t
  misc_feature (86)..(86): n is a, c, g, or t
  misc_feature (99)..(99): n is a, c, g, or t
  misc_feature (119)..(119): n is a, c, g, or t
ctgtggaccccactatcgctaagaaaccctcaataaaatactggcaaccaaatccacnnttnatcaaaaagcttatccagcacgancaagtgggctttntccctaggatgcaaggctgnctcaacatatacaaatcaataaacataatccagcatataaacagaaccaaagacaaaaaccacatagactgaaaaggatggaaaaagatattccatgccaatggaaaccaaaaaagagcaggagtagatatacttatatgagacaaaatagatttcaacaccacgcccagctaagttttgtatgttttgtagagacaggattttgccatgttgtccaggctgatgtcgagttcttgggctcaagcaatccttctgccttggcctcccatagtactgagattacaggtgtgagccactgtgccccgcctacgtggaattgttttatatgagaacagaggttctaccatcattcagtgatagcagggctgaaatatatttcaggcagactagtgtgatatattagaaaatgagtgtttcttagcgatagt

SEQ ID NO: 215198 - DNA, 454 bp, Homo sapiens
ggaagattattgagcttcataaatagcctagtcaggtacctagcacatagtagtttttcataaatgatagtttttcataaatgatagctattattattattaaccattatcactagccaaacaagaaatagcatagcagcatagccagagctaaacaatcatgccaagagaaggaaaggtagtcattatcctgcaatggaactagtcagagaaagtttcttggtggaggtgagccatggaggagatgcgactcgaagcagaaaggtaaggatctagggtgaaaaatacttgtattcccttattaacaaccttggtttcaggcctcaaagaccatccttttgaaaggccaaatgtggtcatatcgcacaccaaactgttcgcaaaagtagttatggaaaatttttctgctaagactctaaattaagcatttaaaaaaggaaaacaaacaagaatc

SEQ ID NO: 215199 - DNA, 335 bp, Homo sapiens
gagacaggtttttgccatgttggccaggctggtcttgaactcctgacctcaggtgatccacccgcctcggcctccgaaagtgctgggattacaggtgtgagccgccgtgcccggccagttgtcttttttatgactagtgggttcaggtgttggcagcctgacttcttccttttaaagttccccatcagttttttcctaatgactttagtaagaagtgattatagtgtagatgggctctgtatggttttgtttgtttgtttgttgttttgagacacagggtttctcagaaagagtacagtggcatcatcatagctcattgcagcctcgacttccca

SEQ ID NO: 215200 - DNA, 406 bp, Homo sapiens
tggagatgaggtctcactatgttgcccaaactggcttcaaacttctggactccagcaatcctcctgcctcagccttccaagtagctaggactacaggtggaaatctcaaacttttgtttgagggtaataggaagatattttttgatttgtttcctgtagtctctgtataatgctgaaccaggctaactgcttttcaaggaatcctttccctatataggttaatggcatattcatatgctgattattcaaattaaaacctccaaaacttctttaactccctcctttcctgcacacccaaatacaattaatctcaagaactatcaactttaccttttaaacattttgaaaattcttccaccctctctattatcattgtctttgttcaaacctatctttgaagtcttct

SEQ ID NO: 215201 - DNA, 473 bp, Homo sapiens
tatgctccagacacgttccttctttgagatttgaccaagtctttctctctggcttgagaatgccgtccctgtgctttgcgtacttcttataacagcacctatcccgtattgctgcacaggtgccccttgagctactgtcttcagccttgagttttccagaatgatggtgtctgaggattgtccactgacaggcacctgaagggctttcctgggttggcatgctgccctccccatctccccattcctggaggggctgtggaaaaaagcaccggaacctgaactgcaggctccatgagatgggtacctggccggtcatgtgtactcctgtgtccaacccccaacacaatgcctgaccactgcagacgcacaagaaatagcactgaatgaatgaatgaatgagaagttagtgttgctctccaggtcacactgttatttcttgctatttaaaagtaaaatcagcagcctcttttttg

SEQ ID NO: 215202 - DNA, 180 bp, Homo sapiens
taacttatgaaaaatggagggggaagtatctctgaaactgaatagaaacagaaacaaatggagttaattttggtgggtaataactgggtgggggcatataggaaattttggggtgatgataatgttctgtatcttggatctggatggtgggtacttgggtatgttaactttacgcttatg

SEQ ID NO: 215203 - DNA, 454 bp, Homo sapiens
aatgagatctctatcctacttttacatttatttactctaatgagtttgtctaatgcttaacattttttaacaaatgcagtgttttataggataaagaaattaaaaaaatttttttgttgtttgaagactttttgtaccttgtttagtggttgagcattaaccaccatgttcttcagaagagaattctgctgtaacatgttttatacttccttgaaaaaatatagaaaggagaatacagaacagagcgaaggaaaaataaaaatcacatatattgctgctacctaaagataacctctgttaatatttttatacttgtcccttatttaggtatgtagatacatacgtgtgtgtaggtagattggttttgatttagggcatgtgttttctactgttctgcaatctgcgtttctcaaaactattacttgtatttcaaggaatgagtaaatacgtaagt

SEQ ID NO: 215204 - DNA, 478 bp, Homo sapiens
agacttcagtgctaaaaccagggaagtcctgggctccatgacagtggctcaccctatcagaaggccacgtcaaagagaactataataataagccctggggggcaggatgtgtgaaccaattgcctaggtgttagcacatgccagaaggtactttggaatggaaagaggtgagagtgtctcaaggtttaaaaatgagcaagtgtagcccctcttttgtagctcactcatcccaccttctcagggtgttgaaatgcaaatgcaaaaaggctgaaaccctgtttctttctactcagtgccctaatattatatactaccttgaattgtgcttcgtctttttatgcatgtgtcctgttagtctaattagattgtaagctccttgagggcagagactctttctcctttgtctctgcagcctatacctagtatagtgccttgcacacaataggtgctcaataaatgtctgttgttgatcatgacc

SEQ ID NO: 215205 - DNA, 346 bp, Homo sapiens
actttgggaggccgaggaggatggatcacctgaggtcaggagttcagaccagcctgaccaacatggtgaaaccccgactctactaaattaaaaaaaaaaaattagccgggcatggtggtgcatgcctgtaatttcagctatttgggaggctgaggcaggagaatctcttgaacccaggaggcagaggttgcagtgagctgagattgcgccattgcactccagccttggcaacagagcaaaactctgtctcaaaaataaaaaaaataccccaccctctgctaattcagtagatctagtctaggacccaggaatttgcatttctaactagttctcaggtaatgctgat

SEQ ID NO: 215206 - DNA, 536 bp, Homo sapiens
atagacaaatagatgacagatgaggaaatgaatacatactaaacaaatgtatatttcccagctctgtccactcagagcatctggaagcagtgacaaaccagtagcatagggtacacccaggtccatgtttggtttctgataccattctacaatgaaatgaaccaaggctccttggagaaagggcttgatttctaatgctgatacaaggaaaatgcaagataagcctggaacatcttgtaatgtcagaaaataaagaagtgctaaaaaaataaaaatgaaacgaagaggaaggcaagttcagcctgcaagacctgaaagagggtcaacaggaaagagctcataatggccaaacctggaacaatttgagcaacaaaacaagaaatactggatcggaaccccaagaataaaataaatatccacgagtctaatctgataaataaatgattaaataaataaagcatccttacagtgcttttccaaaaaaattgtaggtatgcccccaaaacttctatacttaagaaaacaacccaatagaa

SEQ ID NO: 215207 - DNA, 423 bp, Homo sapiens
tagtcatcaaaaacagcaagatgctagaacaaaggaactggataatccacagaatatattgcagtccaaaagggaatgcagcctaattagatatggatttatgatgctgtgaatttcctttttgcttttttgattatttatttttaagaccaggactctctctgtcacccaggctggaatgtagtgcatgatcccagctcactgcagcctcgacttcccaggctcaagcagtgctcccacctcagtctctcatgtagctgaaactacaggtgtgcgccaccacacccagctaattttttttatttttagtagagacaaggtctcgctgtgtttcgcaggctggtctcgaactcctgaggtgggtggatcgcttgaggccgcgagtttgagaccagcctggccagtggtgccccgtctctactt

SEQ ID NO: 215208 - DNA, 396 bp, Homo sapiens
tgaccacattccttttaatataagttcttattttatgctggatcctacaactgatttcttggcttccaagtagtcgccggtccatatattccagaattctgccatgcaatcatttggtctatatctctccccataaaacattacaccagttcctaagatcctatatagcatgtcactacttagtaccattttaattcccaattatagttaactcccccgcctcccggcaactacaagaaattatctcagttaaatgactattaccaaaggattctttggtggttgtaccataagtcatctattgcatgggactctaaagcattttcatcttacaatgatttttctataatggtatctgccctataactaaaaatacttccaaattttcttttttat

SEQ ID NO: 215209 - DNA, 433 bp, Homo sapiens
ggcatgcctagctgaaagccgatgcaccgaggcctgctccatgctaaggctgtaattcttcaccccaagaatcttcattctggtcttcaagtattcaagcaatctggtttccaatcccagcgtctgtgtaagaggacactaccaaagtgaatgaaggcagagagtgagagcaaattggagtcactgctgccatcaacctgcctctgcctgcactaccaaagtgaatggagacacagagtgagagcaaattggagtcactgctgccatcaacctgcctctgcctgcactacctcatgagctgttctttcagcactccctcctgcatatccgtagagcaccacttcctgatttctagagctgggttgtatttgcgaatatttcaacagcctttgcctaattcctgataacaaaataaaggtacatttatgaaaat

SEQ ID NO: 215210 - DNA, 590 bp, Homo sapiens
gaaatacagagaatttacaagaaacaattgacatttattgagattgaacttgtactatattcaagataccatttgagacatttcacaaaggaacagtgtgaaataagacacggcaccagtcatatatatatataatttcttcaaagcatcagtcatggcctgtgtggtttggggaacctggagctactctgtcccccagactgggtgcccttgtgggggctgtggagcctctaggatttcatagagcagactttgcaaacctgctggttctaatctcacccactcagttttcagtgtagtcggggaaaggtgagttgtacatgagacaatgtcattattaacaggaaaaacccaagtggcaggagcaatagttgttgttggagaaatgctgcctccacattttgattttctgtctttttcttatctacttgctacttgatggtacttggtaccatattcacaacgaatttgtgaattctaggaggaaactaaaattaggagaatgtccctgaattttttcttcctttgtctctgaaaatgctaaactgaaaagtataactaaattgaagaaaagctcaaagagaaatcaa

SEQ ID NO: 215211 - DNA, 247 bp, Homo sapiens
ggccttgggcctacttaactaaaatgacctaaaaaatcagtgaaaaatcaaggctgggtctttgcttgataaggtagcatccacacaccttggctcttgtccatggcagtcaaaatattctatttagatgagaaaagagctgtacattagggtaactgctaggtttcctgagatgaagacgttgtacctgctatgtctcctgctcatattccttacatgaatctaaataaaaatagtattgaagcca

SEQ ID NO: 215212 - DNA, 602 bp, Homo sapiens
gaggcggttgactagaggaaacactttaaaaaaccatccagtagaatgcttgctcattcctaaggacccacttcctggcccctcaactgcttctgatatttttttctcacctaaaaaaataaaacacacaaaacacagaattgtaggtggagagtaaaggcaagctgttgtttgttgttgctgttaatagctgatatagatattctggcgctgctactgtgctgcttagatatcctgaacacattattttttcagtgtattaatggtatgctatattttttactgttaagaacttatgtgtgaattcgtgtaagagaatggttgctgttggtagcatataaattcagtgtcaggaatgatgatgataacaaacacagattgtccacatgggttgagctagtgacacctttgctttctgatacttcaatgagtataaactttgtttcatgcacaaaattatttaaaatattacataaaattactttcagggggtatatagaaggtttatatgaaacataaataaattttgtgtttaaacttgggtcccattcccaagatacctcattttatacgcagatattctgaaatgtgaaagacttctg

SEQ ID NO: 215213 - DNA, 343 bp, Homo sapiens
acagactgctgataaaatgatgccatcaaagaaaggccaattgaagattgcttgtattatcctcttttttcattggtcctaaaaccttttatcacattttaacatctctgaatttgggatgcatcttaagaattaatagcatattatagattatttagcaacgttttttctcttaattatacttttagttgcataactcttaaggggacataattcttactagcaacccctggagttgtgctgtgtatacactgagtgcccttatggggcagccctcatagcgataaggtggacattcattgtttttcctaccttttaacctcatatttgacctcacaaattg

SEQ ID NO: 215214 - DNA, 228 bp, Homo sapiens
ttacttaggccacgatatttctgggtctctttgttacagcagcttagtatttatcctagccaattacatctcccacagaaaggacagggagttttgcttgtatttttaacatctataagggttcctggcacacagctggtgcctgataaatatgtgttaaatgacggaatgaatgaatgtctatgaaataaaaggaaaaatcccaagtattccagaaagatgacttaa

SEQ ID NO: 215215 - DNA, 460 bp, Homo sapiens
gaaaagggtctgacttcttactattgcatatgacttactgatataaaatatattttgctttccattgtagtagagaagagacaagctccgaaggcccctgaacatgcctgtatattattactgagtgtgccagactgcaagccgtatccatctcctgatgctaagcagtttctgtagttagtcatataggcacctaagtaggtcaaggcaatcacagcattactaccatttaactgctgctccctgggggagagagactagcttgtttgttgtttgctcaaaaactgcttgattcttgatcctggattcttctgtaatgcaaccccccatgtgcacagacgtcatccggccctctgcatcacactgtgggaattgggctacgggaactgatgcaaatatgcggacactctggcttctattttgctgtaataaagctgttttgtcttttacccaggaaaat

SEQ ID NO: 215216 - DNA, 142 bp, Homo sapiens
tggtagagatagggtcttgctatgtagcccaggttggtctcgaactcctgggctcaagcgagcctcccacctcgtcctctaggagtgagccagtgagacccggcctcaagcccctctgagataccccttctgtcgtcttctc

SEQ ID NO: 215217 - DNA, 388 bp, Homo sapiens
gaactatttctaacatatgcaaagtaaacagaatagtgtaagaaaccacccaggtttaataaggaccaacattctgctattcttgttccgcccccaccttttcggaatcattcctaacagaaaatttcacgattttccctgttttcagtctgtcaatcttgtaccagaatagggtcaatgattttaactgctttcttccaccaggtaagaagagtcatttttgtgagaagaagtaacacccagacatgtctgcaaagactgaaaacatcagctgggttttgggcaggaacaaaagcaattagttttctaagaaatcctaatgacttaattataaacatcagacccttcatgcctgctcaatcggctctttgtcccattacagtgtcct

SEQ ID NO: 215218 - DNA, 390 bp, Homo sapiens
gacagcaagattctgttttagaatcgatttctaaaggttttctgaaatctccaaacttgtaaccttcaggctagatggctcagacctcagcattgagtcctaatgctcaccctgagttgagtgtggcagagatgctgatgtttatacagaagactgagacctttcctcatgcagaattcatcctacctccaaaaaattccttccacatttttccagttctgaatagaaaggaaaaaatatgcacactcctagggagtgctgcttaggcccccacttccataccccacatggaggaagatgcttagaaggaagaggtgggcttcctcctggcacagttccaattttcctttagatcagctgtttctgggtttaggcaaagagaacaaagtg

SEQ ID NO: 215219 - DNA, 1227 bp, Homo sapiens
actggtcatttgtttgcttccagtttttggcaatgatgaataaaacagctataaatatttgaatacaggtttttgtgtaagcataggttttcatttcttttgggtaaatacctcagagtggtattgtattgctgcactggatgctaagtgaatgtttaacctcatgagaaactgccaaactgtttttcaaagtgattgtaccatttgtcattttccccaacaatgtgtgagaattgcatttgctcaaggtcatcgtcagcatgtggtattgtcagttttttggtttgggtttttaaccattctaatagcagtgtagcaatgtgtactgtggcttaaatttgcatttccctaatgactaatgatgttaagcatcttttcatgtgtttaattgtcatcctatattttgtttggtgaagtgtctcccaaaatcttttgcccatttttaaaactggagtgtttgttttattattattgggttttaagggttctttgcatattatggatacaagtcctttttcacatgtatatcatcaaactattttctccagtctgtggcttgtcttcattttttaagaatgttttctgggctgggtgggcagctcacgcttgtaatcccagcactttgggaggccgaggcaggcggatcaccaggtcaggagttcaagaccagcctggccaacatagtgaaaccccgtctctacgaaaaaacaaaaaaattagctgggcgtggtggtgggcgcctgtaatcccaattcttggcaggttcggccggaaaatgttgacaccccttagagagttcatttgcccaattggcctttggattcaacccatgcaccgtggacactttttccaaaaatccttctactcctacaacagtgggcctctttcccacgttttaacctgacagtttactttgccccatctgctacttgccacctcccctagggaggcttaaatcatggcgcgtttcctcgtcgtaaacctgtgtccacattatatcttggggaatacttcttccctggtatcacaaaggccccccattccttctacgttctctctcttacctctcactgtgggtcatattgccatctcatcaattctcatgccttcttacacacgtcgacgtctctcccttaacactatctctgcctcgtgtctattctcacacacttctctcagcgcgctctcgtcgtgtcctctctgcgcgcctctcctcctctctcttct

SEQ ID NO: 215220 - DNA, 814 bp, Homo sapiens
agaaaagaaaagaagaaaaggagctatttaagaccttctcgtaataaccaacatttctcctttagagcttttacttttggctaccctgacttgacttagtaaacactattttattgtaaggatgattcttaaaacaacagtggaatgctatcatttctgtcttctggtgaggttaattattggcgcacacagcataacagagttagagctcaaatccaggttttctgaggccagactcagtcgccttcccactatgctgtgatgaggggctgacagcatgcttcaggtctgtcttaaaagacagggagaggccacataagttctgtgttcacagagctggagccccctgcttggtggtgggcagcgagaggaaaggatgcaagctttccagccaacaaccctgctcaggattcctggcagccctgccctaggcaggttatgaaaactctatgagcatacacttaggaatctgtaagctgaggctgattatagccaccttaggaagttgtggggacaattatgagaagacaaatatgaacctcccagcacaacgttccagtatactgataaatagatgctgcatatccagtttctcttgctgtaatcattctgttacttaatgcagaatctcatttccatcccagagcttctcgatcagggcttgttacagaaaacggagcacctataatcccagcacattgggaggccaaggtgggcagatcacctgaggccaggagttgaagaccagccttgccaacatggcgaaaccctgtctctactaaaaatacaaaaactatccaggcacagtggcgcg

SEQ ID NO: 215221 - DNA, 523 bp, Homo sapiens
  misc_feature (4)..(4): n is a, c, g, or t
  misc_feature (6)..(6): n is a, c, g, or t
  misc_feature (25)..(25): n is a, c, g, or t
  misc_feature (47)..(47): n is a, c, g, or t
tttnancccccttgcctgcagcccnctctagaggatccccccttccncatctcatttctcacagttaatagttttacatttcaccctcttctctgggttacagaggaaaactgagtgagaacaaaaataaaaaggtgtgtgtaaaagtcacggtgtgggagagaaagtgaaagtgtgggggagagaggtcaagtaaaagtatgtgtaagaaagaaaatgaaagtgcaagagagagaatgtaaaactattaactgtgagaatgaagtaaacatggatataagagagaaggtaaaagtcagtgacagagaaaaagaaaaagtgttgggggaaaggagaaaggaagacagcatgcatgagaggaaaagcaaaaatggcttagagaaaagaaaaatggtcagtaagaaggaaagtaaatgtgagtggaagggggagatagaaggtaaaaatgagagagagtgaaaatgggctgagagaaagtaaatgcatatgtgggagaaagaaaggaaaaatgtgtggagaagaa

SEQ ID NO: 215222 - DNA, 392 bp, Homo sapiens
acgggaagaacagactggatgtgtgccaaaagtggcaaggtttacttgaaacatttttgacatcacgtaccttagactgaagagtgcagagggaaagaaaggagaaacgtctgatgatgccatattcatgacagactcatattttagtgactgcagctgctttacctacttacagcttttgcctccattctgtcctctgttcttctcttgggagttttagcattggactgggaatatagagatttatattctatttctatcaaaactaacttgtgctgggcatggtggctcatgcctgtaatcctagccctttaggaagccaaaacgggaggattgcttgagctcaggagttcgagaccagcctgggcaacatagggagaccctgtctgtac

SEQ ID NO: 215223 - DNA, 449 bp, Homo sapiens
agtgaaggccaaaaactacagtgatatgttcacaccttgatcactctgtcgtctatacagacagctattgacatatttgttgcattgacgaagctaacatcatctgactgtatcgtgggtctggttatccatttgtgccctagaatcctgggtcacctcagttgaaagtgaccaaggccaaatatttcgtcccatgcttcccagggacaacataatcatatcccctgtctttgaaaaacccaatctgaaactgtgtcactaacctccaaattaaagaatccgagcatggaagctctagaacgtatggtccagtgtggcagccactataatatctaagtgtaaaatacatagcagttgcaaagacttagtacaaaaagaatggaaatgtattaacagttttttatattgattacatgttgaaatgatattttggtttaaataaaatatta

SEQ ID NO: 215224 - DNA, 660 bp, Homo sapiens
gcatgagtgagtgctattcattttaagaagcactcaagcactgtgaaaattagcagtggaacatggttccaaatgaaagtgacaccatgagcctaatgagaaattgaataccatctatttatctcctctagcccaagatctttctcttctgtcatttgaatgtttctgaaacgccttttcttcctgggctgagaagtgcctcatgccttcttcccctgcctctctggaaatgagagtccttgtgctgttttcctttctacgctcatgaagagtcctgctaggtgcatggaaactttgctttctgtttacatgtgcttctctgtcttgctaactcgttgtcctaagttttaggtgtgatagctgtagtggttttcatgaagccaaatcgtaaaggtctgagaaatacacactgtgtgttgcttggcttgtcttagagcaaaccaaaatttggaaaattgtctgggaagggtaagatcacttagctgtgaagcctctgcttttaggaactggagaagtgatttgagggtgaaaatagggtaagcgtatttactctttagctccttaaggaatgcttcttcaccttcttcaactcactgagtttgtgtttgaaaaatattccaaagcctttgcttaaaaataatgtattatataatatccttc

SEQ ID NO: 215225 - DNA, 289 bp, Homo sapiens
ctgcctgccttcctcagaggcaagagttaggtccacatttcctggcacgcagctctgggtaattcacaattccgaagctgcccctagagagaccagcctatgttggccagggcaagtccttctgtgattgctctctgccctcttggggcctacatgtccattgggcatgctgggcacagtgcatggggcccatgatactgttaggggcctgcaaaagtgttttaattttgatttattttaaaatcagaggaaaaccacaaataaacgataatgaatgtataataatgaa

SEQ ID NO: 215226 - DNA, 450 bp, Homo sapiens
aagccagggtgtttctagaaaaagagattctacacccttacaagcatatcacttctctgagctggaagcctttgcccaactaagtttcagtatcatcagctctcctggaggctgtccgatttggctgagaaaaagctagatgttgatagagaccctttgcagaaaagcaggcaaacaagtatattggacacataaccaataattttgctcatgaatttgaaaaatagaacttttactgctgattatctttttcaagatttgacattacaagatttgacatcttttgggaaagtgtttccttttcataaaaaaattcagcctggcgacagagcgagactgcaatctaaaaaaaaaaagtcagaacttgaacctaagtcttctaatgctaaattccattaatgcctctaattctgagagtctcttattattgtctgccctgaccggcgtggt

SEQ ID NO: 215227 - DNA, 390 bp, Homo sapiens
ggtcaaggctgcagtgaattgtattcatgccactacactccagcctgggtgacagattgagactctgtctcaaaaaaaaaaataaaagaacgaaatcatatcttttgcagcaacatggatggagctggaggccattcacttaagcaattaacacaggaacaaaagaccaagcacctcacattcttataagtgggagttaaaccttgagtacatatggacagaagggaacaacagacactgaggcctagttgagggggtgggtggtgcagattgaaaaactatgtatcagtactatgcttatcacttggatgacaaaatagtctgttcgccaaaccttcacaacacccattttccctgtagtacagacctgcacatgcactctgaacctaa

SEQ ID NO: 215228 - DNA, 247 bp, Homo sapiens
accacccttttaaaacacaatcaaacggtggtgtcgtgtttaacttgctgagaagggtaagttacctgcaggtagagttgggcttcaaactaggcagtgaccccatatggtctgaaataaaactgacctgataacctcatctctttacacaaaacactagccaacagtcatcattcccaccagatgctatttgtccccacaggtggtcactacctcaaaggtgacagcctgttttgggtaatgggga

SEQ ID NO: 215229 - DNA, 530 bp, Homo sapiens
attttcttatagtaatttccagcaattcaactatgagagtgttgttcagcactagaaaacaaggagctgtctttctctgtctgtctccctctctctcttttgccaagtcacagtgcatgtcacaagagtgcaatgtctaacataatgtttgggtcagctcttcgggtttaagaaaaatggagacgtggaaaggagagcaaatagatcctaaatggaattccgtagacaaggtggtacaggcatcaggcacttgaggtgagaggagaccctgaggtcagagacttcagtcttcttctgttttccccttaagatcagctcctcttttcctatgacagcaattccttccctctttgattttgtgaaatctaacatttgtgagggtgtacatttgattgaggccttttttttttcttaacggcatctaattttcattccacaggatgcatattggcacataaatgtaattgtacttctcatgcaagccacagggtgtcatgccttcctctcctgttgccagaaggatctctgag

SEQ ID NO: 215230 - DNA, 452 bp, Homo sapiens
aatttttgtatttttattagagagggggttttgccatgttggtcaagctggtcttgaactcctggcctcaagtgatccacccatctcagcctcccaaagtgctgggattataggtgcctggcctaaatcagggatttttaaatagctctgagaaaaatctgttcaaaagattttttttttctgttgaagaactgttctacaatattcaagatctccatcctgcagcctctggaacccagctctgttactgccctccagcaagcccctgcaagctggctaggtggcatagttcctgcaagaggaactatggcaatatggttagaaaccaccggatttgaacatcagattgcctctgaccttgggtaacaacttaagttcttgcagtctgttttcccatctttaaaatggggataataatgatagaacttatttcaaactgccattgaagaatg

SEQ ID NO: 215231 - DNA, 429 bp, Homo sapiens
gtgcttagctaagactggcacacagtaattgtctgatgcttgtagctattattaagttagaaaatgaagctagctcagaaaagaataacaattaggcaattatcggcctgttatcaccctagtgtaaatgagaagtcaaataatttccttggaacaggttttgattgggataaggatgcctgagattccagaaaatgaaaggagaatctggggaactgaaggaccactagggaattcttcctggagtcaattatatgtggagaggagcagaaaatcccatcctaaataatcaggtgttacaggccgggcatggtggctcacgcctgtaatcccagcactttgggaggccaaggcgggcggatcacgaggtcaggagatcgaggccatcctggccaacacagtgaaaccccatctctaccaaaaatacaa

SEQ ID NO: 215232 - DNA, 678 bp, Homo sapiens
atagttttatggttttgaagtcatctccaccttgtccctctaaccttcccatctagtcaggttttctaatgacatcttgaggaaatttctgctcaattttgagggcatactgccgatccagtatttagggacccacgtgaagcttagttaattattgattatgaagacttatcctctccctgcccctcaaggctttataaagccatggctcctggaactaaggcatcagccatttgtttttccaacctcatttcttgagccaggactctccattcaagcagagcctggctctgattgctcctttctcatgtggagctcttttagagccattactacataggagctgcgcatctggccttgacctctgcttttgtcccttgggtacagcaggacattgcagaaacctcacccacagccttcagcttttggctccctgctcattcatcgaaatggtcagctagcttcttgtgcctagctgtgatttacctatttaatattttatctatcattgctatgtgtttggagcagtggggtgttgtccaagtgtggattcaccaaaccaccttggccaaaagtccaaacttgtcggaagactgtgtctgatggatgttgccttatgtaaggtccagacaccaggcaatctggatgtgcagaaaagtttcacagcctctgcattaa

SEQ ID NO: 215233 - DNA, 874 bp, Homo sapiens
tgaagatgaacagagttcatagctacattcatctttttttttttaacccccacaggactgaggtgcagaactggagtgagctgtttttctaggaatttgaatgttatactgaataaaagccccaggccataaggcaaacacaaagtttgagagaacccatatttcaagttggcaaacccctgtgtctagcttgcccctggtcgctatctctttgggttggtgtttcacccagctcctctgggctttgctgtagactactttcccacacacaggtgcctaggattcactttcattttgccgtgctaaagaaatatgtagcttaaataattccagcaacaagattactcttactggtaaaaaaaaatgtggactagtatcctaagacaaagagttaatatttgtctttttgagggttttgaaactgaacactttgaacctggcagcatcgagttctcaatactgttttaaatggctttttaacacttaggagaaattctccaatggctctaagagatacttctcaattttttcattccctctctatgctgtctgctattattcacagatatgcatattcctacacgtaaatacacatggggtagattgtttgagggataattaatctaaaatttagtaagatcttatctaatttattatttcttttttccaaaataaattcaaatgctctattgccatctcagctatactagtgtgtcacctaaaaattacacttagatattacacttacaccaacatactaaagggatgctgattttacagtagtcacagtgattgattaaacaaatttatcttatatcaaactagtgcttgacttgtaagtctactatgtagaataaataagattcttaaaaga

SEQ ID NO: 215234 - DNA, 298 bp, Homo sapiens
tcccagctactcgaggggctgaggcaggagaattgcgtgaacccgggaggcggagcttgcagtgagccgagatcgcaccactgcactctagcctgggtgacagagcaaagactacgtctcacaaaaaacaaacaaacaaacaaaaaaaactaagtagcagtacatcttaataattaccaaagaattggtgccatgtagatcaagggttagcagactatggcccacagtccaatctggccagccacccgtttttgtaaagcaagctttattggaatacagccaaccttatttatttaca

SEQ ID NO: 215235 - DNA, 154 bp, Homo sapiens
ctgtccaccaagttaaagacaccaatgctccaccctcctcgctcccctcctccccatccccaaatattttcgtaaagaatcagcattttgctacttttcgtccatccattcctccaagacccatttccccttcctcccttcttgaacctcttta

SEQ ID NO: 215236 - DNA, 1007 bp, Homo sapiens
ttgttctagcgccagtgcacgacagttgggtgagttttgcaggttccccctgcagcattagccatgttcctgacaatagcagctaatcacaaacactgcagcacttatatccctcccctgttgatgtttcttttattagcactcagggcttccaggtgtgagcaagtagaaacggtctgtggcattacagaagtccaaggacacttcctgagtggacaaggtgggtgggtgatccagttgtccactaagaaagtgcccttgggcttctgagctggttgggtgatctgcctgccatatgtggcttcccatgggactctgcaaaggtagcaccaggtcaccaagaggtgtgaacagaaggaacagtccactgccactcactgtcttactgtggctatcttgaaatgtggcattcatatctatccccaaattcaatgccagaagctgctgataaagcatagtcagaagctgattacgtttagaaatatgtttcctggtgtgtaggtagaaatatgtttcctggtgtgtaggtgcagggggcatctttcagtgtgccttgtgctttgcccattgctgcagcagccaggggcttacaggtgtgtcctggcgcactggcctcagcagagcagcctttctcttgctcactgccctgaactctctgtcactgctcaatgggaggcctgcagacaccatccagccaccctgccacatttgtgggcctgggactgggacaggagggagtcaacacctttgggacaatctttgagcaaggaaagttgagcctgggaataaatactcctccttctcttgtgaataatcttcaagtacacttgagaaggtttctcagaggatctgcagtgggctaggtccctaactgacaatgagagaaaccagctcaattgcactctgttgagttggcttcccttcttccccacgtcgctctcccaaacacctcctcccccactgctactccttgggtgcattttcctaagtgcactgcagcctcacca

SEQ ID NO: 215237 - DNA, 302 bp, Homo sapiens
attgattttatggagcagaggctggtgcatgcatgtgtgtgtcaggtgggcagtgatgggggggtgggggatgaggcatggtgataattcacaacataccctctatctagttgggatccgtaaaggaggaggttaggggagggaggatccatgcctacttgtggagggtatcaagaagggcttcctggggaggtggaggtgagccgagctcaccaggagcttcaccttcctggggaggcgcagtgagccaagactgcaccactgcattccagcctgggtgacagagcgagagtctgtctcaa

SEQ ID NO: 215238 - DNA, 211 bp, Homo sapiens
tcagcacaagtttaatatgtttgatatccaatatattatccagactctaaaatttgtttatcctcctgttgaattccttgctctgttaaaaaataactccacgctcaataaatgctaaatgaatggatgagaggggaaaaatttttctaataatccagactatcaatattagggtaacccctctttccctcctcccatgaactgccaaatc

SEQ ID NO: 215239 - DNA, 385 bp, Homo sapiens
ggtgttctatgttggaatgttttcactgtaaactgtatttaagcaataatacgtacccatttttttctttcattatttttatatatctgtgaattaaatatgaagaaatagtttttattttttgttttttttggggggacaggttaattttaatgaatcttattattttatgattttatcatatgacttttatataggtagggaaaactgggacttcgtctactcaggtcagtcattggacaccttggttgttctgattcattgcttgatactcttttcaggagtgattaccacactttggaatattaaatatatatattagtgatgtttaggaggaaagattatgactgatgaaatttgttgaataaagtgtatgtggtaaaca

SEQ ID NO: 215240 - DNA, 194 bp, Homo sapiens
ggaggagaatcacttgaacccaggaggtggaggttgcagtgagctgagattgtaccatggcactccaacctgggcaaaaagagtgaaactctgttggggggaaaaaaaagaaagaatgaaaactgagaaaggtaagagctgaggctctctggaagcttgaggagctaaatgtgtgtatgtcaagagacttcaaa

SEQ ID NO: 215241 - DNA, 806 bp, Homo sapiens
tctgtgttgtgataattggctttggaaaggttacgagaggttgactctggcctgacacggaggctctagccaatgccagagaggtaggcttggtgccagagctcacctcagacccacatctccagggagtgacaggaacagaaaatcagccaagctactgtgacccagtcgttcagcaaatgtcggagcgttgcaatgcctgcccccaccctaccccagagcaaggctgggcacctgaacactgtgtggggtactctgcgtctgtgctctggggaagggggctgtgaaattcacctggagatctgttttaagacctgcgctttcgaaatgctctcaaactcttttatcaagacagtacagcttggacaaatgtccacaatagagaagcagtgacatcccttggacctccgggaacagcagccctgtctgtctctgaacgggccttcctccctcaggctcctctcacccctcggggctgccctcaggggaggatggcctcacccagtgaaggttaactgggccctttgtttgcaaatggcaggacaggagctggtgctagctgatcatgaggctttttacagcatcaaagtgctgcagtttactaagaaatcaggaaagcatattccaaaacagggttgtcttctaggaaggaacagagaggactctgcctttctactttcaggcatccagccctgtatgctccaccagggtatctgtgaggagaggcagcgtgagcaggcccagtggaagcagggatggagaaggaggggtctcccataactcactgcagatgctgagtataatta

SEQ ID NO: 215242 - DNA, 434 bp, Homo sapiens
cagcaagttctgtccagattcttcttggcctctctatgcagcatttcttcctctggggcatgggaaggaccctttctgaaatgagggtcttattactcacaatcagaaagtcagagaaagattagagtcctgctttgggcaagcaaaaggagggcagcaaaagtttagagagagagaggttatgttttcgaaggcctccttctggggcctaaagtgcccccaacattacaacagactgcaacaagggctatggaagttatgagccaggaaccgtggatgaaaaccaatatatataaccatatgtcatgggagggaagggaatacatttagttctggacataaggtagtggacatccagacataaatggactaaatggaatgttatttaaacctaagaaataaataagaattacaatgtaagttggaagagattc

SEQ ID NO: 215243 - DNA, 831 bp, Homo sapiens
  misc_feature (2)..(2): n is a, c, g, or t
  misc_feature (525)..(525): n is a, c, g, or t
gntccgcgcgccattgtgttgataccccggaattcggccattatggccggggctagcactttctccaggcacagctgcatctctaagtgccttctaaatttctccttcctgctggatttacataatgtaattatcaccatcatccattttcttccacactgaattctctaccgctgtaagagaagagaaattttaatgggatggagggcaggtgataaaacaggcaaatctctcatgcccccttcctccagcataaatgcacacgtgcctcagaactgtcaggctctatgatggggctacaaaccctgccctcttagagaagtcacagattatttcccctgccataaatcagaaggcagtgggctatgagaaagcgtgtacagggcactacagaggagcaaagggaaggagcatctaatcacattagactactcagactcaaatctgagtcaggaagggcaggtaggagtgcaggtgaggtaagaaatgggagacaggaaaagagcattctagacagggtcgccncgtctcgccccttgcacacagcccagcctgccgatagcctccctctcgcactctggatgcctccaatactgcttcaactctcgacgcctcccgccgtccccacttctcctgttccactccggctcctcgcactcctctgccagtatcgcccccactccccattgctctcaccgccgccacgccttattccgccacactctctgctcattcgcggccacgccctcccctccctttccatcccccacctctgttcctcaccatcccctcttcctctcctcccctaccctcctcatccttcgctccccc

SEQ ID NO: 215244 - DNA, 529 bp, Homo sapiens
ggtatgtagggaaacctcaattctacaaaaaagttaaaaattagccagatgtggtggtgcacacctgtggtcaatccactgagctgctcgagaggccaaagtgggaggatcacttgagcccaagaggtcgaggctacaatgagccatgagcagtccactatactccagcctgggcaacagaacaagaccctgtctctaaaaaaaaaaaaacaaaaagaaaaacccaattgtttcttcagagtagctgcagtagaaaaaaagaaaaaagagacccaattgttgacaaaattatgaaaaaaaaaccaatattctcgtactttattggtaggaattttaattggttaaacccttctggataaaatcttaatagtaaatatgcgctttgatccagaaattccaggacgaaccataaggaaataattaatgcagtacagtgctcaggagtttggttctggagttctgcaacctgaattggatcttgctttaactactaattgaaggtatgatcatgggaaagtaaccacctctt

SEQ ID NO: 215245 - DNA, 672 bp, Homo sapiens
tctttattcatatgttgataaaatactaaatgggttaaggctggcaacagggtcctttggttccttaatattatttaaccagctgtgactctacctaattcttctgtcacctgctcatatttctgtctctcgtgcctaggagagctttttagtatttactcagattttttcatcaggaactcaatttttttattgttacctgttctgacccttgattcttttgctcacagctttctattcattacctctgtaaaaagcctttgttctgtttgagcagaaacttagcaaagaaaagcctactagcaaaagcttccagtttccagggtttctttaccagttcattgattctacaaatatttattgtgttttctgaatctttattaatttatcaaatcagtctttattaaatgaacaaatgagttttagaacgggggaaaaaattgcatataggccgggtgtagtggctcacacctgtaatcccagcactttaggaggccaggatgggctgatcacttgagcccaggagtttgagaccagcttgggcaacatggcaaaaccccatctctacaaaaaatacaaaagctagccaggtgtagtggcacgcacctgtactcccagctacttgaggggctgaagtgagaacattgcttgagcccgggagtttgaggctgc

SEQ ID NO: 215246 - DNA, 399 bp, Homo sapiens
aaaacttttttttaacacttttaatctcctctttatctttcctacagattttctataaataatacatatttgatattactgaagcaaaagaagtctaaagggtcattctttcaatatttataaagtacctactaagtgttacgcactgtgctggatgcttggctagataatatgctgtccttcttctggtctctgtatttttgtgtgtgtatgttttaagaagatgacattcttcaacattgtaaggtcagtaatctgacaaatgtaatttagtagtattggggctcggaaaatgacaccccaaaacatgctgagagctttgaacaaaggagattaaaatgctccagaacgaagcctcagaaccaatgtttctctctgaccttctgctccttccacaac

SEQ ID NO: 215247 - DNA, 454 bp, Homo sapiens
ggcaatgtctggagacagtttgcattgtgacatcgtggagacaggttgctgctggcatctaatggtcaagaggttaagagttttctttggctggtggcagatgaggaggtcagagagattcaaagcatgagaaggatttggcatgtccttgctggctttgaagatagagggaccacactcaaggaccagagagaagccacagttgctgacagtgacccttcaccaacagccagcaaggaaatggacctcagccctgtggctgcatgaaactgaattctgccagcaacccccaaagaacttggaagtgtgttctttcccacagcacccagatgagagcccagccaagctgacaccctgatttcagcccctgagtagagaatccagtagagtctgcctgaacttctgacccatagaaatgtgagataataaaagggtgttgttttaaaccattaaa

SEQ ID NO: 215248 - DNA, 160 bp, Homo sapiens
accgcacccggctaaggtatgcatctttgaatgaatttttgatgtcatagtagtccttaccttttaaaaaaaatcaaaaatttagtttattttcttattcaggtttatttcttattagcttagtactcttcattaaatgtcttttgaacacagtattttt

SEQ ID NO: 215249 - DNA, 212 bp, Homo sapiens
catcttgaaacaaacaaaaaacacccagccagcctcctgaagatggctttataagcaaactcccctgggcagtagattaccgcatgattcactgtttttaactacagttaatagctgtgccaccaccacaggtgacaccgtctcacctccaggggctgggagttgaacacttgctgcatgcctgggccctggcaaggaggccgacggccagg

SEQ ID NO: 215250 - DNA, 380 bp, Homo sapiens
gcataaatgaagaatttttttattctcgttagactttttataagattgtcagatattcaaataatatgtaaccaagccaaacttcaggttgataggaaatctagagccaggagttttaatttttttgttgttttgtttttttctgtgacatgttggcaaatgataaaagcaattcactctgctaaccagagatgctgggcagaattcccccaacactgatttcatgccatgaaaagcacatgaagtctggcctggcaaggcatggtgaggagcacaggctttgtgtcctactgctccaatttgaattccagcttagtccctactagctgtgtgaccaaaggatatttacgtaacttctctgaaccttaggattcttatac

SEQ ID NO: 215251 - DNA, 385 bp, Homo sapiens
  misc_feature (273)..(273): n is a, c, g, or t
ggcgcagtggctcatgcctgtaatcccagcagtttggaaggctgaggcaggtggatcgcttgaggtcaggagttctagcccagcctggctaacatggtgaaaccccgtctctattaaatacaaaaattagtcgggtgtggtggcaggtgcctgtaatcccagctactagggaggctgaggcaggagaattgcttgaacccagggaggtggaggttgcagtgagcggagatcgtgccactgtactccagcttgagaaacagagcgagactccgntctcaatttaaaacaagtaaatttaatggcttatctcaaaataaagctgtttaacaaaagggaaagaaaaccaatgtggctggagttcagagagggtaagaagtgggagatg

SEQ ID NO: 215252 - DNA, 164 bp, Homo sapiens
aaagaatgcttattgagaaaagacacctgagtatccctgatagagtaaaggggcttcccctgaaaatcccttatgactcttctatttggggccaattaaaaatgacaatcttacctcacagtatttttggggtctttattcagagagtcacatacgcaagacca

SEQ ID NO: 215253 - DNA, 251 bp, Homo sapiens
ctggacaccacagctcataccctgtggttcaaacaacaatctaatcgccagtcactgttatttctgtagaccaatgagaattcctgaaaaacgacgtttgcaattgtccctctcctgactttgtccttttttctttaaaaaatgcaagcctctcacagaagactaaagtgaacttcaattgtcccatgtttgataaagtagaagcctagccatcttagtctcttagtttaataaaaattgatgtaacagcc

SEQ ID NO: 215254 - DNA, 527 bp, Homo sapiens
gagatgtatctctccatgtgtaagcaattatacaaagatttagctgcagaaatgttcacgtctatgctacttctattagaagaaaactgaaacaactcccatgtccatagtataggacaggttaataaatggaaatatatctatatgtaaaatactataccactattcaaaagtatttggcaaatgagttttcactaacatagagtgttcatggtctgctgtatgggaaaaaaggcagtttagaaaaaagtacatttggtatacatgcatagagatgtgcatagcaaatggtctgaatgaatggccttagaccacagttttcataattgttctccttcagtgagaatatatataaaatatatatttcatatataatatgttatatgtaatatatttcatatgtgatatatatttcatatataatacatgttatatatcatatattttatatttgttatatatcataaatttcatatatgttatatattatatatttcatatgtaactaaatacaccaattaaatttg

SEQ ID NO: 215255 - DNA, 380 bp, Homo sapiens
gcaggatccctcttcctaactccactttcattcaaatgccccactggacagttagtgataagaagataatggattccaataaaggatgtacatggggatggattcttggggaagaaaatgtaccccctggccccacagctgttcagcagcatcaaaaccggatctggctaaagaacgaggttaagcctcaaatatcatcctgtaccaccccctccactgaagtgcctgcgggaatttaatcattgaatttattcactagcaattgttgcagtttagtgcatcatatttagaaacaaaataaattgttgtcatattcttttgtattgatatataatgaaatataattcacattccataaatgcacctttttgaaggataca

SEQ ID NO: 215256 - DNA, 210 bp, Homo sapiens
tcctgaccttaggtgatccacccgcctcagcctcccgaagtgctgggattacaggcgtgagtcaccgcaagacacctttaaaagattagcagaataacatcggatcaaaactgtctagcctgcagttccccttaattttgtattataaaaagaaaactaaacagagaaaactttaaaagacaatataatgataccacgtagattccagta

SEQ ID NO: 215257 - DNA, 661 bp, Homo sapiens
tatttccttttttttgagacggagtctctctatcacccaggctggagtgcagtggcgcgatctcggctcactgcaacctccatctcccgggttcaagcgattctcatgcctcagcctcctgagtagctggaattacaggcacccaccaccacacccagctaatttttgtatttttttagtagagtcggggtatcaccatattggccaggctggtctcgaactcctgacgtcaagtgatccacctacctcggcctcccaaagtgctgcgattgtaggcatgagccacggcgcccagcccagcttttcttcataactctcaactctttgcagtcaggcagttctcagagctaattagggcatttcatgtcacagtataagtttggtatgttttttctattgcttaaggaaaagcaagatagtaacgtataatactttttgtccaaaagtgcaagatattttggtctgtgagtctcataggagcccctagaaataaatatagtttgccttttaactgttagaaactgcagcactctgagtgtcctatgcccaaagaatggccttctcttggttgcgtcaacatagcaggcttgcttctttctgcctcacggctttacatgtgctgtttccccagcctgaaaccctgtccccttgttcttgtctt

SEQ ID NO: 215258 - DNA, 352 bp, Homo sapiens
ccaaaattatctgcagatttaatccactgccaatcaaaattctagcaggattttctgcacataaacagattctaacatttgttaggaaaggcaatgtaactaggatagacaaaacaattctaataaagaagaataacttgggagaaatccctatctccaattttaagaattttaaattataataatcaaaacaatgtagtgttaaagacagaaacacagatcaatggaatagagtccagacacagacccacagaactatagatgattaatttttgacaaaagtacaagtgcaattcaatggagaaaggataatcttttcaacaaatagtgttggaattagacacccatttgc

SEQ ID NO: 215259 - DNA, 343 bp, Homo sapiens
ctgtgcatgtatattttgcactgtatcgtgggaataatttagttatttgtttgcaaaggacagtgcaggtctttttgttctctattgacataagtaccagatccccacagtgcagtgagcaccagtgcaggcacccttaggtcagacgctcctctctttcttttcagccagccccactgccaaattgttgtcaacccccagtcggccttgggttaagaatgaggaggtggagaacggcacgtgcagccttaagggttccttctccgatttaggtttcttccactcctttgccctgggagagcaaaggggcgaagggaaatcaaaaaccggttgaaaaagaaaa

SEQ ID NO: 215260 - DNA, 811 bp, Homo sapiens
gaaaaagaactaatgtttgatgccaattttacatttaaggaaggtgaaattgttgaagtggatgaagaaacagcagctatcttgaagaattcaagatttgctcaagattttctgatcagaccaattggagagaagttgccaacatctggaggctgttctgctttggagttaaaggatataatcacagatccatttaagcttgcagaagagtctgacagtatgaagtccagatgtgtccctgatgctgctggaggctgctgtggcacaaagaaaagctgctaaatctatagccaaccaggggaccacagtagtgggcaagagtgatctgcatgttttttaacctgcttttccccatagcacagaccataagaaacaacaaatgggccactgcgcccggccataaatgaattatttttaagaggcattgattaaagattcacagcaaatcactagttaagcagattttttttctatttcctacttcaaagttctggtgccacatagtggtcagaaatggaacagagaagctgtcttaagccttgttcaagaagcaggaaaggcatcagaagaagtaacagttggcagagggtctcaggaaaaacatcttccttctgatcttttgcatagcaccttttggaattttcatcatgtttgcttattaaacaaagctcctactgccatcatactaatcatgcaaaaagattgccaaatcatgtttggtaggaggacttttgaggtagcttttgaacaaatgtttttttcttttttctttttttttgcaataaagaaaacaaattaatcataaacatct

SEQ ID NO: 215261 - DNA, 589 bp, Homo sapiens
aaaataaatgtggtaagatgttatggcagagaagactgtatttcactgtgtaatttcacagtgaaacatacataatacaaaattagttttgttattccaggccttcattacagactatctgaaggtagtactgtgtgcattttttcaacaactttttatctgaatacaaaaataatatatatatctgttgtagacagtttggaaagagcagaaaaatataaagaaaataaaaatcattacctgtaattctagtatctaatgataatcactgttaatattttggtatatagtacttttttcagtcattagtataagttctttgttgtgtttttaatagtggtataacttaattcatttgtaacctacattttatacacaaatgttactttcagatttaagtatccttctatagcataatttttattttttatttttatcttattcatttatttgtataaatacaaatgaatgcaggtgcagatgcagtttggttatatgcatagatttcatagtgggaagtcagggcttttagggtatctgtcacctgaataacacccattgtacctattaggtaatttcttattcacct

SEQ ID NO: 215262 - DNA, 604 bp, Homo sapiens
gcataggatggaaccttgaggaacaccagcagcatttactgacgggttagagatagatgagcctgcaaaggagtctaagaaggactagttggagcagtaagtagaaaatcaggagaaagctgagtgctagaagctgatgaaataaacttttcttgaaggaaggagttcttgatatcaatactgctaggcatataagatggattgctaacaagaaaatcattggtaacttcaataagaattgtttttgtgggggagatgctggaaaagatggcagataggagacaggactaatgtgcagctcccgcttagatggacagaacagggtctggagactcacactgtgaacttttactccaagaaccaccacaggaacatatcaggaaaactgaaagaattcacagaccctttgtaagaagtggcttgtcactgcaaatgctgtgagacagcaaaaaactgtgagttcccaaagtgtgaggggggaaaagttggcttccgaacacacatacccactggggaaatgtgtcaggcctctgagcccaagctaagccatcatatcccctgtgacctgcatgtatacatctagatggcctgaagcaagtgaaga

SEQ ID NO: 215263 - DNA, 597 bp, Homo sapiens
cttgaactagtgggtttttgtcagatggaaaataagagtattggccaggcatggtggctcatgcctgtaatctcagcactttggaagtccaaggtaggagaatcccttgaggcaggagtttgagaccagtctaggacacatagcgaaacactgtttctacaaaaaaaaaaaaaaaaaaaagaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttgggcccaaattggggcttatttggccaattcgccctttaggggggccttttaaaattaaagggcccgggttttaaaaacgcgggcctggaaaaaccctggggttccccaatttaaacgcctttgaaaaaatccccttttctccaggtgggtaaatccaaaaaggcccctccctattgggcttttccaaaaagtggccacccttaaagggcaatggaatatgtaccgcgaaaatttttggacaaactcgggtttttgataaaccgcctattttttaaccaaagggcccatcggttct

SEQ ID NO: 215264 - DNA, 1821 bp, Homo sapiens
gaggccgcgagagcaccgggaggaggtgcatttggggttgcgatcgcgagcagcagcgcccattgttgcaagacctgagaccttgggcgagcctggcccctacctgggcctcagttccccttcggcagagcgaagttggactagaaggtctctgcggccgtgcagacgaattctcccggacgaatcgccgagccccagcctgcatgggagaccgtggccagcagggatgtccaggctgggttgggggaacagaggtagcagaagagttttcaggagaccagaattttccgttttcgcacagccaggactttcggctctcttgggggatcagcagggcaataacgataagtctccttaaggcccaggacctcaggagggggtgcacgacttcttttcaacccagccccggactctgatctcggattctggcccgcggctctgggtcaggccgcggaactatagcagcctgcagtcctggtcttgggtgtaggggtgcgctcctggtcccgcggctcagggatatgcagtgaccatgggttgttggcctgatgggacttttggcttgctaaaccaaagctcggttcggatatcccgggcgaagacgtccgctgctctgggccaggctggcagcgttcaggctggggcagagacgcggagtcgggcgctggctccaacaggcctggctcccacatcgaagacagctgggccatttgctgttaggaggccccgcgctgacagtgtgcaggatttgctcttacacagctctttctctctgtccctgccggtcccccgcagacgaatcggcagccgaaacaggccagagcttcctgttcgacgtgtccagccttaacgacgcagacgaggtggtgggtgccgagctgcgcgtgctgcgccggggatctccagagtcgggcccaggcagctggacttctccgccgttgctgctgctgtccacgtgcccgggcgccgcccgagcgccacgcctgctgtactcgcgggcagctgagcccctagtcggtcagcgctgggaggcgttcgacgtggcggacgccatgaggcgccaccgtcgtgaaccgcgccccccccgcgcgttctgcctcttgctgcgcgcagtggcaggcccggtgccgagcccgttggcactgcggcggctgggcttcggctggccgggcggagggggctctgcggcagaggagcgcgcggtgctagtcgtctcctcccgcacgcagaggaaagagagcttattccgggagatccgcgcccaggcccgcgcgctcggggccgctctggcctcagagccgctgcccgacccaggaaccggcaccgcgtcgccaagggcagtcattggcggccgcagacggaggaggacggcgttggccgggacgcggacagcgcagggcagcggcgggggcgcgggccggggccacgggcgcaggggccggagccgctgcagccgcaagccgttgcacgtggacttcaaggagctcggctgggacgactggatcatcgcgccgctggactacgaggcgtaccactgcgagggcctttgcgacttccctttgcgttcgcacctcgagcccaccaaccatgccatcattcagacgctgctcaactccatggcaccagacgcggcgccggcctcctgctgtgtgccagcgcgcctcagccccatcagcatcctctacatcgacgccgccaacaacgttgtctacaagcaatacgaggacatggtggtggaggcctgcggctgcaggtagcgcgagggccggggagggggcagccacgcggccgaggatccccagctgatgagcagcagcgggc

SEQ ID NO: 215265 - DNA, 370 bp, Homo sapiens
agcttgggcgacagagagagactctgtctcaaaaaacaataacaacaacaacaagttatattctactcggtgtcttcaggcaactttattgtatcctcaaatggccagcactattttgctggtaccttgcctagctttgttatttcccaaaccttgacctggtctcatactaggtctttagtatgcccacttattagatttcttgatatgttcgtagtcaaaaccacaacagccagattccctgctttctgggactcttctaggagatctggtttcagggtagagttactgaaaacccagggcttctgcagaatggttttgagtcactatggttcccttgctgatttgattatcttcttgtctttgacca

SEQ ID NO: 215266 - DNA, 402 bp, Homo sapiens
gtcacttccccatcctgccccttcccaatgaggccctgcacatgctgctcttccccagtccccagggaaccccatgagctcaagacactaccatgttctccaaacaaaatcaagtctgatgcactttaatttttgagtgcacagagcctccatggctccttgaggagccagcagcagataatataatctgggccacgggaggaggctggtgcagctcccaggaggctgcaggacatggcttctggaggcacagcctccactcccaaagtacctactgagtgacaggccctgtgctgtgggctttgtggccctgagccatcaaggcctcatgcggtttccagctattggtgtcaacagcgtcttcccagaaaccctgtggctggcagtgagtgggtgttgtgt

SEQ ID NO: 215267 - DNA, 668 bp, Homo sapiens
tcctttgcagatccagtggtacccttgcctcgccttgcgcgagtctcgctcctccctttcccacaatgttatcatgagctatttttatctacaacttgtgccaagatgcttttggggggattctagggaggccactccaaatccactgtctttgcgctgcgctccgagaaacagtctcctgttagcatggagcagcctcaaggagtggcggggagggtggccgagaacggaaggagccagtccgccctcttctcctccctcagccctagccccggagggaaaccccgccaccaccagctcggctgcgcctcccgccagtagccccggaagagggtccccagacgagtccccacgctcccgctttcaggcgctgggtgcttggacactgctgaggcagcagcctggcacaggcaggatccttcattcccacccgtgcgttctcgctttgcaggcaaatctcattttattttgttgaaatgcttccacccaagggttaattccaggaattccatctttaaaaaaaaaagaaaaaaaaaggagggagaaataacccaacttctgcctccctgcatttctaaagcaaagcgcatcctttgacgttcggatttttttcttgctttctgcattcctggtaatattgggtaacactgggtgcaattagaataagc

SEQ ID NO: 215268 - DNA, 434 bp, Homo sapiens
caggattgtatgctgagcccagaactatagctgggcaatgggaaaaaacactgaaataaacacatctctgaagcctagaaatatcatgtctgcctaagactgaaacttatctacaacaacaaagattactcatcccaccactaggctaaaaacattaaataataaggtaacaagggaatactgaagggatatttactgtggcacatagagattgttttctaatgtgcaccacaaaacaaaacctagagcttagtgtagagtgaacattgagaaaaatcctctgccaaactaaaattcgctacaaatgaaatatatcacaaaagtactttgaggttttgcatgcagcgcagaaagccaaaccagcaacaaatcctaaacatagcccaatccctgacttgattgagccaaactctgacacaagaagcctagcagaa

SEQ ID NO: 215269 - DNA, 688 bp, Homo sapiens
gggggatttttgggaaggttcaattagatatgccccaagaaatgcttaatttttctgaaaaataccactgtttttaggcatctgttatactgtaggggtcataatttaattatttctattaggtatttttactatacaccaagatttcattatgcaatcacacatctgttgttctgagctgtggttcttactggcatcttttggagatgtatttagaggtaaagaatcctttaacaacttttaggatccaaaatctcctaacacaaactttctccttctgccttctctttagcccttttaaaattggtgtatttcctacttaaactcacatatttcaacttcttgcaacactattaaaattacagctactatttgttaagcacttactgtaatccaggcacagtcctggatgctgcttgtattatttaatcttcacagtagtagtgcagtttaggtattatgactatttaaatggagtctgagaacacagaactcagtaattgagacagcatcttataggtatgatgctgtgaagaacagaaattattttaatacctggatatctgtcttcaagcccaagttctgtccactataagctattcccataactttaatacagtcaattttcccaatatgagaacatgaatttctcccattggcttcctaatggttttctgtcactcagagt

SEQ ID NO: 215270 - DNA, 529 bp, Homo sapiens
caggacacaaaataacccatcgtttgaaagccggggaaataacctcgctgatgaaatagctaagcaagctgcctcttcccaagaggcacccatttgccatctaaccccttgtccctcctatccagctgtgatccccatcttctcccttgcagaccaagagaaactaaagaaaataggagctaaggagagcccagagggaaagtgggtactaccagatggaagggaaatattgtcacagcttcatcaaggaactcactggggtccacaagctatgtgcgatgcagccctcagagtctacgggtgtgtagggatatataccctcactaggcaagtggcggatgattgcatagtgtgcagaaaaactaataagcaaaccctaaagaagcaatctcttgggggaagaaacccagggttgaggctgttccaaagcgtctaagttgattacactgaaatgcccccaataggccacctcacgtatttactagtaatagtagactatctcacccactgggtagaagccatccccttc

SEQ ID NO: 215271 - DNA, 200 bp, Homo sapiens
tatatgaaagagaaaggaagcttcattaaatgaaacattggaatcaggaagactccggcttggctccctgagcattctaacttgttctgagcctagtctcgacagaagtagcctgacacaagtggctcagatcaagggtccatattacgggcagagtaaaaataggtcccagtttcattagacttctcatacatttaagg

SEQ ID NO: 215272 - DNA, 385 bp, Homo sapiens
tatcctcatatggtggtctcttcctttcttttcctctcctggttcatatttgggccagagtgacctctggcatttacctccaactaactttgaggtgcaggaccccacaagccatcatttatcctttggcaaatatagcagcagttagccagcctgtctgtcacttttaggattctttgggggatagagatcagactcccatgcctgccaaatgcaggggacaaatatcctgttcttcaggtggcactgccggaacccttctgccttgagtaacataaagaagaggaaagaagatcaaagaattatgaaacaaatgagatgcttgtaaacttcattagttatatgaaaccacaaaggggcatttaataaactattcctctcaaaa

SEQ ID NO: 215273 - DNA, 237 bp, Homo sapiens
tatccgaggattactatctatctatcactctttaatggtcatttcccagtacaaaaaaataaaattgaaataactactttttggcactattaatgttagtttttgtattgggaattgaccattaaagagtgatagatagatacctgttttgtgattatgtgcataaagtcaaataatgtaactgagttctctgcttgagatcaaggcaaaatatatttgatagattattagaatata

SEQ ID NO: 215274 - DNA, 393 bp, Homo sapiens
ggatgaagcgggtattatggaccattttattccagtcagtttgaaaacagtgaaaaaggtcaccaattgctaggaaaccaaacccgccaaaactgacacaagaaggcacagccaacctgaaccgttccagaatcattacagaaagatatcagtagtcaaaggctttccacgaatgaactccaggattcaccaccacattctgacaaacatcctaggaatacatatcttccattttacacaaactcgtgcagaaaattgaaagtgaggggccaggcatggtggctcacgcctgtaatcccagcactttgggaggccgaggcgggtcgatcacgaggtcaggagatccagaccatcctggctaacacggtgaaaccccatctctaccaaaaatta

SEQ ID NO: 215275 - DNA, 425 bp, Homo sapiens
tcaaatttttgtggtgaattgattacaggaacaagtcacactctgtaagtgaattactgggtgttgtctgatgaattaatgaagtttaagaagttctttcaaagatccgtggcttcgtgtgttcatttcagttctaccagcaatatttctgagagcagaacaagtcttgcgtcttctccctacttctcttctctggcagtttcttggatctacataattgataatctcttaagaagaaaatattttatccttttggaaattcgtttttgaaagttggagtttgtgaacctctaaaactgcatcatggtttttctctccccttcacccccctcccccagcccccaagaaagccccagttttagcctttgcttggcttccttggaatttcacttatgaatacgcacacacaccatcttttgagactg

SEQ ID NO: 215276 - DNA, 373 bp, Homo sapiens
tagaacctgtctgagaatctttctggtccggggctattttgttagatagaattttttattaacgattccattttggaactcaaaatttggctgttcagggtttttaattttttcctgattcagtcttggaaggtttttatcatacagggaggttggattttgttgaaagctttttctatctattgagataatcgtatagtttttgtttctaattgtttatgtggtgaatcacatttattgatctttgtatgttaaaccaaactttcaacccacaaggaaagcctgcttgatcatggttaattaactttttgatgtcctgttggattcactttgctagtattttggtgatgatttttatgtccatattcatcag

SEQ ID NO: 215277 - DNA, 467 bp, Homo sapiens
ttttgattgaaagggcaaattttatgtaatgtatattttaccataataaaaaattataatcccccaaacttgtaatatggttatatatgtgcttctttattaaatgcattaaagaacagcaacaataaatacaatggatgtgatcagctattcattttgtttgtcttgttttgagacagaatctcgctccgtcacccaggatggagtgcaggtgtgtagctaaggagccttgggaatacccaaatttaatcaaggttctttagggcttgctgatcttattccctgaaactgaaaggtcatcctcgtctgctgtctctggtctctttcacaaaattgaaaacctaacccagtttacactcaccataaactcagaggtttattgcttggagggcccttagctcaggccaacttttctccttcctgatgaggcttaggcagtcttaagccaggtaggggcagcagagtgc

SEQ ID NO: 215278 - DNA, 655 bp, Homo sapiens
tggaaatggtaaatgtagctacctgtgagtgtttagcatatgcatatattatatataaggccatggcaatagctgaatgaggatgatttttatttgttggtaaaggcattgtacagttgcaaaagagaagcagatttaaaatcagctaaacttggatagactttttactcttttaatattttgacattttagattttctttttattttgtgggcattttattttcaggccagagccacgcattttatggaaaatgtaactagaagtaaggtgctgaactgctgctacagcaccttacctgaggcacaaactttgttgcatgtgagttatataaataagtagaaactcataagtactattgtttattggatttttccagcttcaaaaattctaatgtgaattagcagtttattttctgttagatcatgatttttttttatttgtaatagtcttagctagaaatgttaaaagttagcttttgtgggcaccataatactaaaatatttactttagtgtttcttgacattcaaaaatgtcattggatttgtaattcaggtatcatatttgaaaatgagtcttttaaaagataacataaatatctttattttgacacacaaggtcaagactagaaatgtgttcctgggtactttcagcct

SEQ ID NO: 215279 - DNA, 580 bp, Homo sapiens
gctgacatgtggtggtttatttaatctatttgggccccaatatctgcatgtgtaaaagggaatgatgataatgagtattttccaaaaaatatggttgaaggattaactgtatttgagatagagtaggcctcagttcgtgtcagctattagccttagtctgtctacaggaaccagaagtttcaggttgggagaagcctggccttttagtgagaagctttcttgtggtgggacaagatgttggtgtgagaccagaaactcagcctctcaggagcagaaaaagaggggactcgatgttctgctggtgattctgagatgagtgttaacatcagatgtggctgttagtccccagaaggacaaatataaatgtttccttcatgctcttctttgtttttgtttttggtttttgttccttctgctgataaatattcttactcagaggttattactgcaaataataataaaaaatactggtaaaccaggcctctgatgtgttattgttaaaaaaaaatcaatgttttattcacagtctgagtacagacttggctttattgttctgaaagaattctgcatggcagggcag

SEQ ID NO: 215280 - DNA, 421 bp, Homo sapiens
aggcatattattctcttcaaaatttggataaagttgaatgggtcaacttaaagtctttgaatcatttggatcgatgttgctacctatgctcaaagaaaaatgagaatgggaacatatattaatttattataactgtttttctatatttctataatggaatgaaaggaaaatagcatatttcttgtagaattacaagacgccttatgtaaaactggctttgtgaaaatcacattgatttactccttgacaagttggcgtctttgaattgcataaattccttctccaacctctgtgtaagtctagagaatcaagtgacaccaagacagaatctagctaatttaagtcaatatttccttgtgaataaataaaatgctaagagttatgaagctcagctgttctcctaagctctgctgacacttga

SEQ ID NO: 215281 - DNA, 421 bp, Homo sapiens
tgcagtgagccaagatcggtcgaacactgtactccagcccagtgacagagcaagattccgtctcaaaacaaacaaacaaacaaacaaacaaaccaaaaaaaaaaggagactaactcagctcagctcagttactaacagactaactttactcagatggtaaattcatgagattaaaaaatccagtatttgacatttttccaccttccttagtactgtagttcctgtgatttaagataaaaagatggattatctactgaatttcaaaatctgcctcaaaacctaagaaaatacacctgattcttcttaaaatccacctgaacaattaacaactaaaaagtcaagaaggttctagcaagcagctagaaggaatgaaaaggaaaaaatgaggttacccaaagtacagtgatcgaccacttcctga

SEQ ID NO: 215282 - DNA, 428 bp, Homo sapiens
acatttcacccccacccactccgtttccctttgtgttcaccaagagagcagagcagttcaaggagagtagctcaccagcgaccatcttctgtacagcagtggcgcggcaagggaagcctggactggcaggagagttgagttcttaccaggcaccgccacgagcttgctgtgtgagcttggtccacttatgttgcatatctggggcacatgtgcagagcaagggtgggattagatcatctccagagtctcagaaggaaggcctcataattaaaaacatgtctgcatgtgacaaatcaagagtgtatcacatgattctctgtgtgtctagctgggtaatgacatgtattggttttatgttgataaaagtgatgtccagtatgcttcatgtggaaacttttgaaaacttcaattaatctttaaaaaattaa

SEQ ID NO: 215283 - DNA, 529 bp, Homo sapiens
gataattataaaatcacaagtattatacttttctcagagctatgtttagataaaagtttaaggaacacatcatctgtgtatgtatatttagatatttttgaaacaaagtatgtatttgataaatttaataattcatttagccattccagtatttctttgttgagtgcctagtgtttgtcaggcagtggagaagctgtgggtaattggcactctcccactgcagttagttacactctggttctttcagtctacccagcagtgtgtgctgataatgtggaagtaaatgaataaacaggaatggaatacagaaggattcttatgaacttgctcatatatgcatagcaatagaaagagtacttcctaattgcaaacttatagcacatacatctgctagaaactccttgtgctaagtacatgaattcaggcattaattccacacaaaaataaaagctaaaatcccttgtaccatgtatacaaatgagacaagtgagcttgacattcaagcttttcaattcatgcaaaactaaaa

SEQ ID NO: 215284 - DNA, 434 bp, Homo sapiens
tgttatacagtaccttgaacagaggggaagagtaaaccagcagcagaagagaagaggctttgctcagactccaaaatatcccacatcagggacattgcaatggacagaggcaaacttgccaggaggaggcagaaggggccatagagtggatactttctgcaccttctagagttgatctcagaaactcaactgaggaatcttaagcaaggtccagtgcctccatttcatcagctgcaaaatgggtaatttggtataaatcagcagttctcctgacatggggtccttggaaccttgggtgattgcataaaggggtctgtggtgttgtctgtagacttgaaaagcaacatatctcctatagatttgtactatttttcaaacgccactgttggagtaataaaaacaattcagttaaaagcttaactgaacttatagtt

SEQ ID NO: 215285 - DNA, 384 bp, Homo sapiens
caccaaatatctagggataaatccaatgaaatatatgcaagcataagtcttccacaaagaagattcaacacctacttcccttttggcagtctggaattgaggtatgtgctaagcagagtgcctacactaccagtccccaataaaagtcctgtgtgccaagtctctaatgcacttcacaagatctcaactagttgctggaggtgcaagtacccactggaagaggactcttaggcgcttacacctggtttcctccagattccaccatctgtgcttttccctttgctgattctggtttgtattcttttgctacaagagtacaactatacgttggtgcagaagcaattgtagtttttgccattacttttatgacaaaaaacataataa

SEQ ID NO: 215286 - DNA, 474 bp, Homo sapiens
cagcagcgacagcagtttcctccataccactgattcccgctgctattcgtatgtctttatcaggatttccattttgtagaaagtcttaaaaaaaagagcccccaaacaaagatgcacattccagagcctgtaagtcatcatttcaggaagattgactctaaaaattaaaattgaaaccaccacactataacctgaaagttccctgaaataaaagtcctccctccccctttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactttttggcccctttggcccaagtgatttttaacttgggcaaattttttcattgggcccaaatttgggcccatttggccaattcccccttatggggggcggtttaaaattatgggccgggttttaccgtgggccgggccc

SEQ ID NO: 215287 - DNA, 524 bp, Homo sapiens
ttttcatatgacgtttgcatcaatattctgcgtgctgtccctcccccaccccaaccccaatctgtttttaaaaatccacctccgcagaagaggagaggagtgcttcagggaagggtggaggcatccatgtcctcacctttcccagtgaggaatcgagacttcccgccttcgcgatggaactagaaaagggtatgtagtcctggactttaaaagacaattaacagaagtggaaataaggatgtaactatattccgaggaagagcgggcaggaaattcttagctgtcgtagcagaaagtaaatgtctaaaactcataagcctaaaattagccatgcaggtacattaattaattaaccactagacaagcagaattattaatgtaggtaatgcccagtagggggaagaaaaaaggaattgattctgacctgtggcactggggctggggagagatggaaacttctgacaactttgtttatattacaagcccgtctgcaatgttgtttgagttgttgtaagcgtgtgcat

SEQ ID NO: 215288 - DNA, 410 bp, Homo sapiens
cgtcacagggatgccttcatctggtcccagctctctccctctcatagccgtgtactctgttgggagcaattggcatgaagtttggcagtggcatcctgaaccgggatgacaggaccatcagtcagcaccagcctcccgcccctcctggcctcggcctgccaaagcctcgtattcccacagctgtggctccagcctctgccctgtcacactcgcacacctgtttgccatcctgcttctggcccgccagcccaagccacagcccccaagcaggcttaaagggccgggcttgtgggaggaatcggcacaggatggtatttactcaaaatcacacaggacggtgaaacttggttaaaagaaatccttttgtagctgcttcattaaaaacaccaaagaggctgaccattcaaaaa

SEQ ID NO: 215289 - DNA, 515 bp, Homo sapiens
cagttagtctgttatatgccttggtcattttgttggccttcattcagagtatttaaaatgatgatttctgtaaaagttatcacctggttaaaagattgatggtataataatataagcagaacttttacaagatgtgaatttttagtgagcattaacatttggagtcatctatgacaaaactccacagtagcccatggtgtcctctgtgtcatttaccaagaacatgtcaactcaaattgtttttcagggttcactgaggtagtagaaaaacaagggggtagggggagatttagcttaggaaaatcaatggttagaatatgtatctttttagacaatttaataataaaaaaattcattttcagaacatgctgtagtacatagatgttggcttagacagggaagatgtttgcatttggaattcaagattaaattatttttctgtatggagagcaaaggcattgtggtaaagaataaaaagctggattaggtgaatgaattcattttccttactgatt

SEQ ID NO: 215290 - DNA, 437 bp, Homo sapiens
aattaatgaatagagcagcttggagcagctttatttgtaggtccttctgtttgaagcacaatcagtctacttattcaatgatcaggcctgggaaacttagcctgaaaaccaaaacatccatagctgagcagtttctaaacaaaaatcctaaagagagatgaattcctatctcacagcgaaaggtagctctgaaatgaagctccttgatgacatctcatacttgtaacagagatttcaaaaatctgttcatttcatctagggaacatttttctgcaaaggctggtttgagtggttatgtgatccagtatatcattctgcactacacacaatgatgggcaatgttaaaaacagatgaaaatggctgtcttccaagtccagctatgaacctccccacgggatgttgctggacagtacttcggtagcacagttattctaca

SEQ ID NO: 215291 - DNA, 360 bp, Homo sapiens
tgaactatatatggacagcctcaagtgctgaggcaaagggcgttgccgaggacattccgtctgccccagagaaaagaggagggtaactgagaactttgcactgatttctcatgaccttttttcttttggaaaagtggcatgctccataatatgaaaaaaatgtacatttgaaagactgagtgataagtgatatatcatatttattatatgttgtccaaaaagagtcacttatatacgttagtaaaaacatgatttttcttttcatgtcttttcgattcagtaaaataaatgcttagacaaaaatatagatttttttgtgattgaaaattacaaaaataaagtttatctttttttaacaag

SEQ ID NO: 215292 - DNA, 511 bp, Homo sapiens
gtgagttgagatcatgcctctgccctctagcctgggcaacacagcaagaccccgtctcaagaaaaagaaaaaaggaatgaattaataaataaaatgcatttagaagagacagaattgtcattacttgcaggtaatataattatctacatcaggggggcaacccttttctgtaaagggtcgatagttaagtagtttaggctttttgagccatagtgtctctgtcacagctccttaacaatgccattctagcatgaaagcaccaaacagtacagaaacaaatgggtatggctatcttccaataagaataggcagcaggccagatttggtctgaggttcataatttgccagcccttagcctacatagaaagtcatgatgatcaactaataagataactcagctaaatagccagattcaagttgaacatacaaaatcagtagctttcctatgtatgccagcagcaacttattttaaactgtaattaggaagaaagatttatcttgcaagacaaaa

SEQ ID NO: 215293 - DNA, 415 bp, Homo sapiens
cgtctgaaaaagaaaaaagccaacataggaatttttaaaataatatataattaccaaaaattggggaaaatagagacagggaaggcagttctataagcgagataaatctttatcttttgtatcagaaagtcaataaatattgtctgaatttgattggttatttccatttttatgaaatgtctacaataggcaaatctatagaaccagtaaagaaattaggaattcctgtggctgggactgaagagtgaaatcactgcaagtggtcaagagggatcttctgaagtgataggtgtgttctaaaattgggctgtggggatgcttgcacaactctgtaactttgctaaaattcatttcattacacatttagtgagttttatgatatgtacattacccatcaataaagctgtgttaaaaa

SEQ ID NO: 215294 - DNA, 415 bp, Homo sapiens
ttcgtcatcagcttgttatctccactcatagaatgggagcctcttgtcatctccactcagattgtcgggacctattaatacacttggctctaagaggaggagggccgtggacgaacgctaatgccggcagcgccttggtcgtttaggctcaggttaagtgcggaacttgctctatcagttactgttatttcgcgttacatcagcaaaggagatcttcaaacgctgtctgctgacaaggtggaatgggagcttctttcgttacctccacgcgtttgcatcggatcttcggggcctgttagcacacttgtgtataagtcagcagcgcgtactttggagagtgtggctgctttaggtttcacttggtttagtcacatgcggtgtgacggtcattggattaaatgttactgcacccaca

SEQ ID NO: 215295 - DNA, 295 bp, Homo sapiens
ctccagccccacaaggttggttcagctgtctgatcttcttacctatagctttgctgactttaattttcaacaaatatctgctcatgtccttctcctaaagggagtctctttaatagtccctcaatgtattaatgaaaaattccaaattccttccttcacataaacatgtaagactcttcctgacctagtccagcttgcctttacagctgatgtttctttgctcattctcactttcaaagttctacccatattgagccacatgccatcacccggagcttgccatgcactcccacct

SEQ ID NO: 215296 - DNA, 339 bp, Homo sapiens
ttattgtgttgtcatcattgtttttcttttatagattatgagactgaaacttgtgcaggttgtgacttgcccaagtttacatcaataataagtagtaaagaagttattaggaattctgttgaatcagatgaaaacaaaaatgaagtaaagttaatggtatatggaataattttgtgaaatagtattgatttgttaaatgaatcagattatgaaattattggctgtcgatttggggaaaattaaagtttgcatgtgtttacagatatccacacattccagacattatttgttagaaaagttgtttctaaagcgtatatcaataaagaaaccacattttcc

SEQ ID NO: 215297 - DNA, 309 bp, Homo sapiens
ctccagcgctgcagtgcatctcctgggtctgcccttatactccccaggcctaggtttgctgatttttccctcgctgcccataaaggtgttgtggggcccagagatggcagtgtctgctgcactcacacaagttgttgctgaatcgagtgtgtgtctgagctggaggtgcagtgaggagatctattattgccattggtttaataaagaacaaacaacacctctcgccttacagccggtcggtccccccccaccaggtgtgtagcatgacacctgagcaccctcaccaggcccaggatgggcttgtgtctg

SEQ ID NO: 215298 - DNA, 394 bp, Homo sapiens
tcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaac

SEQ ID NO: 215299 - DNA, 520 bp, Homo sapiens
ggttctaaattctcattctgctacttctgatcttggctaatgtatttgccccaatttattagactctgtttcctcaaatgagaaatagcataatatttacacggcagagttaagcattaaagaaaatgtgccctaagtttccaacgcacacctggtctgaaagaggtgctcagtaagccagcagttagtgccttctcctatggctgatggagtgtgtgtctccatgtggagaagaaatgtagattaatcttcctccattttctctcacttgtgtgctctccatctcttcattacttttatttttcattgcgtattctcactttctgctttctttcctattctgtatcttttcattcaaaaatgaatttattatcattcttatgtttatttagagatagtgtcttgctatgttgcccatgctgaatttgaacacctgtgctttaagtaattgatcctcccacgtcagcctcctgaatagctgggactatagacgcttaccacaacactcagctttcactca

SEQ ID NO: 215300 - DNA, 423 bp, Homo sapiens
atgaatgagaattttattatctcttggctttaaaaaaaattctgtcctttgccagatctgaaaatgctgccaacctggaagaaaaagaacccatttttctaaacaacctcatttagtaatttccatgaaattgacattttagaactatgacaaaaagccaaattaaaactcaggggttcctaatccctaaattctgagtccgttttaagaaatacctaaaatacactttaaaacgaaccaattaatataattaccgtgggtttaaataacacatacacactggatttgtttctgtaaaacacagctgttctgttatttacattttgctattttttaaattagaaatatggctttatatattgtacatatatgtaaagtaactttttaaaaagagtgaatctgttgtcttctgccatcattaca

SEQ ID NO: 215301 - DNA, 242 bp, Homo sapiens
cacagtggctcctgacatccaacttccccccaacaagaacttcctaggtaaagcagaagacgtgatacttccctgaccttcctttgtctaaatatgaaacttccatgactggggaccaacggtgagaagcggcagtgggcagggcctagccctcacctgtccctgtctacaggcccacctgacctgcaattaggtttcctcactgtcattctctcttgggccatgtcttacggcatgatact

SEQ ID NO: 215302 - DNA, 546 bp, Homo sapiens
cggtggccccagcatccagcacagagcctggggcacagcaggtgcatggtgactgggggctgggtgagtgagtgagtgaatgaatgaatgcatgaatgaaggagtgaatgcacagaggcccctgccttcctgcctccccgtcgccatgagagaaaggaagcaaaatttcaaacaactcaaagatgtatcagcctggagccgcgggaaacaccagctcccctggcagggtgcatcgacccacggtggggcgggcaggcgtccggctttgtgcaggcggaggtaggagggctcgagatggggaggggggctgcaccaacccgctcggtggcgatcaaaacgcgcccccactccctgcctgggcttcagcggccaagtgcatggggtctgccgatggaggctgcgggggctggaggggggcgaacagcttctgcagcggccaggacagaaaagctctctctcccgacacacaaaagcaggaaggccacattaagcccattatcaatattttgcctggaaaaaatacaaaaagcattttcttctctgaaa

SEQ ID NO: 215303 - DNA, 534 bp, Homo sapiens
acctttcccatctgtgggtcatattttaaaatatttattgttcaagtttaaagatataaccaaaggtataaagaaaaataccacaaacatctgatttaagaaacaaaccagccgagcgcggtggctcgtgcctgtaatcccagcactgtgggaggccgaggcaggcagatcatgaggtcaagagatcgagaccatcctggccaacatggtgaaaccccgtctctactgaaaatacaaaaattaactggtcatggtggtgtgtgcctgtagtcccagctactcgggaggctgtggcaggagaatcgcttgaacccaggaggcggaggttgtagtgagccaagattgtgccactgcattctagcctggcgacagagtgagactccgtctcaaaaagaagaaaaaaaagaaagaaatcatttcctacaccttcgaagccttcatgagttagattttgaaacagtgcaaatgcttcacgtgagaatcgagagtcccttctggtgctctccatccctgcctctatgcattttcggtagg

SEQ ID NO: 215304 - DNA, 612 bp, Homo sapiens
ctagatgcagtggctcacgcctgtaatcccagcactttgggaggctgagacgggctgatcacttgaggccaggagttcgagactagcctgggccaatgtggtgaaaccccgtctctactaaaaatacaaaaattagctggacatggtggcacatgcctgtaatcccagctactcctactcaggaggctgaggcacaagaatcacttgagcctgggaggcagaggttgcagtgagctgagatcgtgccaccatactccagcctgggcgacaaagcaagactctgctcaaaacaaacaaacaaaaaacaagtggacgtgctcttaggaactttcaggaagtctcctagaaagcgaggggaagtgttcctcctctttctttctctaccctgctgcatctccaatgccaatgtgatggctgtagctttaactatcatggaccataagaataaaggccacagcctagggatggcaaagcgatgatcagaaagagactgaagccaggcacggtaaatcatacctgtaatcccaccactttgggagaccaaggcagaggaatgcttgagcccagcaggtcaagtacagcctggacaacaagcaagaccccggctctcca

SEQ ID NO: 215305 - DNA, 246 bp, Homo sapiens
atgtaactaatatctaccagactaaaaataaatcataataaatgcccataaagatgggggtatgaaatgtgaaattgatcctagactttgcccatactgaccatgtgtttatggcactgagagaaaagtccttgaaatcagtcggccttgatttttgtcatcctgcctgtatctctgtgagtgatactattttaaggacctgtaatgaagtaaagatagtgtaatagtctatgtcataaaaagtga

SEQ ID NO: 215306 - DNA, 930 bp, Homo sapiens
gaaacttactgagtctctttgcttttcatggcaacgtagttttatgtaaaagctcaataagaatatcttctccttcttactaggatataattggatgaatcagttgtacaaccagggccttacctggagtgtcctttttgagaatgatgcttattttatcagaagtaaccagccacttttcagaagctaaagttgacgttacttatggagccaatgcatacaaagccctcctaggaaaactggctggtgtctggcttataggatcccagccttacaggaggtgaggaatattattcccgtcaggccagaaactcaagaaatttggaggaatttaagaagaaagaaattcacccaaacatatagatactatgggtgatattttttggtaagagtttctaaaagatcatttgggattccttattaaaacttctagacagaagttaactttgtaagtgattaatactatatggacctggattttgcaagccaaacttaagaataatcttcctttgaaattgttatgatcacgaaaggaaagcagacgctagggaaaaattgtgaaagactgaaatagaccgaaaggtggactggtgtcttcaatggaaaactatgccttgttttagggcacccccttccaagttttctgattctataaatgatgtgcctttcattatctttgagctcctatatagaacacttataggaatgtaaaaagttcttgtctatagaaataaaaattgtgttcagtgaatagcaattgattattgtcccatggatattaaccaattttacatctatttttacattcatttcagcattcctgattcaacgataaaagtgtagtacattgaattctcctatatagcatcttactggttcccttatgagttaattaagaagttaaataaaatctttgatgtttcatcctat

SEQ ID NO: 215307 - DNA, 576 bp, Homo sapiens
aatttcagcaagaaacattaaggacaggactgtatggaaaattaagagtagtcatgaggaagcaaggtcacacgtgggtacttctttggtgtcactgctggagcccttctatgatatcagtttcttcgaaggcacaaccatggcatgatctactacatatgtttgtacctgatggcagtcatcaaaatgccagcgcaagtacacaaggcaattcggagccaaaactgagtggggatggctgtgttatttacgtgcactaaacacagaaatgagaacaaggagttctaatctccaatctattgctgacttacttattgggaacagtcacttacacattttatgggtcagttttccttgacacataaaggtatttcaaaggttactagtaaacaaccccagcacactttccaaacagtcaaagctgtatgactttccccccttagaggatggagcatgggccaactccacattcttcactacctagcaccttgccatcatggaaggtatacgtaaatacgtttgttgttgatgaacctgagttctgggtcattcttagctttagaagtttcctgcaat

SEQ ID NO: 215308 - DNA, 423 bp, Homo sapiens
ttctggcagcttttgagctcaccggaaaaaaaaaattagactttggccaggtatggtgctcctccctgtgatcccagaactttgggaggctgaggcaggattccttgaggccaggagttcaagaccagcctggtcaacatagtgagatctagtctctatttgaaaaactttttaaataaatttaaaagttagacttttttttggctgggcacggtggctcacgtctgtaatcccagcactttgggaggccgaggtgggtggattgcctgaggtcgggcgttcgagaccagcctgaccaacatgatgaaaccctgtctctaataaaaatacaaaattagctgggcgtggtggcacatgcctgtaatcccatctacttaggaagctgaggcaggagaatcgcttgaacccaggaggcggaggctg

SEQ ID NO: 215309 - DNA, 485 bp, Homo sapiens
agcttccgacttagtgatgtcatgctagctgcttgaaattggctatggtgagagtatttacaccatggaaattggcaagtgctacaaaccagggtttccgctgcacccagagagccagttgttaaacataccagcataccactgaagaagcataagcgaaaccagtgatgagggtacgccctgcccccagtaacagggtattgttggcaagagtaaattggagtagcataaacaggggaacttaacgaaatgtccaaaagattgttttcagatacataaggagttgctatgaggttaagaactttggtgtcaaccagaaccgggcttaagacccagttctacctcaaagtgagtctacttcacgaccctaggcaggtcatttaacctttctgggccttagtttccttatctgtagcttgagaataatttaataacttgagttcttacctcatggacttctttttttgagattgagtctcactctg

SEQ ID NO: 215310 - DNA, 392 bp, Homo sapiens
cacctggccagaataggtttttaaagtgtcaggcatagtataaaactttttcttccatcttttgttcagctccaggagctcttcagttgctgtagtattttagctgtcccactgggtatacactcccaaatgtgtttgcattatggcattttaggatggaaatcggtcttatacagcactgtatctatttccttccagtccccaactgccccaccaacctagataagcaaggcctcctcgtcccccaatagcactaatcacattctaacatactgttaattacttcttatgtttattgtttatttgtctcttcctctggaatgcagcaagctcagtgaggtcaggaatgtttgtgtgtttatcagtacagcctcagcaccccgaccagtgcc

SEQ ID NO: 215311 - DNA, 209 bp, Homo sapiens
ctggactagagatttaaactttggagttgccaactttcaggtggtaattaaagccatggggctgggttacctaaagggaagcatgtagaaggctcgggattcctgtgagaattccaacatatgtagatatacatatattttgagacggagttttgttctgttgcccatgctggagtgcagtggcatgatctctgctcactgcacctctg

SEQ ID NO: 215312 - DNA, 407 bp, Homo sapiens
cagttgcaggaactgaggaggagtagaatgatagaatgatttataatatcattgtaaaaataatgttagaaagcaaaaatttttgactctaagcattttagattatatgcctgaggaatggtggtgttagaaataagggtaagaggagtaactttaggtgaggccgattctgggaccttttttttttttttaacttaaaaaaaaatgttcttcttctctcatgctgccttgtctaagatgggacaccttgaggttgaggtgatggtggagtatccagctgtgatatctgtcctagaaagttgcagatactggattaaatcttgactgaggttcaaatcagagatatagattagtaatacttagcagagaggttacagtcaaagtcattagtcaagcagtaaggcaaa

SEQ ID NO: 215313 - DNA, 466 bp, Homo sapiens
ggtggaagttttaactcaacacagggccccagctcagcctttaatatcccctgagcagtttaaacatttgaaagaccagcaaaagattatcattcagcagctaaatacccctggaaatgatgaacttccgccaaatctatcaagagcccatgactccatctccaactcagctctcctcagacattgtcttgagacaaactcaaccttaattgtcaatcagaaaatgtttaaattcacctatagcctgaaagcccccaactccactttgagttgttccacctttctggaccaaaccaatgtatttcttaaatgtatgtgattgatgtctcatgcctctctaaaatgtataaaacgaagctacgccctgaccaccctggacacatgttctcaggacttcctgagggctgtgtcatgggccatggtcactcatatttggctcagaataaatctcttcaaatattttaca

SEQ ID NO: 215314 - DNA, 234 bp, Homo sapiens
ggtggaagttttaactcaacacagggccccagctcagcctttaatatcccctgagcagtttaaacatttgaaagaccagcaaaagattatcattcagcagctaaatacccctggaaatgatgaacttccgccaaatctatcaagagcccatgactccatctccaactcagctctcctcagacattgtaagttcgtttaattgtaagatggtattttcatctctagatgtgtctt

SEQ ID NO: 215315 - DNA, 486 bp, Homo sapiens
gtcgggccgcgcgggagcccccgaggcgcagggtcccgcggcgcccggcacgacagccccggaggggggcgaccgctgccgcggctactacgacgtgatgggccagtgggacccgcccttcaactgcagctccggagcctacagcttctgctgcggcacgtgcggctaccgcttctgctgccacgacgggccgcggcgcctcgaccagagccgctgttccaactacgacacgccggcctgggtccagacaggccggccgcccgcccgcgcccgcgacaccgcagcgccccgggaccccggccgcgagcgcagccatacggccgtctacgctgtgtgcggcgtcgcagcgctgctggtgctggccggcatcggggcgcgcctgggactggagagggcgcacagcccgcgcgcgcggcgcacagtgaccagggcgctgacagagcttctgaagcagccgggcccccaggagccactgcctcccaccct

SEQ ID NO: 215316 - DNA, 416 bp, Homo sapiens
caacacagttaggtttcctagtgagtattaggaaaaaatgtataaccttcacgtcaaacccatgacttcacagcttattaacattgcaacttcagtactttagagtagcagccagtgtgtagttgatgtgcccgcatctgttgaatgtgtgtgtgagttagcgaatgagcttcctagcttcttcagcaaaatgctgtctctctctttttttttttttttttgagacggagtctcgctctgtcacccagggtggagtgcagtggcgcagtcttggctcactgcaagctccgcctggcgggttcatgccattctcctgcctcagcctcgcgagtagctgggactacaggcgcctgacaccatgcccggctaattttttgtatttttagtagagacagggtttcaccgtgttagccagg

SEQ ID NO: 215317 - DNA, 340 bp, Homo sapiens
ccagcactttgggaggcagaagcggtggatcacctgaggtcaggagtttgagaccagcctagccaacatggtgaaaccccgtctctactaaaaatacaaaaactagctgggcctagtggcacatgcctgtagtctcagctaggcaggagaatcacttgaacccgagaggtggaggttgcagtgagccgagatcatgtcactgcactccagcctaggcaacaagagtgagactcaaaaacaaaacaaaacaaacaaacaaacaaaaaaagtgcttagagcaatgcctaaaatatagtaagcactcaatacatttaagttttcttttctttttttttttttt

SEQ ID NO: 215318 - DNA, 366 bp, Homo sapiens
tctgttttggtaccagtaccatgctgttttggttactgtagccttgtagtacagtttgaagtcaggtagcatgatgtctccagctttgttctttaggcttaggattgacttggcaatgcgggctcttttttggttccatatgaactttaaagtagttttttccaattctgtgaagaaagtcattggtagcttgatgggggtggcattgaatctataaattaccttgggcagtatggccattttcatgatattgattcacttctaaaacatataccatttactaagaaatctgttaaatgttcaggtggttttgcacagttttctaggcagaatatttaaaccatatgttcagtaataggcacattt

SEQ ID NO: 215319 - DNA, 501 bp, Homo sapiens
ccgaactgctgggattataggcatgagccactgtgcctggcaggtagtttctttatctgtaaaattgtgataataatttttacttttcagggtttttggaaggattaaaaatgaattgaggtatataaaatgcctagcatatgctaagcattcaataagtggtagctatcattgtcaatattagcagctttgctatagagtgaatgtttgtgtcctcccaaattcatatattgaaatcttacaccccacagtgataggatagtggggtctttgggaggtcattagttcacctcataggtgaagctcttatgattgagattagtgcccttataaaagagaccctagagagctagcttgccccttcttccatgtaaggtgatagtgagaggttggtatctgcaacctgaaagagggccctcaccagaactcaaccactggcaccctcatgttggacttccagcctccagaactgtgagaaataaatttccattgtttataagc

SEQ ID NO: 215320 - DNA, 260 bp, Homo sapiens
aagtctctaggaaaggggcaagaacaacccaaaataccagttcagactaagaaatcgaagggtttttcatcttagtggctggggtgagaatgcgggcttcagggctggcttgatccagtgacttagcaatgtcaggagagacccggtctctgttctgccttctaccagggtggcctctttggaaacatggtcacctgtggttgccagatggtggctgtttctgtggctccatctatccctcctccctcaatcgtgtagag

SEQ ID NO: 215321 - DNA, 606 bp, Homo sapiens
catggtggctcacactataatcccagcactttgggaggccgaggcaggcagatcacctgaggccgggcgttcgaggccagcctgaccagcatggagaaaccctgtctctactaaaaatacaaaattagccaggcatggtggggcatgcctgtaatcccagctactcaggaggctgaggcaggagaatcgcttgaacccgcgaggcagaggttacagtgagctgagatagctgccattgcactccagcctgggcaacaagagcaaaactccatctaaaaaaaaaaaaagacaaagagaagtagatggactgatgcaatgttaaagaggtattaggaggacaggatcatgaaggagatggaagaattgaatttcactctgtaattctggtttgagatcctggactaatgggagtaccactcatggatatgagaaaaggtgagaaataagaagaaaggtgagagacataggataatataaattagagatatgttgagtgtagctgctaggattgcattcaagtgaatgcaagaaaatctaatgtagtggttaattcttatttagtcacacagcaaaacctgggagtgtgcaatccaggctggattctgt

SEQ ID NO: 215322 - DNA, 371 bp, Homo sapiens
cagttggaatgcagaatggtacacctactttagaatatagttaggcagtttcttacaaaaccaagcatacccttatcgtgtgatctagcaacctggctccttgagtcacatgagttgaaaataacatctacccaaaaacttgcacacaaatgtttatagtagttttgttcataattgccaaaacttggaggcaacccagatgtctttcagtaggggagtgggtaaacaaagtttggtacatccatagagtaacgaaaagtaatagtagtaaaaacaaaaaaaagctatcaagacctgaaaagacatgcaggaaccttaaatgcatattgctaagtaaaagaagccagtctcaaaatgctccacactgtatg

SEQ ID NO: 215323 - DNA, 140 bp, Homo sapiens
tgagtcacaagacataagatctctctctatggcaccaacacaatttacagcatcctcccttgacttttgggtattgtattctctgacattctaccttttcaaccacttcttctaaatctatcctaagccttagtgtcttc

SEQ ID NO: 215324 - DNA, 212 bp, Homo sapiens
gccgggcggggcgaggcgaggctgtgggcggctgctgcgctcggcttctcccgtagcccggaggaaagaaacttccgtgggaggcttccatcggtgcgcacacctcccgagggcgaggcagcgaccgggagagggagagccggccggaggctgccgggctcctgtgggaccgcgctgcagccggggaggcggagaaggggaaccggggcgag

SEQ ID NO: 215325 - DNA, 641 bp, Homo sapiens
ttcaaagtgtaaataggaatagaaaaggcttggaaggacgggagaagggggaggtattctggtttatgagtacataaataagtacttggaagcttagaagtgcctggaatatctgatgtgagttgaagcattgagtgcattaaagaataataatttgagccagagtcaaactaggcttgattcttcaggcctgatattgtttcatgccagcagaggtgggagagagagggtttctcagctcattgatgtaatgagccactgtgactaatggaaattgcgtattcttcaggtaggttggggtgaagttcaggtagttgagaaattcacagctcagagagcctgtcttccttagagagagtataaaaattgactctcagccaggcacgggtggctcacgcctgtaatcccagccctttgggaggccgaggcaggcggatcatgaggacaggagattgagaccattctggctaacatggtgaaaccccgtctctactaaaaatacaaaaaattagccgggtgtggtggcaggcgcctgtagtcccagctactctggaggctgaggcaggagaatggcgtgaacctgggaggtggaacttgcagtgagccgagatcgcgccactgcaccccagcctgggcgacag

SEQ ID NO: 215326 - DNA, 504 bp, Homo sapiens
cttcactgctgagctgccgccactgtcctccgtgcgcggagtgtcgctgaagtcactggcgtcactaaccaaggcgtgcccgcccaaggtgccctggtcctggtcgtccctatcgatgacccttcgtcaatacctcaggtctaaaatgctttcctccgagcccgagttcctcctgtcgggcaaactccgccctgtctgtgccttgctgcttggccagggcccgccgtccttcttcgccagcaagtgtgggcttccaaagacagggctgggcccggcctgggcctccctgaaggcagagaaggacgggccctgtggaggcagccccatgtcgggctgaagaggctggcctgcctgcccccctgggagacaccctttccaaaatggaagagctgggtggacagcgcggggagaagcccacaaggggtaggctgggcaggccccaggcggggccctcggaccccttgtctttcccgctcccgacgccccgcctccactccgcatctc

SEQ ID NO: 215327 - DNA, 342 bp, Homo sapiens
atactgcatgccttgttttgaactaagacatgctaacttgaatgtgcttttgtacctcaagttgaatgattctgtgagaaacaaaactttgaaaaatgcagtttctgcccacctctaggaagtaactaagtggttctagacattctttcactgagatggtgtgaatagtatgagatagtgtaggaaaaagctatgaatttgtctttcatgagttaaaaatcagtaattgtgttcactccaatgcaaatgaatttggtctcctataggaatgttaaagaaaacagtatctcaattgtattttgcttgtatgtactacattgtgtatggttgaattaaatacca

SEQ ID NO: 215328 - DNA, 755 bp, Homo sapiens
ctcaggcaggagaatcgcttgagcctgggaggtggagttgcagtgagccgagatcacgccactgcactccagcctgggtgatagagcgaaactgtctcaaaataaaaaataaaaaagaaagcaatagaactcagacttcaatgaaaggcttatatctaattatgagtccagtgctgcttccactttgcagttggtagaggagacagaatctttgagtattttttctaagactgataggtttgacgctcaggcaaagtctagagtaaaattaacattaaacatggaatgaaagcaaagcaaatgatttgaatcatgtgataacccagtgtccaaacagtgctcaatacactctgccatttttgaatgatagtaaactaatccgattgcattgcctcatttgagaaaactaaagctaagtttaaaaaaacaaaaaagtgagccaagaccacatctggcaagatcacatttatatgcaatggccagaataggcaataggcaaatccatacagacaatgcagattagtacagtttcctgatactgggggaggggaggggaagattggtgcacatctctgtgaatgtactaaaaaaccactgaattctacagtttatataagtgaattatatggtatgcgaatatgtctccataaagctggtaccaaaagaaagtgaactaatagttacagtttgaaaggtttcacatataaatttggatgccttgctatttggggaaaataaatgtgagctctggcaat

SEQ ID NO: 215329 - DNA, 316 bp, Homo sapiens
gttgtccaggcttgtctcaaactcctggcttcaagcagtcttcccacctcagctttccaaatagctaggactacaggtgtgtgccaccatgcccggataattttttttgtagagttgaggtcttgctatgttgcccaggctgctcttcaactcctggcctcaagcgatccccctgccttggcctccaaagtgctaggattacagatgtgagccaccatgatggcctgtagttttcaatgtagaagtctttcgcctccttggttaggtatattcctaagtattttattgtatttgatgctatcataatttgttttca

SEQ ID NO: 215330 - DNA, 403 bp, Homo sapiens
caggcctgggggtcgccccgctctcaggcaatatttagggaaaacccatcttcagctttcacgtgttcttctgctcccagagccgattggactgggaccggacggcccggaatggggacgcactgaccacaggcggaacccgcagcagaaatcccctctgccctcaagccagggtggcgggaaaggcggggccccgtggtccgagattcgagctgagacctcagcagaactgggtttgaaccttaaaaacgatttcctggttcttattccccgaccccaacaatttctgctcagagagcggcagaaccaaggaaccttcttgactgcccgtggatgactatttgtagacacaagtgtggcctgggactttcgcacctgcctgggagggagacctgcgcggccg

SEQ ID NO: 215331 - DNA, 588 bp, Homo sapiens
gttgaacataaagtttatatgaaaaataaacaagtaaaaaaatccaggaaaacccacaaaaaggagtatttgaggagggaaggtagacctaccagatataaaaacatattataaagtctacacattgtcaggtgcagtggctcacgcctgtaatcccagtagtttaggaggctgaggcgggtggatcacctgaggtcaggagttcgagactaccctaaccaacatggtaaaacctcgtctctatttaaaatgcaaaaaattagccaggcgtggtggtgcaaccctgtaatcccagctactcgggaagctgaggtgggagaattgcttgaaccagggaggtggaggctgcagtgagccaagatcgcaccattgcactctagcctgggttgacagagtgagaccccatctcaaaataaataaataaataaaaataaagtctacataattacaaccgtgtgattctaatgcaagaccagaggaacagaatataaataccagaaagaggttcaaacacacagggaaatttcatatatgataagtgtagcatttcaaatcactgggtagaaaagttaatagtttttaatgaat

SEQ ID NO: 215332 - DNA, 379 bp, Homo sapiens
acaccaagttgaatatatgatcccagctgtttcaggaaaaggacccccaaaccctgtgtatagaaaaagattataaagggctgggcacggtggcccacacctttaatcccagcactttgggaggccgaggcgtgtggatcatgaggtcaagagatggagaccatcctggccaaccaacatagtaaaaccccgtctctactaaaaatacaaaaattagctgggcatagtggcacacgcctatagctactcaggaggctgaggcagaagaatcgcttgaaccggggaggtggaggttgcagtgagccgagatcgagccactgcatccagcccaggcaacagagcaagactctgtctcaaaaaacaaacaaacaaacaaaaa

SEQ ID NO: 215333 - DNA, 719 bp, Homo sapiens
agtatacatgaaacaatgttggttatgagttgataattgttgaagctggataataggtatgtgaaagtttataccattctctctacttttgtatatgtttgaaatttttcattataaaaagtaaagcttccattcttcgcgatgatgaagtaacaggaaccatatttactgtctcactggaaaccactaaaagatgtgagtatgtcaaatagaggttttcagacattggacaacaggcagcacaggacagtgatccttgagagaaggggtagaaaacaaagtgagccctatgattgcctcatcttactgcttggaaagagtttccacaccacaatgcacgtagcatgacagaataacactacagatcctatagacattaaaggatattaagagaatatgattaaaaacctcatgccaataaatttgacaactttgatgaaatggacacatttcttaacactaaactaccaaaggtcactcgagaagataataggtgactagactaaccttatatttatttaaaaaatttaatttctcattaaaaactttaccactaagagaacttcagtcccaaaatcttcactggttaattctaccaagcatttataaaataatcccagctgagtgtagtgcctcacactgtaatcccggcactttgggaggccgaggcaggtggagcccttgagtcaggagttcaagaccagtctgggcaacgtggc

SEQ ID NO: 215334 - DNA, 444 bp, Homo sapiens
gtttcagaaaacaatagggccgctcccagctgggacgtgagtctctggattaggcaggcagaggcagttatgggcttctgcagtggcgagaaaggaagcgcctgaagggtcgtgaggctggggcgggacccggcaccgctggggcggccaggccgtgaggacgccaatggctagttccccatgccctcagccatgggggaatctgtcccgggccgctgaggggctcccctgcccctcctgggagcttacctgggacccacctcggcgacggagaccgcagcagctggagaggaaggggtgaggcgtgggatcgccaggagtagggaggacatcgacgatgtgcccgtagcagtcgcccctccctcctcgcgcacggggtactgaggcggaaggtttgaaggttacggctcagggctgccccattaaagtcagtgttgtgttcta

SEQ ID NO: 215335 - DNA, 1585 bp, Homo sapiens
gtttcagaaaacaatagggccgctcccagctgggacgtgagtctctggattaggcaggcagaggcagttatgggcttctgcagtggcgagaaaggaagcgcctgaagggtcgtgaggctggggcgggacccggcaccgctggggcggccaggccgtgaggacgccaatggcgagcagcgtggacgaggaggcgctgcaccagctgtacctgtgggtagacaacatccctctgtcccggcccaagcgaaacctctcccgggactttagcgatggagtccttgttgcagaggtcatcaagttttacttccccaagatggtggagatgcacaattatgtccccgccaactctctccagcagaagctcagcaactggggtcatctgaacaggaaggtactgaagaggctgaacttttcagtaccggatgacgtgatgcgcaagatcgcgcagtgcgccccaggcgtggtggagctggtgctcatcccgctgaggcagcgcctggaggagaggcagaggcgcaggaagcagggcgccggctccttacaggagctggctccccaggatggcagtggctacatggatgtgggtgtatcccagaaggcccgaggtgaaggtgtcccggacccccagggagggggtcagctcagctgggaccggccgccggcgcctcggcctccagcgtataaccgggcgttgcagggcgaccccagcttcgtcctccagatcgctgaaaaggagcaggagctgttggcctctcaagagaccgtgcaggtcctgcagatgaaggtaaggcgcctggagcacctgctccagctcaagaatgtgcggatcgaagacctctcccggcggctccagcaggcggagcgtaagcagcggtgagcggcggcccgggccgcgcggggacgcccgggtacccgccagagccccgacgccgcgccggacccacccaccgatggatagaccattgggagggcggagcccgctgctctcacgagcctgctggggcccgagtgccctccttccttgggatgggtgagcgtgggaggagatgggacaggaactctaggagcgcaggcccgggactgagccgcctcctaccactccggagatccgggtcaggagaatggaccgctttccagagcccagaagccacgtgcagagacctagcctgtcccccaaagcagtgtccaacaccttgggcccggccttgcatctcccggcgctgggccttggggggcggtcccttggctctgtccacacccccagaatcaggtccccgcccagctccgaggacggcggcgtctccatccaggctagttccccatgccctcagccatgggggaatctgtcccgggccgctgaggggctcccctgcccctcctgggagcttacctgggacccacctcggcgacggagaccgcagcagctggagaggaaggggtgaggcgtgggatcgccaggagtagggaggacatcgacgatgtgcccgtagcagtcgcccctccctcctcgcgcacggggtactgaggcggaaggtttgaaggttacggctcagggctgccccattaaagtcagtgttgtgttcta

SEQ ID NO: 215336 - DNA, 1729 bp, Homo sapiens
gtttcagaaaacaatagggccgctcccagctgggacgtgagtctctggattaggcaggcagaggcagttatgggcttctgcagtggcgagaaaggaagcgcctgaagggtcgtgaggctggggcgggacccggcaccgctggggcggccaggccgtgaggacgccaatggcgagcagcgtggacgaggaggcgctgcaccagctgtacctgtgggtagacaacatccctctgtcccggcccaagcgaaacctctcccgggactttagcgatggagtccttgttgcagaggtcatcaagttttacttccccaagatggtggagatgcacaattatgtccccgccaactctctccagcagaagctcagcaactggggtcatctgaacaggaaggtactgaagaggctgaacttttcagtaccggatgacgtgatgcgcaagatcgcgcagtgcgccccaggcgtggtggagctggtgctcatcccgctgaggcagcgcctggaggagaggcagaggcgcaggaagcagggcgccggctccttacaggagctggctccccaggatggcagtggctacatggatgtgggtaaggtggccttttccatttctccctcccggttggagctttccttctgtccttcttcctgtcacttgtaagagtggaagtagggagggggaagcaggagaatgagactccagcacagtcattcctccacttgccttgtctcaggtgtatcccagaaggcccgaggtgaaggtgtcccggacccccagggagggggtcagctcagctgggaccggccgccggcgcctcggcctccagcgtataaccgggcgttgcagggcgaccccagcttcgtcctccagatcgctgaaaaggagcaggagctgttggcctctcaagagaccgtgcaggtcctgcagatgaaggtaaggcgcctggagcacctgctccagctcaagaatgtgcggatcgaagacctctcccggcggctccagcaggcggagcgtaagcagcggtgagcggcggcccgggccgcgcggggacgcccgggtacccgccagagccccgacgccgcgccggacccacccaccgatggatagaccattgggagggcggagcccgctgctctcacgagcctgctggggcccgagtgccctccttccttgggatgggtgagcgtgggaggagatgggacaggaactctaggagcgcaggcccgggactgagccgcctcctaccactccggagatccgggtcaggagaatggaccgctttccagagcccagaagccacgtgcagagacctagcctgtcccccaaagcagtgtccaacaccttgggcccggccttgcatctcccggcgctgggccttggggggcggtcccttggctctgtccacacccccagaatcaggtccccgcccagctccgaggacggcggcgtctccatccaggctagttccccatgccctcagccatgggggaatctgtcccgggccgctgaggggctcccctgcccctcctgggagcttacctgggacccacctcggcgacggagaccgcagcagctggagaggaaggggtgaggcgtgggatcgccaggagtagggaggacatcgacgatgtgcccgtagcagtcgcccctccctcctcgcgcacggggtactgaggcggaaggtttgaaggttacggctcagggctgccccattaaagtcagtgttgtgttcta

SEQ ID NO: 215337 - DNA, 643 bp, Homo sapiens
aactactctcttttaaacaggaccctccacttttccaccagtttgtccaccggtgaaaaggagaagccagccaagaaccagcagcttctggctaccttgatcagaaggttgatgaaggcaatgaaacaaagatggaaaaacacatcacacaggcccttaccagatgccagcatcttgatattggacttcccagccttcagaactcaattacaaagatatgctaatgctctgcaccaagtggcagctacatgcttgagaccaacactgaaaatcagtcatggaatcactgcatatctgaacaagggccacgagaggaggcacagatgggtcaactgacttgagcagagccacccagcaaattcagcgtcggagtatgcttcccttgcctgagaatcgttacaaagaggagcatctgatgaggaaatgagaactccagccagaaaccagcaataaattgagggctcctatatgagcaatgcattctccagccccaatcaagcctttggataactgcagctcctgccagcattttgactgcacttcatgaaacactttgagtcagagccacctacctaagccactccaaaattcctgaccgtcaaaaactttgagataataaatgcttgttgttttaaactactac

SEQ ID NO: 215338 - DNA, 497 bp, Homo sapiens
aactactctcttttaaacaggaccctccacttttccaccagtttgtccaccggtgaaaaggagaagccagccaagaaccagcagcttctggctaccttgatcagaaggttgatgaaggcaatgaaacaaagatggaaaaacacatcacacaggcccttaccagatgccagcatcttgatattggacttcccagccttcagaactataaggctccagtcaagcaacccaccttatcaagtggaccaggcacagctcctacttatccctgagtagtgggtatcagtttcctgctaacctcggaattgttcaaagcccatcacattctcctgcaggaaccagggagcacctcaccctcttgttgctacaaagcttgccacccacagcccctgcctgttcaccctgctcctgagggcaacccctgtatggccagcatcccatgctgtgttcacctctcccaagctgcgagtgtatgtgaataataactgccgtcaatcgca

SEQ ID NO: 215339 - DNA, 2166 bp, Homo sapiens
aaatgtttaaaagttagctatatttatacaaggaaaaccaaaagaaatacttaaatgagacttttaaaattcgaggctctccactgagacttgttccctggcgccacgccgggagttccgcagagcctcgccccctgccagggcgcccgggggcaaggaccgcacgggcatgccgctcctccagcagtccctttccccttcttccccaagatccagcgcgtgctcggttgcccttctccgttccttgcaggcccttgggtcaggacccaccacctgccggaccatcattttccgagtccctccggcctagtcggagtgctcgctcgcgcctcctaaagctctcagccgagcgcgccgagacccctcagggcggccgcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggatgatacatggaagagttttcaatgccctagtgatttttccttatgatgcatgctgctggaccactcccctacaacatcagttacatgtgtgctccaggaatacaaactgatatgaaaaatgacttatggtagatgtagttaagacagtcaatatattttaacattagaaaatacagtcagtccttcatatccatgggttttacatccatggattcaaccaacctcagactgaaaatattaggggaaaaaaatacatctgtactacacatgaacaaacttctctttcttgtcattattccctgaacaacacaggataacaactacttacatagcacttacattatattagatattataagtaatctagaaatgacttaaagtatatgggaggatacacataggttatttgcaaatactacactattttatatgagagacttgagcattcgcagatttcggtatccacgggaggtcctggaaccaatcccctatggataccaagggactgctatgtattacaaagccacatgctttggaattacttcagtgttccttctattttcattaacactgatatctagtttaatatgaaaaggaacttgaaatcttgaaaattagaacatcgttatttttttctacttgcaatggaaaatctattttgcttttttgcttctaggaaaatattctgattatgatatgtgatatgttggctactcaaagtcagaacttttcaaagtaatcagtaaattgaatcaacagaaaaatattcattaactcggggatgcattaataaagtttttaaattcaaaatgtatagaaaaatcaagcttagtaatactttaatattattctaccaatgtattttttttaattaagacttctgtatgcagcagggcatggtggcacacctgtagtcccagctactagggaggctgaggcaggaggattacttgagcccaggaattcaagcctgggcaacatagtgagtcctcatctcctaaatttaaaaaacaaacaacaaaaatttctacgtgtggtaaagggttaactcagcaagcttgggttgcttaaaccttgcacattccaaagaaaggtctgaccccagtgctgacctttgactggctactgggaaatgagctctgagcccctggataggaatgtttctgtttgcctgaggcctttgaccatgccagatagtttatgctaacaatgtgatttatagtgaatacctgttttcctgtgtctaagaccctgggctgcactgtattaatttgaccttgggtatttggggagctgagactgagtagctgaagtgagtcacataagcactaaatgcttacctgactgacccccagtaaaactctggacatccagacttggatgagcttccttgggtggcaacacttttacgtattgtcacacaccattgctggggggattaagcactgtctgtaaaactccactgtgaaatgacaactggaaacttgcacgtggtctctcctgattctgctctattcaccttttccctttgctgattttaatctctattcttttgttgtaataaaccataatggtgaat

SEQ ID NO: 215340 - DNA, 1060 bp, Homo sapiens
  misc_feature (604)..(604): n is a, c, g, or t
aaatgtttaaaagttagctatatttatacaaggaaaaccaaaagaaatacttaaatgagacttttaaaattcgaggctctccactgagacttgttccctggcgccacgccgggagttccgcagagcctcgccccctgccagggcgcccgggggcaaggaccgcacgggcatgccgctcctccagcagtccctttccccttcttccccaagatccagcgcgtgctcggttgcccttctccgttccttgcaggcccttgggtcaggacccaccacctgccggaccatcattttccgagtccctccggcctagtcggagtgctcgctcgcgcctcctaaagctctcagccgagcgcgccgagacccctcagggcggccgcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggaaatcaatgaaaattctnttaaaaggttaagtgtctacctagaaaacctccagaaaccaggcttcaagtctttgaaaccaactcagcttacattttatgtaagagaaacagaccagagttcctccgatggccaggaaccttttagtacttccgtttatctgttgaacatatccaaagcttgaatactaatatgcatacccagcctctcaaagaagctaaaaggatgcatgacaggcccatcaaatgggacaagtcttattactcctttactggattcaaggaccctgactgaaagaccttgaacaagtctcgagagtggaaacaattctcacatcctggttagagtagcatgtggaaaagtggctgttaaagctaaagaacgtgttgccctttgaaaagaagctagatcgcttaaagatgtaccgtcttcatcattgcacctcacattccggtggccaagacctgggattgccc

SEQ ID NO: 215341 - DNA, 466 bp, Homo sapiens
cttgaacactgaagggggaaccatgtgagaatggtcctgtgagaatggttagtttttgatatattaattctctcaacaaaccatttgaatacttaatatggtccaaactctgggctaggagctggaacagcaaagacgaaccaggacaaaaatccctgactcatggagttcttcagtttaattatgagacagacacatgagcagatagttaagatatgtgataagatggagatagaacacagaagcgaggcgtctaaccaaggagaggtgtcagaaaaaagctcttcctagagcaatctagggttggatctaagagccacctgagtaaaggcatggaggcaaaaaatagcacaattgatgcagagaaatataagaagttgagtgttacctcatttattcaacaaataatctgtgtaatgcctgtcatgtgccaggcactattccaggctcttgaaaaatactagtg

SEQ ID NO: 215342 - DNA, 404 bp, Homo sapiens
gatgggaggactacttgaggccaggagtttgagacaagtctgggcaacatagtgagactccgtctctgcaaaaaaataataataataattagctgggcatggtgatacatacctcctagctactagggcagctgaagtggaaggattgcttgagcccaggaggttgaggctgcagtaagctacaatcacaccactatactccagcctgggcgagagagcaaagccctgtctcaaaaacgaaaagaaagtttgttatactcacagatcctcagagaaggagcacaccatgcaggaccaagcagagaagcaacagggtcaagcaggaagagaaggaaaatgtgggcaagaggcttgattgtggtttccatgggacggaatgggtgaggcagagtaaacagctcgag

SEQ ID NO: 215343 - DNA, 469 bp, Homo sapiens
gagtccatggcagagcatggaagacttactagctcatggcattaagggaaacttctgactaatcattggctgacaactaagctaaccaagcagagatttcagtggctacacaattcagcatcctgtaggataccactaaacatagtcaaatataaatgagcatgccagagacagatgagagagataaggatagagagaatgtttgaacatatcatgtctaaaaattttgaaatctgacagaaaattcgatggcttttatctatacatataagattctcaacaaactccattaggatgaaatcaaagatattcaaacctagacatatcatggttttatttacagacactatgctaattcatataaaaatctatgaaatctacaaaaaaaactactaaaactaataactgtattctgcagctctactgaactcagtgtcgacgcggccgcgaatttagtagtagtaggcgg

SEQ ID NO: 215344 - DNA, 129 bp, Homo sapiens
agtagaccatggtctggagccccaagaagaggttaaagatgtaaatttgggatgatgtgcttatttagccccttttaaatgaattttatattctgtggttaaaaagaatctttgatttgttaatttaat

SEQ ID NO: 215345 - DNA, 329 bp, Homo sapiens
gcagatccacatcttcccctcaggaaatgcctggtgcagatgaccacaggttgttggaaggcagagactggcttcaggaagagccttgactgggctgtttcagtagtccagggagatggtgagaagggcccctgttgcagccacaggacagggagtgtgaacctgcaaacactggtggctgagtggatagagggtagaaagagcatgatcgaaggaccgggatgatcatgcctgggacgaagctagtgctgtggggtttccacatgcggatggcaaggaactatcagaaatgtggacgcgaggctagggagagagaccaggagtagagg

SEQ ID NO: 215346 - DNA, 463 bp, Homo sapiens
tggtggacacctataatcccagctactcgggaggctgaggcaggagaatcgcttgaacctaggaggcggaggttgcagtgagccgagatcgtgccattgcactccagcctgggcaacaggagcaaaactccatctcaaaataaataaataaataataaaaaaaaataaataaataaaattaaataaaagccatacacagccagtggtgagaatgtgtcatctatgaggtataatcactatgggcactggagtggagggaggtagataatgctgaaatttctcttttaacttggacactggataactcacgaatcctcttttgggaagcatacatgtactatacagcctcaaacgtgtttaggatgaatgattccagaagctgaaaggtcttgtaaataatgcctatgtaggctttaaatcatggcttatgcgagatggaccatgatggggattcaagacctta

SEQ ID NO: 215347 - DNA, 527 bp, Homo sapiens
ctgaacctgggaggtggagcttgcagtgagccgagatcgcgccactgcactccagcctgggcgacagagcgagactctgtctcagaaaagaaaagaaaagaagagaagagaagaaaagaaaaaatcctgaagcaaatggagcaaattttgaacagcttgaatacctgagacaggccaggggtgcggggcaggtggatcactaggtcaggagtttgagaccatcctggccaacatggagacacctcatctctactaaaaatacaaaaattatctgggcgtggcggtgggcgcctgtaatcccagctacttgtgaggctgaagcaggagaatcgcttgaactcgggaagtggaggttgcagtgagctgaaatcgcaccactgcactccagcctgggcaacagggcgagattccgtctcaaaaaaaaaagaagcatgtttcctagcaagccaattcagaataaaaagaaaacaaaggagaaaatataatcccaataaaatatattgaaataaatatgtacacacatatat

SEQ ID NO: 215348 - DNA, 493 bp, Homo sapiens
atataggtggggaaacaaaataagtaagatctttatcccgaagataatagcaaatattaaagatactgagacaagagaagacatgaagggagtggattgtaacaagaaaggcctttgggaaaaggggtggataggagagaaactgaagaaataattattgtgcttttgtgagaatgggggtgtatcagaactttctctactttctattcagttttgctgtgaactgctctaaaatagtttattaatttaaaagaaactaaaacaaattttaaaaattaagggggattaactttgtcagtggttgcttaatacctattcttacgtatcgtaaagtttttattgctattgtaagttatattttaaaaatttggttattgaagtacagtttgtttttatataatgattttgtattcattttttacttctaataagttcataggttctcctaaatattctgtgtaattaatcgtagagtctgcaatggatgacaaga

SEQ ID NO: 215349 - DNA, 584 bp, Homo sapiens
ggtgaaagaatgaaagctttctctttatgatcaggaacaaggcaaacctgactctttcaccacttgcattcaacatagtactggaaggcctagcaaaggaaattaggcaagaaaaagaaaaggcactcagattggaaaagaagaagtgaaattatctttctttgcagatgatatgctcttacatgtagaaaaccctaaagattccacacaaaatactgtaagaaataataaatgaattcagcaaagtaggaggccacaaagtcaacacaaaaaaatcagttacatttccataccctaacaataaatgatatgaaaagcaaattacaaaaacaattccatttaaatagcatcaaaaagaataaaatacctaggcattaaattaaccaaggaggtggaaacatttgtataatggatactacaaaacattgctgaaagacattaaaaacatgaagaaatggaaacatatctcatgttaatggattagaagacttaatattcttaagatgtcaataccactcaaggcaatctacagagtcgatgcactccctatcaaaatcccaatgaaattctttgcagaaatagca

SEQ ID NO: 215350 - DNA, 480 bp, Homo sapiens
catcgtggctcgcacctgtaatcccagcattttgggaggccagagtgggagaattgcttgaggccaggagttggagaccaacctgagcaacatagtgagatcttgtctctacaaaaacaattactaaaattagctggttgtggtggcatgtacctgtaggcctgtagtcctagctacttgggaggctgaggtgggaggatcacttgagcccaggagcttgtggctgtagtgagttatgattgtgccattgtactccagcctgggcaacagaggcaaccttttctctaaaataagtaggtagatagatagaaaacttttcagatgcaggaactgaatctacagttcctaaaatttctaattgctaatatcattgttaatacaaattttcccacatagttcaataaatgttgttgaattattcagttttgtattaacttgtggtatattttttttcttgtttttcaggaaataatttgccag

SEQ ID NO: 215351 - DNA, 253 bp, Homo sapiens
ggtgttctttgtagcgacagggttttgcgatgttgcccaggccagtcttgaattcctgggctcaagctgtgtgcctgctgggcctctcaaagtactgggattacaggcatgagccactgcacctagcccagatactttcttttttaaaaagcatatcatggaaattttcagacatgaagaaagtaatagattttaaaaaatctattagtaattttttttttaacctatagccctgcccttctgtcgtcttctc

SEQ ID NO: 215352 - DNA, 423 bp, Homo sapiens
ggcccctgtacctgccgctcccacccaggttcccaggggtgttccagtgggggacgcaacctgcgggctactcgctgggcatcaggtccagatcccagagacaggtccagtggctgtggcccaggcctccttccccaccacagacaggccaggctcagcatcaaacttcctagggaaagaatttggaattgaaaaagtagcaaaatcacaactttgtgggacttttcttatgcatattttgcagtttggcattgtttgtaattacgtatttataatttcagtattttgagataccagcgagcttaatcaggctaaaataattctcagaatttgctttctaagggctgccaaacacaagaggcctttgaaaaaaggatccttttcaaaagaacgttctcacaataaaaattcctggcccaattg

SEQ ID NO: 215353 - DNA, 417 bp, Homo sapiens
tgcagtggctcacgcatacgatcccagcactctgggaggccaaagcaggcagattacttgagcccaggagtttgagaccagcctgggcaacacagtgaaacccgatctctatcaagaaaaaaacgccagatgtggtggtggtacatgcgtcacttgagcctgggtggtagagagtgcaatgagctgcgaacacctaagcgcacttcagcgtgggctacaaagcaaaagaccctttctcaaaaacataaaacaaaataaaataaaataaaaatggctctaagtcagaggagccacaggtaagttcacaaaatttagaagccttggctgggcgtggtggctcatacttgtaatcccagcactttgggaggccggggcaggcggatcacctgaggccaggagttagagaccagcctggct

SEQ ID NO: 215354 - DNA, 578 bp, Homo sapiens
caggaagaacagagcaataaatcctgtgtgattatttttaaaagaaaaataattcctctgatagaactgtgtgtacataaatctcacctggaagtcaccaaaattaaggggcactttcagcatatctagtgatgttgctactgtatatttaaagaactatacagtatttccttaaagactatctctaccctgatcaaaagcactgtctgcaaatctgcttctctccctgctgtattaaatgacttggatctcagctaacttcattctaacaaccttaaaactgagatgttcatagacactgagggttagcagaggattgtggtcatgttatgttagaggtatgcattctgtacagtgttgataggttagtcattataacctaaatggaaataaaacctaaagcaaaagagagcaaaaatggaaataaaacattttattatccagaaaagagacaatgggaaaaaaacaaagaatgaggatggtaagtagaaaacacaagagggtagggatgtgtcacaacaaacttaaatgggttgagcttgcctattacaggacagagactatcggtttagattaaa

SEQ ID NO: 215355 - DNA, 510 bp, Homo sapiens
tttgtttccaattcaaagcctttcctttcctcacattgtcatgcctcttccatctgctactcctccttcagctatcccctctttttgctctgtcactgagggcattcgacattttcaaggtggaaagatcaattgggtcttatgttcacatatactccagactcctggagacctttgttgggctttcctgccatgcactacttggatggcagctctgggtttggcccagtttcatgcagctctgcattcaactgagggatgagatgtcacctcttcttctcataggaaccctacactctctagggagctttcttggagcacccttcatgtggcttggggcagggggtcgagactccttcccctctcctgtggctcagctccccaactttttgacatcattgtacacactggatatgacaatatttagaaggcaagttagggtaaaaagataaggctacttgaggctgttgggtgcagtggttgggcaatcaaggccctgggtggcctgcc

SEQ ID NO: 215356 - DNA, 448 bp, Homo sapiens
gacggggccccaggaggtgaggggggcaggtggggggcactggttcagacccatgtctgacccctgctcagccccttgctggttatgaggggcccagatgagctgcttctcctcggtcccaagtccccctctccctggtgagtggtggccccacacactcctcctgctcagcacagaatctgcctccagctcttttacacaggaattcatctcaggcatttggggggcctctctgccgttacacatagttaagagatgggtacattaatcaaatcaaggaaaggcatttttccttggttgaaaataattattacggctgggcgcagtggttcacgtctgtaatcctagcgctttgggaggctgaggcgggaggactgcttgaggccaagagttcaagacgaacctagcctacatagcgagagaccctgtctctgaacataaaaaaaaa

SEQ ID NO: 215357 - DNA, 129 bp, Homo sapiens
caatttgccctcacaaagcactccatctggtgagaaaaacaggtatattagcaaatacaatatagcatattaagtgctctgggcacagagaggaggaacatctaataaactttggaaggggtgagtaaa

SEQ ID NO: 215358 - DNA, 303 bp, Homo sapiens
cctgcattttttccagaaaaggccactggtctgagcattcagggccccaccatcatcccacagtgagattggtggctctcagaggttggtgacaagtctctcaagatacagggccttcagagctgcatctgcgtggtggccttttcctgatccttctccctcagggttttaggccctggttcacccaggcctctgctaagctcccgcactttcttgccagaggtgtcttaaagggaaaaacctctcttttgtcgctcctgtcccttctttctttcttccccctcctcattcccctcctccttc

SEQ ID NO: 215359 - DNA, 753 bp, Homo sapiens
gctttggtaacaggatgatgctggcctcataaaatgagttagggaggattccctctttttctactgattggaatagtttcagaaggaatggtaccagttcctccttgtacctctggtagaattcggctgtgaatccatctggtccttgactttttttgattgaaattagttgataacgtcttccaggagacctacggccatcctactgatatgaaccagatcatacctgccctgatgggatgccagagaaagactgctgcaaggtacgcgccactcacagacctctccatttatctcactgatgcaaaggaccctgagggatcctctggaaacagaacagagggaagaagataccttccctgaagcccagatgttccagaagcctgcgcctcattcacaaagtcaccccaaaaatgccctagagtttggagttttgaagaagcgggaagaaggcctgagtaagggcctgggaaccaagttagatcctacttcagcatcagcacatgccagcgatggtgcacacaggtggagagcggcctgcccgtcttttccatggtgcccacagacccatttaggatgaaagatcagaaaattctctccatgtcaccgcttctgaaacatgtgaatattaatatttggtgcctaaaaggccatggcaaattttcattggttttatcttattcatgattatagagttgaaagaatacatattcccatggggatcaatgaagacattctcattttgaatgaagt

SEQ ID NO: 215360 - DNA, 698 bp, Homo sapiens
gctttggtaacaggatgatgctggcctcataaaatgagttagggaggattccctctttttctactgattggaatagtttcagaaggaatggtaccagttcctccttgtacctctggtagaattcggctgtgaatccatctggtccttgactttttttgattgaaattagttgataacgtcttccaggagacctacggccatcctactgatatgaaccagatcatacctgccctgatgggatgccagagaaagactgctgcaagggatcctctggaaacagaacagagggaagaagataccttccctgaagcccagatgttccagaagcctgcgcctcattcacaaagtcaccccaaaaatgccctagagtttggagttttgaagaagcgggaagaaggcctgagtaagggcctgggaaccaagttagatcctacttcagcatcagcacatgccagcgatggtgcacacaggtggagagcggcctgcccgtcttttccatggtgcccacagacccatttaggatgaaagatcagaaaattctctccatgtcaccgcttctgaaacatgtgaatattaatatttggtgcctaaaaggccatggcaaattttcattggttttatcttattcatgattatagagttgaaagaatacatattcccatggggatcaatgaagacattctcattttgaatgaagt

SEQ ID NO: 215361 - DNA, 571 bp, Homo sapiens
agaaagatttcactctgtgagacgaatgcacatatcacaaagaagttctcaggttgcttctcttgagcttttatgtgaagttatttccttttctaccattgaccgcaaagtgctccaaatgtccaactgcagattctactaagagtgtttccaaactgctcaatcaaaagaaagattcaactctgtgagatgaacctgcacattccaaagaagtttctcagagttcttctgtctagtttttatgtgaaaatatttccttttccaccgtaggcctcaaagcactaaaaatgtgcatttgtagattctataaaaagagagtttcaaaactgatcaatgaaaagaaaggtttcctctttgagatgaatgcacatataacaaaaaatttatcagattgcttctgtctagattttatgtgaagatgtttccttttctaccataagccacaaagcgctccaaatgtccacttgcagattcttgaaaaagagtgtttccaacagctcaatcaaaagaaaagttcaactctgtgagatgaatgaacacatcacaaacaatttctcagaatgcttctgtc

SEQ ID NO: 215362 - DNA, 264 bp, Homo sapiens
ttattttaaccttggcaaaataaacctctaaattgattgagacttgcctcagataccttttggtttacaagggtgaggtgagtcactgggcagttttattgagactgagaatttggtggttcttggggttccaaaatccataaagactttttttagacctatgtctacagaaatagccaccctcttctaggttttgggtgaaagcagcccttcctggtggaaaagaatttcagcagtagcaaattgtttcttaacatggtaaaa

SEQ ID NO: 215363 - DNA, 458 bp, Homo sapiens
agatgaagccggcccactggggtaggggaaactgaggaaagatgacattgtgctctggcacaggctgcagcgacatccaactgtgctttgctggattttcaagagccaccctggagtctgtcacaagtgtcttacaaggcacagccctgtgccccactcccgccagtgagcctggtgttggagcaagttaaatcacctcttcacgtgcaggattcaggtgaggagggcaggagaaaaagggacctgtaggtccgcagataagagctcatttccttccgtctgtcacacagaaaggatgttcaccaacaaagctgccgttgtgggtcttcatggtgtagtccataaaatgtcaagaagcaatttctaagaatttcagagcaccaactcaacttgggctagtagagaacctctgacttccatcagcgtgcagtggcacctcgttctgaagaaatgcagcc

SEQ ID NO: 215364 - DNA, 122 bp, Homo sapiens
aagagagagaatgaggtgtgaggtgccacacacttttaaatgacaagatctcaagggaattctatcacaatgacagcaccagtccatgagacatctgcccccatgatctatacacccaccag

SEQ ID NO: 215365 - DNA, 427 bp, Homo sapiens
caaaaaacatataaaaaccagaatgacccaatacaaacagtcattgctaataccaggaaactgatgttgatacagtactgttaactcaggtatagattttatttcagggtgatatttcacaggctgaaaagcactactaatgaggacaggaattcctcagtcttgcttggtccatgcacccatttaacatgggatattttaaaagcagtgctgcatgccggggaccatggatggtagagcttaaagaactactttgtttaataaaacctatcccagactgggtgcggtggctcacaggtgtaatcccaggactttgggaggccagggcgggtggttcacttgaggtcaggagttggagaccagcctggccaacatgatgaaaccctgtctctaccaaaaatataaaaaattaaccgggtgtgcttgc

SEQ ID NO: 215366 - DNA, 598 bp, Homo sapiens
tgcgatgttgaggtcccccactattattgtgtggttatctaagttacctcataggtatgtaagaacttgttttatgaatataggtgatccagtgtctgactgtattgtgaaattcttatagtgagttatttagctctatcagatcagtttggttgagctcttgtttcattttattggattccttagattccttggattgggtttcaactttctcctgaatctcaatgatctttgttactatccagatactgaattcaatgtctgtcttttcagccatttcagcctggttaagaaccattgctgaagagctagtgtgattgtttggaggtaagaagacactctgactttttgagttgccagagttcttgagctggttatttctcatctgtgtgggctgatgttcctttagtatttgacattgctgtccttcggatggggtttttttgcttttgtattcttcagtgcccttgagggtttgacccagttgactggctttgttcctggattatttcagggtgccaagactcagctcaccactcctaggctgtgtgctctaaccctggagggttggtaccaagcctacagctttactctctgg

SEQ ID NO: 215367 - DNA, 241 bp, Homo sapiens
acatccttaacgggcttatgagtaagctctttctttctctttctctctttctttctctttctttctttctttctttctttctttctttctttctttctttctttctttctctttctttgtatctctctctctctccttttctctgtctctctttctttctttctttcttttcttcagagtcatgctctattgcccaggctggagtgcagcagcgtgatctcggctcattgcaacacggtct

SEQ ID NO: 215368 - DNA, 468 bp, Homo sapiens
ttgaaaaggcagataagactagttatttgaccaaatactttaaatttaagatgcttatttgatactaaaatggaaacgttaagaaggcaattggagaagcccagcatttaggcattaaaggtgagaggaatgtactaaagatataaatttggaacagagtatatatatataaaggcatgaggctgaatgagaaaccactcagtaagtctatgtaggtggaggagagagaaaatgtgaggattaggccccgagcccagctcagcaaagaaggctggggaggaatggccaagcggatggaagattccagagtgctgctatctagacacaaattcaaagaagtttttcaggccaggcacagtggctcatgcctgtaaccccaatactttgggaggctcaggcaggtgaattgcttgagcccaggagttcaagaccagtcttggaaacatagagagactccatctctattta

SEQ ID NO: 215369 - DNA, 422 bp, Homo sapiens
ccgctagtgcaaagggataggcgtatttcccatgattaaagattccagctcctgaaggttagggtttctctcctataatgcaacacactgcatgtgcaggtggcctgtggccctattcaggttgctctgtgacatttgggacttggggaactagagcccagtggtcacaagataatgttgatattctggctgcccctgttagtgtaagtaataaataccttgtctctcacccaggagacttctttcctctgccagcattttattagcttgtgacaggctaacttgttagtttgaaagtagtgtaaatctcagatccttcacaggtcttgatagtatgtaggtaacacaaataaatgcataaacagctgagttcagctcagaaatgtccgtttttacccatgtttttcattaaaaactgtatt

SEQ ID NO: 215370 - DNA, 450 bp, Homo sapiens
  misc_feature (439)..(439): n is a, c, g, or t
  misc_feature (442)..(442): n is a, c, g, or t
gaaagccttcaaatcagccattgcttggtcgctgtgaattttaaattagaagtgtctgaactcaatgaacctgcatcacagaccgaaattcatcatttcatcgtctaccataaaacctgcacacatggccaagcctcggttacccacttctatagccactactttgttggtgcaataaggctgatttccaacctccatctgacttcttccttgattcctcctcccagcttccataccttgagctactgtaagctcacaaaatgcaaattaacatcaatattagcctaaacagaacaagtaagtctcatcaataatggattccagaggcaaacagggattttttttttttttttggcagagtcttgctttgtcacccaggctggagtgcagtggtgcgatctcggctcactgcaacctccatcctgggggacagaataanacnccgttaaa

SEQ ID NO: 215371 - DNA, 450 bp, Homo sapiens
gctccacagctttctttaggacttaagagtctttatatgccaaggtataagtggatcccctgggtaaaatgatagtattcagttttctaaacttatttggccacagaaagctatttttgagaagcatttcataggactgtatatcatagagctcgctgctgtgggatacctttgatatcctccagaaccacctaagtttgctatggtttaattgtagtcatatcttctaacttaaactcaaaacagtccttttgagttccacattagctctcctgaaaatccctctatgaaactgggcactggcaggttcagcagtcaaactttctgttgtcattcaggtcattcatgaaaatatttagtagtgtcttgggattaaaacaaaatcgggaaaaaaaatgctctgtcaggatttgctacttgagtggagaataaagtcaagtataaaacctt

SEQ ID NO: 215372 - DNA, 376 bp, Homo sapiens
gatggggtcagaaagatgtataagatctagttcttgacatctgagagtttacatttagaagagagggagactaattataagacaaggcataggctgggcacggtggcccatgcctgtaatcccagaactttgggaggctgagacaggtggatcacctaaggtcaggacttcaagaccagcctggccgacatggtgaaaccccatctttactaaaaatacaaaaattagttgggcatggtggcatgcgcctgtagtctcagctacttgggaggttgaggcaagagaatcgcttgaatccgggaggtggaggtttcagtgagccaagattgagccactgcactccaacctgggcaacagagtgagactccatctcaaa

SEQ ID NO: 215373 - DNA, 519 bp, Homo sapiens
cttttgaggaaccagtgcacacgtaaagcaaattccaaatcactgtttacattaactcaatgataaagttgtctgggaggaaggccattgcattctccacagaatggcactggtatcacactaggacagtgcttttcaaagtccacagcccctggaaccagaaccccacagtactccccaacggcacattcctgggtcctaccctcccatctcctgagctagactctttagggcaaaggctgagagtctgcattttaataagttgcctcacccaaagaaccactgcgctagggttagtacgatgctgggttctctacaaggtgcctcttaggtcagtttctttaactgagtagcccaacgagagcttccatttacttctttgtgtggttcattaaacattcatttcatgaagtttagacaagcctttcagatgagtaggatgaggcatggttaggccttggcctcatctgactttgcccagatgtaggggcccacctgggacgatggacttcccaccac

SEQ ID NO: 215374 - DNA, 1063 bp, Homo sapiens
gagggtgccgtgctgggcaaggggggcaagccacagtttgggctgggcgagctgtctgcccatgccacaccggccttcactgcggtgctcacctcgcccttccccgcctcgggcatgcccgtgaaatttgaccggactctctacaatggccacagcggctacaacccagccactggcatcttcacctgccctgtgggcggcgtctactactttgcttaccatgtgcacgtcaagggcaccaacgtgtgggtggccctgtacaagaacaacgtgccggccacctatacctacgatgagtacaagaagggctacctggaccaggcatctggtggggccgtgctccagctgcggcccaacgaccaggtctgggtgcagatgccgtcggaccaggccaacggcctctactccacggagtacatccactcctccttttcaggattcttgctctgccccacataacccgcggggggggtcctgctgccctggcctcctcccctttagtggtagagcgaccttttcaattacaaagaacctcctggaaaaaaaaacaaaagctgaacagaggcggccgtggccttggcccgaggagactaacttgctttctccctgcatgcaggctgagattgtttctggaaggggctggcctgagtttctttcccccaaatgtctgtgcagtgtcagggctgcaccccataggccctgaggcacacagcccagccccttgtgagtcctggcctctgctgggccctgaaggagctgagagggagctcaactccccaccccgccacgtggggagacagcccttcccactggctccctgatggcacctgctggaggaaaggggcacggcctccctcacagcccttggctggggctcctccagctccccctgggacctccagcatatgacagtggactaaggactgtggggttttcctccaaggggaagggagaagaggggaccatcgaggtggcgagtgtggacaccctgccaggactgcagcccccatggtgatgctgtggcatcagacatgtccgtggtgggcacagtgcctgttgccct

SEQ ID NO: 215375 - DNA, 221 bp, Homo sapiens
ggccatcaaaatatttatcaagtaaacccacttcatctactcatggtcttcatatagaccactaacaaaaaagatctagagctggttgtactttgaagttctttgactccaaaagtatacttactgtgcacaaagagcatgggttgatgtatacattataatttataaagctattcacttctgataaaagaatactgctgttatttggatacatacacagt

SEQ ID NO: 215376 - DNA, 160 bp, Homo sapiens
agtaacaaaatacttggaagttaaacagtacacttctaacacacatcaagaaatcccaagagaaatttaaaatattttaacaaagtgaaaatgaaaatacaacataaccaaatttgtaagtttcagtgaaagcagtgtaaagaaaatttatagcattgaa

SEQ ID NO: 215377 - DNA, 433 bp, Homo sapiens
aatttacctatttgacactcacggaacattctacccaaaatagcagaagctgaatgaatgttcttttttttctcttttcttttttccttttctttctttttttttctttgagacagagccttgctctgtttcccaggctggagtgcagtggccctatctcagctcactgcaacctctgcctcccaggttcaagcaattctcctgcctcagcctcccaagtagctgggattacaggggtgtgccaccacgcccggctaatttttgtattattagtagagacggggtttcaccatgttggccaggctggtctataattcttgacctcaagcgatctgaccacctcggcctcccaaagtgctgggattataggtgtggcccactgtacccggcccagaatgaacattctttacaagtgcacataaaaacatttatc

SEQ ID NO: 215378 - DNA, 381 bp, Homo sapiens
tgacagagtttcactcttgttgcccaggctgaagtgcaatggtgtgatctcggcttaccgcgacctccacctcctgagttcaagagattctcctgtctcagccttccgagtagctaggattacaggcatgcaccaccacgcccggctaattttgtattttcagtggagacagggtttctccatgttggtcaggctggtttcaaacacccaacctcaggtgatctgcccgtcttggcctcccaaagtgctgggattacaggcgtgagccaccacggccagcctatggtttatttttcatgtgagaatatgttttgcttaacaaataaatttctagagcattatttttttttttaagagagagacttttcatttctagtctta

SEQ ID NO: 215379 - DNA, 262 bp, Homo sapiens
aagaatggtttggagatgactgaatggtagtaaagcacaggtactaatgagtactttgcagggatccactggagaataaataccctgcttagggcagagtggttattgaagtcttgtgagaaataagacctgttggggttggaaaagaagggcttggaaactccattgcattaatggttagatttgatgcagtagaaattaagaaggctttgcagttaggaagtgacatgtctgaagtggtgttttaggaagactagacaga

SEQ ID NO: 215380 - DNA, 680 bp, Homo sapiens
aagttggacaatggctgcagtgcaaagctgtcagagagggtgtttctgtgagatgagaagcaaactttctagccgcaaacacttactgccatcctgcctgccatccacctctatgatcatttgactttgtatgccttggtcatctcatgtttgaaactggaatcacatttagcctgtcctctgctgtcaacgctgataagtatgctcatccaaaatcagccattggccaggcatggtggctcacgcctgtaatcccagcactttgggaggccaaggtgggcggatcacttcaggtcaggagttccagaccagcctggctaacacggcaaaactctttctccactaaaaatacaaaattagctgggcgtgatggtgcacgcctgtaatcccagctactagggaggctgaggtaggagaattgcgtgaacccagagggcggaggttgcagtgagccaagatcacgccactgcactctagcctgggcgacagagtgagactcctctgaaaaaaaaaaaaaagtcagctgttgccattttcctattgagagcatccagcaagatggtttagaaaattttgttctacagtctcagcacaagaaactggcagacccagacaccatgccaagacccctccctgcctgctgagcttccattttagcctcttgcactggctggtagccg

SEQ ID NO: 215381 - DNA, 525 bp, Homo sapiens
ttaggtaaaagtaaatgtctccagacctttaactatatagtactttatttgctaaattatgcaaatcaatataccctaaatcaaatacatacctcctctaaagagagttccccttggttttgaaactcactttaacaagctatcaatcagaggctgatatttagaggtagcataactgattggtagcagtgggatttctggccatttttagtgataaccaccgaaatacatgagcagggtttttaaaccctaggaaggaaaaagcctgaccaaaaaccctgacagatatataatgccatgatagaaatgctactcattatgtcatacctaataatccacatgtacctcattactcagctgtttgtgttacaccctgttgccaaaggaagctccctgcttctcctcctgatccagcaattaatatgcatatcaggcacagtggccagacttctacggagaaagaggaggcaggcaagagatccatagtcataaagacctaggcgagtaatattctcagcattattc

SEQ ID NO: 215382 - DNA, 395 bp, Homo sapiens
gcacacgcctgtaatgtcttgagcccgggaggcggaggttgcagtgagacgagattgcacccctgtgctccagcatgaatgacaagagtgagactctgtctcaaaaaaaaaaaatgctaagagggtagatcttacgttaagtgttattatcacacaaaataataaagagtgcagaaggaaatatttggagatgatagataggtttttatgacacagattgttatgatggtttcatgggtatatacttatctccaaactcatcaaattgtatacataatatatgtaaagcttctcataccaatcatacctcaataagctgttttttctttaaaaaaatcttcaaaagaaaaaatatttcttaaaaatttcacatttttttctacttcatcaaaaca

SEQ ID NO: 215383 - DNA, 545 bp, Homo sapiens
agtgccctgatcttgaaagcagtggaaatgcggcaacgggaatgcatctccgcacacgctgtggtgtccgcgctggagcaagcccgcgccgccaggaccgggtttgcgcttttgcccggctcagtttttcctgaagtgcttctgggtgccagagtccactcgcccgccacgcaacctctaacataaatcctccggggagaaaagttgggggcggagcgggacgggttgcgcgctgcagtgaaaccctctgtctgcagcccaggagggaggcttgtcggtgcagggaggcgtaggaccgagggtcctgagaccgagagcagctggtcctggagggactcaagcttggccgtggggctgggaggcggctgcaatggagtctgcactccacccagcgctctgctgaccccttctcgggttgtcttctggagggctctttccctctccttcttggggcccggagacaagtatccagtgttacgtctggtggcacaactgctccgggacacgggcgaggctgtttgcggtcagctgcctgcggctgccgc

SEQ ID NO: 215384 - DNA, 440 bp, Homo sapiens
tcccaggttcaagctattcttctgcctcaacctcccaagtagctgggactacaggcacacaccaccacgcttagctgatttttgtattttcagtagagatggggtttccccatgttggtcgggttggtctcaaactcctcacctcaggtgatccccccaccttggcctcccaaagtgctgggattataggaatgagccactgcacccagcccatcttattgtatgtctaaggatagatatacttgcataggaataccttgttcagagaaataatactgattttttttgttgtgattaaagaaggttttcttttcccgtgggaactgtattgcaaaacgaaaatttgcatcaaactgttaaactaactaaacattttatttttacattgagttgaggagaagaatgcgtaacatgaatggacaattttctggggacataac

SEQ ID NO: 215385 - DNA, 479 bp, Homo sapiens
tgacagttctcctgtgggagggaagggattgtcttttccgtaagtagcgctgggtcgatatggaaaaacatggactttgatttctacttcacactataacaagaagtaatgagatacatcataatcatatccctaaacgtaaaaacaaaacaataaagattccagaagaaaaaataaaataatatccgaccttggagggggcaaaattttcttaataaaggcaaaataagcgtcataaaagaaaagatttagtccaggtgcggtggctcacgcctgtaatcccagtgctttgggaggccaaggcgggcagatcacctgcggtcaggagttcaagatcagtctggccaacatggtgaaaccccgactctagtaaaaatataaaatttagctgggtgtggtggcacgtgcctgtaatctcagctacttgggaggctgaggcaagagaattgcttgaacctgggaggcagaggtttcagtga

SEQ ID NO: 215386 - DNA, 617 bp, Homo sapiens
aatcccggaataccttgactccaaacccactgctattaacatatctgccaatttatatctttgttaatacttggttgaaagattaggccaggcacggtggctcatgcctgtaatcccagcactttgggaagccgaggcaggaggatcacttgagctcaggagttcaagagcagcctggacaacatagaggagagtctgtcactacaaaaaattagccaggcatgatggtacacaccagtcgtcccagctattcatgggattgttctggctcatcctcccgagcagctggatttacaagcgcatgccaccgcgcgctggctaaattctgtagtgttaccacaagtgggggtgctcctatgtgtcctctagtgctacaatccactcgatctcaccggtccttccgtatttatccgaccaatggcgactattcctgactcgggccccgttttttccacagtcctggccctgcgcgactccaaccttcgctgggcataagcctcaacaacccctctgtgctcgtcacggcttacccactttcgctctctcttgtgcgcctccccgtccaccctttcacctcgacttatttcctattctctctcctggccctctctctcttc

SEQ ID NO: 215387 - DNA, 572 bp, Homo sapiens
ataagtacttgtagaatgaatgaataaaatactgtgccttctagccaaaaggatttgagtgtgttatttgtaacataaacaaataattagggtaactgtttgaaatgtaaccagagtgatttatgacagtgttaattgttcatccttgtaagggactggagccttttgccttcatggaagcaacccccagaaaggtactgggctcagcatctctaccagatgatgaagcgcccttcagtgtggccacggctttttgcttaaatcattgctactttttttttaccagctcagtaggagtgaatgcatgtgttacaacgaaaaataatcctaaattgaaattgtgagtaactgaatatatgatttagaagagttaattatgaagaacagctagaatttcatgtggcatttagatgtactcatttttatattgatttataaactaatgcttgttccatggtattgtttatactatatgatgtcaaagccatttgcaaaagatctactgaagtttgagcctttttatgatccttctatggacccccctctttgtctgctcactcccactcctccca

SEQ ID NO: 215388 - DNA, 287 bp, Homo sapiens
gtccatcagtattatttatttctatgcaaaagtatgcttcaaactgcttaaatgatatatgatatgatacacaaaccagtttcaaatgcagtcttgctcccatcaggtctcaatgaagtagcaccttctcagagagaccatgcctaaccacccaagaataagctacttccttatcccccagctactcttatcttcacagcacttatttgtaactgaagtaattttatttgcttttgtgtttactgtctaccctccccattttcaatgccactaagaatttgactctg

SEQ ID NO: 215389 - DNA, 356 bp, Homo sapiens
gagccgagatcacgccactgcactctagcctgggcgacagagcaaggctccgtctcaaaataaataaataaactttattttttagagcagttttaggtctgcagcagaattgagtggaaagtacagaatttcccatacactcctgccccgcccctaccacacatggtatgccacactatccacatcctgcactgcaatggcatatttgctagaatcagtgaacctgcattgacacatcatcaccccaaatccatagtttgcattaagtagggttcactcttgatgttgtgcattttatgagatttcgacaaatgtataatacttatttaccattgtagtatcatacacaatagttt

SEQ ID NO: 215390 - DNA, 115 bp, Homo sapiens
ctcagacctgccagtgcacatgtaattgagacagtggaagaactctgccagtagagtgctttcttccctgatgatgggaatgtcacaaggaaggtagtgacattaaaaaagaaga

SEQ ID NO: 215391 - DNA, 433 bp, Homo sapiens
ggtcaaaccctaaagatcaaaactgatagaaccaaagcttggaatacgtggaggaagagctttccaggcagaagggaaagcaagtgcaaaggacttgagaagtgaaatgaaacctattcaagaacagaagaaggctgactgtggaagtagagagtgaagtacaacaacattttaatagtgcacaaaaccggaatgtacaactccatgatttatcacaaggcaaatattcatgaaaccaacacccccatcaagaaatagaacattgccagtaccccatccctcttccctagcctaagcactattctgacttccatggtactctcttctttgcttttaaaagtaagtttgccaactaaatatgcaccctgaaactttatcatttagtttgcttgtggtttgaactgtatataaagtgaataattttgtgcctgct

SEQ ID NO: 215392 - DNA, 194 bp, Homo sapiens
aaagagcaaaactaaacatgtctccaggaactgagctgagcagaaccaaaaggaaatgttagagatgttttctaagttcacgtgagtagaaagctcgaaactcagaagtctcctgggtggaaggcggaggttgcagtgagccaagaccatgccattgcactccagcctgggtgacaagagcaaaactccatctc

SEQ ID NO: 215393 - DNA, 391 bp, Homo sapiens
ggtgggccgtttttaaagcccatcggaaaagtgcagtattggggtgggagtgacccgattttccaggtgctgtctgtcacccctttctttgactgggaaagggaactccctgaccccttgcgcttcccgagtgaggcaatgcctcgccctgctttggctagtgcagggtgtgctgcacccactatcctgcacccactgtctggcactccctagtgagatgaacccagtacctcagatggaaatgcagaaatcacccatcttctgcatcgctgacgctgggagctgtagaccagagctgttcctttttggccatcttggctccagcccccaatcaaaattgtaaatgtgatttttcttttttgctattaaaaagattatttatgttcatcta

SEQ ID NO: 215394 - DNA, 151 bp, Homo sapiens
tcccccacccccactaggtgggaggtgggttggcccagatctttccaggccaccattcctacaagttaatgatcacagaccttatcagagccttttgccatttataaatttataaaacaaaagagaaataataaagcacatgggtaattag

SEQ ID NO: 215395 - DNA, 334 bp, Homo sapiens
tagattatgaggtcaggagatcaagaccatcctggctaacacggtgaaacctcgtctctactaaaaatacaaaaattagctgggtgtggtggagggcgcctgtagtcccagctactcgggaggctgaggcatgagaatagcgtgaacctgggaggcagagcttgcagtgagccgagatagtgccaatgcactccagcctgggcgacagtgcgagactccatctcaaaaacaaaaaaatgccagtaggacttatcaggagtcatgagatgacttgggacgaaactccagggctccaggttaacaatccatccactggggtactctgccatctctc

SEQ ID NO: 215396 - DNA, 514 bp, Homo sapiens
cccagcctgggctgctgcccctcacgccccagaggccgtattcagatgggttcatggctgttgctctcttgccaagctcaccagtctgcctcgtcctagctgttctgccattgagcccacacagggagggtcttatttttcaggtctgaaattcccactgggcccttcttgtatcttccatgtctttgctgatgccctggtgatctgttggagcattttcctaacagctactttaaagcttaggccagctgggcatggtggtgtgtgactgtggtcccagctacttgggaggctgaggcaggaggatcgcttgagccctggaggtcaagatcagcctgggaacatggcaagaccccaggtctacaaaaaattaaaaaaattagccagtactaagaaattagtacagtgagcctgtagtccctgctacttgggaggctggggtgggaggatctcttgagcccaggagtttaaggctacggtgagccctgattgtgccactgtactctagcctggg

SEQ ID NO: 215397 - DNA, 735 bp, Homo sapiens
gcagggacgtggatgatgctggaaaccatcattctcagcaaactaacacaggaacagaaaaccaaacactgcatgttctcatcataagtgggagttgaacaatgagaacatatggacccagggaggggaacatcacaccctgaggcctgttggggggtgggggacaaggggagggagagcattaggacaaataactaatgcatgcggagcttaaaacctagatgaagggttgatgggtgctgcaaaccaccatggcacatgtatacctgtgtaacaaacctgcacgttctgcacatgtatcccagaacttaaagtataattaaaaaagaaatttaaaaaagacattccgtaggtgaggctctccctaaaagtcaaacttttacttgcacatatgaaaagtgtaatcattaaataagctatttcttcagtgacggtatactgagttctgctcatggtgccaagtactttgcatatattattcagaagcttattagctgccctgcagcaccagtatcatttattgctgcactccaggtgaagaaattgttgctgggagctacaacaacttgcccaaagccacaatgatcataagtagtttgcgcttcgttgtgctcttctttgctggtgtgagattctcgagggccaatgtccttcatctgcgtaactctagggactcgcccagaccttggaagaggttcacattcccgcgtgccgagattgattatgggccaccct

SEQ ID NO: 215398 - DNA, 416 bp, Homo sapiens
ggtgatactggactctggaggaacccccatgtggataagcggatgaggggctgatgggtgcagcaaaccaccatggcacgtgtatacctatgtaacaaacctgcacgttctgcacatgtatcccagaacttaaactataataacaatttttttaaaaaagtctgcctaccctgtgtgacaggccacacagagaccacatggaaggcaatgccaggaggagaggcgctgaagccacctagtgggagagaggcccaggcctcaccagcctcccaactgagcctaatcttccagccatccccaccaagaggcccaatgcggggatgaaccagcctaggctttctagcccacccaaaccccagacgattttttccccagccaacattacatggagcagagcaataacttaagttagaaag

SEQ ID NO: 215399 - DNA, 346 bp, Homo sapiens
actcagtttgtggtactttgttgctgtggccccaagaaagtaccacaagcctgaggttttcaccgtccttacagccagcaagacgggatgtttcagatgaccctgtcctatgtggaactgggggctgaggtggggtggcctgataacagagtcaccaaagagctgcctctcttatctgtactcctgagttctcacagccttctgggcatcttcagcaccagcaactcagcatgtcaaaactgaacatctttcctctccaaaccccttttccctcataagcccatctaaattatggttaccatgtccctctcagtccctctggaattcttcccttttctcatcccca

SEQ ID NO: 215400 - DNA, 1080 bp, Homo sapiens
gctgaggcaggaggattgcttgaggccaggagttcgagaccagcctgggcaacatagagagatgctgtatctccaaaaaataaaacaattagcctggtggcgcactactgtagtccccgccactcaggaggctgaagtaggaggaattgcttgagcccaggagttcgaggctgcagtgagctatgatagtgccactgaactcccatcagagtgagagagcaagactgtctcttaaaagtaaatgatagatttaaaaatataaaaagtctttgactcttagtatcccatggaagcacaaaaattcacagtggtttgtagatggtgataataatttttttttcttggcatctctaagaatatattacctaccataaagattgtatactgtcaggaaataaaacattttaaaataatattcaaaaaaacctagtctcatgagaggcaaaagttttcaagtattaactacaaaaagttcagttggaaatttccccgtcttccgagaggtgtcatgagctgagtcagctcctagctgtgaccttcatgtgacctcatacatcaccttcacctctctcagaaaatctatgtcttcattcttaaagataaggacaataacctgctttgcattgaggaagaagtcaattaaaagatgagattacctgtgtgtaagcattttgtacagaggaagcactttttttcttcctctcattatcatcattgccttgactcatttcctgttgtgcccggaaggcgggggcacctgtgaaattagaatgcagcagggcagggggttttcattggctcagttcccgctggtgctgctaggtaactttgctcatatcctgtctggaaggacagacaagggtcagactggatgcaggctgggacaccatcagcttctcacagttgctttttctctccccatcatgggtctggcctgctcttagaactgagtcatcgctgattattctcccaaacacaggaaaatccaggataccctagcgtacccacttttaggtgctgacacattgcaagcctcacacttcatccatggttttaaggatcaccttgaaccatggaaac

SEQ ID NO: 215401 - DNA, 501 bp, Homo sapiens
agaaattggggatagtattatctaacatacatgtttcccatgaagattaaaagagataatacatgcatggtgattagtccactgccaggacatagtaaatgctcagtaaatgacaaccaacatccccagctcagcttcttgaactcctggcctcaagaaatcctcctgactaagccttctgagtagctgggttacaagatgagctactgtgcccggtgagctcagtttctctacctgcaaagaaaacttctgaagtgcaaatgtggtggttcccacatatgctagaagggaggcaagggaatgcaattcttgcatttgtttgacagagacagtcagatactctaagcctatggtgttgttgcagagaagcattgagggaaatggctgagcatcagagcctcttctgacaactgtgccactttcttagacctacaggtacacccaaatccacttgaaattacagaaacacattatcttctttcaattttcagttgtttgttc

SEQ ID NO: 215402 - DNA, 810 bp, Homo sapiens
gcccggttcaaattttattttaaattcagagggtacacgcacaggtttgttacacgggtatcatatgatgctgaggtctggggtgcaattgatgccatcacccaggtagcgagcttagtatacaacagttttcaccccccgtccccttctttctccctccctgctctgtcctcagtgtctgttgctgccatttttatatccataagtactccatgtttagcttccacttgcaagtgagacatgtggtatttggttttctgttcctgggttaattcgcttaggataatggcctccagctgcgtagttcacattttttaatgaatcgtgttagagggatttccccactcactgtactatctttgttaggaaagaaatactactttctgttagctttttcttttccctgaatagaaaattttcctttgacttctaccctccttcttctacgcctccatttgggaataaagtcattgttcttctccaaggcagcccagctcttcctgtcttgatgggcagttttctctacgactgaactaagggtatactttaagagctgtaatccttttattctgtagtaatacagaatataattctagattagtcacatcaactaaatcaactgggtcaaaatctcacttctcttattctacgggtttaaaagtaatcatctttataagcacaaatgatggaatgtggtacagattaaacaaaaatggcagcataccaaaaccactggttgcatatgaatatatctgatattctggtaactgacaaaacttcaaaagtattaaccgatagtctagaagactg

SEQ ID NO: 215403 - DNA, 291 bp, Homo sapiens
gcccggttcaaattttattttaaattcagagggtacacgcacaggtttgttacacgggtatcatatgatgctgaggtctggggtgcaattgatgccatcacccaggtagcgagcttagtatacaacagttttcaccccccgtccccttctttctccctccctgctctgtcctcagtgtctgttgctgccatttttatatccataagtactccatgtttagcttccacatgtctcagcaagtggaagcgtaaacatggagtacattatggatataaggtacgagcatgatat

SEQ ID NO: 215404 - DNA, 365 bp, Homo sapiens
acttgagactctgtatccaaccaactataggagatctcaagctgaatgtgcacaagatgaagctttcctggctagaatatcacacaacttttcagtaagtcaggaacagcatctcctttcattcaaaccattctttcaaccagaaacctagattttatccctgattcttctttacttatttctatactgtgttcacgctaatggaaaattctatcaattctactacaaaacatgcttcaaatccatttcattctctgtctccattgccaccagcctagacaagaaaactgccaccccaccactggactacttccacagcctttgctgcatccatatctgctctgattagttcattctccataaaa

SEQ ID NO: 215405 - DNA, 277 bp, Homo sapiens
ttcacttcctgaaactcagggtcggcttgtgaaaagctgttaaacaacatgctaaatgtgaaatgtcaaccctcactctaaactttccctgttcagagcatcagacgaaaacttcattgggttttatagtggctttcagatttttggtagtcaattgaagaagggagtttaaaatttgttgtatactgttcatgattgtctgcccatgtcctgcctgaaataccatgattgtttatggaaagtatctttaataaagctggatacagtttggcttgga

SEQ ID NO: 215406 - DNA, 859 bp, Homo sapiens
ggggctttatagcctactgagtaccatctctgccagtaacaggttttctgctgtgttaactgaggttttggcaaagcattgtcctagaaggccttgaattccttcataccaagtgaaacaccagttttgcccatacctgcaaaaggaggaggcttttccagaactcttataaccagaccagggatccctgagttggtgcccaggatcctgaggattgtaatcctaatttccttctagggtaagagacagcttatcacaaaatctattcttcaaggacttaatgtgcagacctaaggtgatgtagacaccattgaagccttcaatccaaaatctgccatctgtatttcatgagacaagatgtggtatgattctaccccaagtcaaggcaccaattagtttgttaactaggggccccctgtcactttatttcattcattccagtaactttgaggccctccttcagtgcctagcccccagcagagcaatggaggattcaataccaaaaacatagttcctgcccttctgtaacttgggattcagctacatatacttagttatgtgatagttgctgccatgtctttgggttgaacaagaaaggctgcctttggctgttctgcctgggaagacttcctgggcttaaggatttccttaagtgcttcaagggaagctcatccttgctctcaatcaggagcccacaacaccagcctattagcttttgctcttcctgctctgttttcaggttgacaagcctaacacaacagcttcaaaacacacacacacacacacaaagtcctctacagtggacaggtgttgaaaagtgcacagaagaaaatataactaaagctattacaatatcatg

SEQ ID NO: 215407 - DNA, 420 bp, Homo sapiens
  misc_feature (293)..(294): n is a, c, g, or t
  misc_feature (297)..(297): n is a, c, g, or t
  misc_feature (299)..(299): n is a, c, g, or t
ttgtttttttttcctatagcattcctgctggggtgtttgctgtgatcagagttagagatgtagaatttttaccacatttttacttttttaaatattctgctacccagactgtaattgagaagtacaagttgctctttgggtgttatgacagcatctctgatgaatgagaacctaatccagatcttcttcaattcttccattagtttgatagtctttaaagtggccatttagaggtacactcccagcaggaccctttagggcacccaccaagaaacccttacttggtgggggtnnggngnggtgttaccttggactctttcacacacacacacacacacacacacacacaaagtcctctacagtggacaggtgttgaaaagtgcacagaagaaaatataactaaagctattacaatatcat

SEQ ID NO: 215408 - DNA, 277 bp, Homo sapiens
gactccgtctccaaaaaaaaacagaaaagaaaactaacagaccacagtcatagtgaaaaccagcaacacagtagccactggaagggctactggcagaatagtctttcctggaaagacctcacttgcaaagctgtctttatttgacctgacttccatctcaccaagtgaagaaatctgttttcttggggacactgtcaaaaacatttagagccaaatgtttaactttgtggctgcctgatgcaatagaccacagttgggtcaaataataggctaaacc

SEQ ID NO: 215409 - DNA, 379 bp, Homo sapiens
ctgcccattcaacatatcttattgctgtcctctctggaactctcctctccctagctctcacttttaagctagtggatctgtagcagaggtacttgcccttttatcagtggtttagtgagcggttcccttcgagaagaagatgaaatggcatttacggagtcttggggttgccgaagagagacatcttttactcggtaattctgcataaggctctccccaacagtgaaagcttttgctggcctctttgatgggaactctgttctgggccattattcatactcaaattcagatcagagggatgggcttttatgggttagcctggaaattcaatcttcatgtttatcagggggatttcatcctgaagaaaatcatcactttt

SEQ ID NO: 215410 - DNA, 524 bp, Homo sapiens
aacttggttatctgcttttctagctcacaacagaaaatgaacagccagagatttatttagttcagattgaccacaaaaggagactgcctataacctagcaaggaaagggtacagaaaaagggtatgaaacattaatttaaaaataattaagaagcttccaagccaggagggtcggagaccaggtggttgtgttcagagaagccagcacaatgggtagtttctgaagcactgttggttcccagctcttgctgggatcttgtagtcactggtgatcaccataaccatactggagcaagccagagtggtttgcagcacattttacaagcttcctctcaaatttgggaatgttggaaagtagtgttaattataagactaagctatggttgtcttagaagatgtattttgttcatcttcatattccccacagcatcttgctacagggaatacaaagaaaaaaatcactttttttagaatatcgtattccctaataaaactatatagatgaggcagttgtatgtagaact

SEQ ID NO: 215411 - DNA, 451 bp, Homo sapiens
ttagcccttctcatttactgaatcggtggtgctcctctggtgatagaggcttgttcacagaggggagagtgttcctcaaagctgacctgctttgcttctaggaggagtgattgcttgtcctaaaatcagtgtgtccggttcagccctttagccacagggcttttgtacttgctgttctctctgcctggaaaggccatcctcatggtatctcaagggcttcttttcttacttctttcaagatggcaacatagcagaggcgtccatgctggcaactgatataaaatggccccaccgccccagtgctaggcaatctttagcactcaatgccctgagaaatgtccatatatttttaggtttgtaaaactttattttattgtggtcagattacctaacatgagatctgccttcttaaaacattttaaagtctacaataaagtaccgttaattctaa

SEQ ID NO: 215412 - DNA, 352 bp, Homo sapiens
aatagtccccattttattattattattatttttattgtagagacaaggtttcactatattgcccaggctgttcttgaactcctgggctcaagcaatcctcctgctttggcatcccaaagttttgggattacagcatgtgccgccacacctggccaatactccccagtttatacacgaagaaggtaaaacacagagcaattaagtaactcacccaggatggtcccattgagcaagtggctgagctgggattcaagcccagcgagtcctgtcacataggatcccacgcttatatctcactttgctctatggaagtcatgcttacttttgggaaaattgcctttgattcaaagtt

SEQ ID NO: 215413 - DNA, 625 bp, Homo sapiens
cctcgtggaatgagaaagacctgaccttcccccagcccgacacctgtaaagggtctatgctgaggtggattagtaaaagaggaaagccgcttgcagttgagatagaggaaggccactgtctcctgcctgcccttgggaactgaatgtctccgtgtaaaacctgattgtacatttgttcaattctgagataggagaaaaactgccctatggggggaggcgagacatgtttgcagcaatgctgccttgttattctttactccactgagatgtttgggtggagagaaacataaatctggcttatgtgtacgtccatccagtcacagtaccttcccttaaacttaattatgacgtagattctattgcttacatgtttttgtccttattatgatgcaaatattacaccattttatataagggacttgagcacttgtggattttgatatcctggaaccaatccctcatggataccgagggaagagtttgtaaatgtattaaaacaaagtagtggaattggaatcaaattcttttgattttgtaggtatctgtgtttagccttttcactgtgctgtgaagatttcccccccaggcatcctaggggttgatgggagatttacttaagattccc

SEQ ID NO: 215414 - DNA, 775 bp, Homo sapiens
tatggcctccagctcggaggctggcaaggatggacacgaccctcgcatggtggccgctctcaagcccccactgctgacctggctacaggtccctgaaggattcttttgcaaatactttcctacttttttaggagaaaaataattcattccctccataaactgtttttaaaaataacgaaccctctgaaggctggtgtgtctggtttgcttttgaagccccgccctggccccttccccacacccgcgctggggctctccgggtggggctggagggcggccctgctgggggcactcggcagagaaggaaaagtacttttcctttcacagtctgtaaactgtctggagagcttcaaagttggagaaaccataaaaaagaaaataagaaataacaaaaagtgaggttgccatagaaaccatcctctcccctcccctgagcctgccggggctggcaccggagcgtggaaaaagcgcctcggctggcccgggctcacaccaggaatgcggccgcagctgaaatgggggcaggagtcggctcacaccgcaaggcagagcaacattccagacgccggcctggaaaacagcgctcccctcgcagagcggcggcctcctcggccaggccacgggctcggccgcctgtgcgttcccagggctggacaagagcaagcctcgggggccgggaggaatgtgcttggccccgagtcagctcctttagaaaaaaaaaaacacggttctggggggcctcgccagggggacacacgttctgcaacctggcggg

SEQ ID NO: 215415 - DNA, 449 bp, Homo sapiens
cttgtctttctgtgtgtaatatcaagatggatggatggattcagatgttgtcagcctagtccatccattataaactccccatcagctcttcaactcatggttttagcagacattgatgattattgttgcacccattatttttttaatcacaaaagtcatacatgtaggctgagaatggtggctcacgcctgtaatcccagcactttgagaggctgagatgggtggatcacttgaggccaggagttcgagaccagcctggtcggcatggtgaaactccatctctactaaaactacaaaaattagctgggtgtggtggcacacgcctgtggtcccagctactcgagaggctgaggcataagaatctcttgaacctgcgaggcagaggctgcagtgagccgagactgtgccattgcactccagcctgggtgacacagcaagcgtctgtctca

SEQ ID NO: 215416 - DNA, 643 bp, Homo sapiens
taaccagaaaacagaatgtgggtcccagtacagcatataatgaaaccagttagagacaataacaggcaagaaaagatgatttggcaaggttggaggtcctaatgtgagcaatcaacctctaaataattctaaaatcactgacatgatccagatgatacccaaagatggtggcattgggtactgactctaggacatactaaagctgttttcatgggttataaggtaagatgaaaaactgagggaaagaaacaagtcgttgaagtaatttcagctataggatgagaatgttctagatcaggattgttgagtaagtaagggataaattaaaagggaaagaagtagatgccaggcaagggaaagagtcaagaaattcagaaatgtgggagctagtgaagtctggaaggcagtggtcttgctcaagtactactggggtgtcagactgtgccccacttacaggtagtacaggtgtaggacaggaaagagtgggtaggaaataaccaggtgcagtcgttaacctggtattgatctacccatgggtgataaatgaaatcaaatcagatgaaagtcctctataatgaaagaaaagagagaggcacaaactgacccaagagctatgggatcctgttcaccagtactgggccag

SEQ ID NO: 215417 - DNA, 387 bp, Homo sapiens
cttctagactgattagatttgctcaaggtcatgagggtagcaggatttgaactgctatctgtctgattctaaaatgtgcacactttctgcaactggacagtctgggtccaggcatagtggggggatgttgggggtactccacagatctcagttctttctggtgaaatgaggggcttgtggaggagagctgcccacaggcttgctgactgagcctcaccgtacacgctccctactagccctgagatcctgagattcaatactagatgctcctagtgactgcacaccatcattccaaagccagtgctaatttaatcaggattgacacaaaagctgaaactggaaccgtataaccaaatggaactgagtctatttggataactaaagttg

SEQ ID NO: 215418 - DNA, 324 bp, Homo sapiens
tgggagtttgggtgagcgatggtgccaccaacaaaggtaaagaaaatagaaggaagagcaactttccaggaaaagggtggtgagttcccttttggacacttgcctgtgagatgtggaggtgagctggacatgcaggatctacagcccaaagaagactacaggtgagagtgaaaagcaagggagcctatgagagtggataggtgaaaaggagaccctcagggccattcagaagaacaccctcatctaaagaacaggtgtgagccactggcacccagccacattgtgaaggttttttaatgaaaataaattcaaatcagttcatct

SEQ ID NO: 215419 - DNA, 323 bp, Homo sapiens
ttcctgagacggagtctttctctgttgcccaggctggtgcagtggcgccatctcagctcactggagcctcccatctcctgggttcacgcgattctcctgcctcagcctcccaagtaaccgggattacaggcacaagccaccactcccagctaattgtatttttagtacagacagggtttcaccatgttggccaagctggtctctgcccacctcggcctcccaaagtgctgggattacaggcatgagccaccatgcccggccaagcataaagtttctaaaattataccaggttatatggatactgaactgccgagtttggaagt

SEQ ID NO: 215420 - DNA, 802 bp, Homo sapiens
acttaattctaaaggaatctggggaggctttaaaaattttaaataaggaattgatggcagagttatgctttaaaaacaatcactctggcagtatgtgaacagcagatttgacaaaggagccaggagatcagttaggaagccatcgtaatggaacatatgaggcataatgaggtcctaacccaagggcagtagctttcagcatagaacaaaaaagggctatgtgcaagaggtattttggatatgaagcctgattagatgtaggaaataaggatagaacagttaaagataactccagagttgtaagacggacatttgggagaattgtgatttcattaactgcatgagaaagaaaagagagaagaggaagattacaaattggattttggaagtatttaacatattatggatttgtttcatgtgtatctccttttaatttcttctctttccttatctttggaaaaatcagttcatctgtaatgtacatccaaaactttcttatcctactctttcctccactggatactttgtccaggaaatttatagatgttgcatctgagaaaacgccttggattctgttccgtatttaaacttattccatattagagtcagtgttttaattgcaaactataccattacataaatggctctcatcaggattaagggatggtcccttccagcttttcatcctcctgtgggaaaccatagactctaatgacctccagagatgcaaaggtgataggctagataactgctgagtaaaccctgagcctgctgtggcaggtgctaagcttgagctgacatc

SEQ ID NO: 215421 - DNA, 500 bp, Homo sapiens
caacaatatcttcctgagaagaacaataaatgagacaagatatttttaagaaagatccaaagttgtagaatagcactaaggctaaggaaaaaagtaaaatggcagttgaggctatttaaaaagggttacaaaaaataaatatctttaagaacaagagctattaatgatattttaattttgtcgcatttgggaagtcctaccttgtgttataagccagtatgttgatgtcccaaaagtacccctggaaacaaaccttggcacaagaacataggctccaaggacatctacccccagggacttcaggccccattgtgctcattccattgaaaaactgataatttgtttctctctgactgagtgatctgtcctagcatatatccacataatatgaactgaatcaagtgggttctcacaaacaatggatgcttttcttcacagttgtgttttgttcctgtggacttttattaaattagtactcataagatcttttatctttaagc

SEQ ID NO: 215422 - DNA, 504 bp, Homo sapiens
ctatatgaccttattaggcatttgcaagtcacataatctcttctgtcaccctatctgtaaaataaagatataatcagtggctatttcataaagtttatcaaggttaaatgaggataaagcatataagtaaaattctcgggatagtgtttggcatacaataagtgttcaaacacgtaggacactcctttcaagccaaggagcatgaaaatgatcaaggtgcaaagagagtaaggaaggcaccctttgggatttgtatttccctttgcttctctcttgctcatcaatagtttagggagcttctcaggaagccacagcagatattaccagagatgtcatatagagctgaaagtgtattcagaaaaaccacagtgctgcttttgtgtgtcagtaaccaaaaatgcaacactgcgattgtctgcacaaaaataggtaatgtcaggtaggcttctcagtagttaaatgatacagttagaagaactgttgaacatacttttcacaaaatgg

SEQ ID NO: 215423 - DNA, 863 bp, Homo sapiens
aaatgaaatgtatttagaatgctcccccatttgggtccttgttcatctggtgatgcactttctgagcctgcctctctcactggggtttcctcctgctttgcacaactttgctatttcgcaggctcccccgtgccccagctcacccgagccgggcggggtggtggtggtggtggtggtgtgtgtgtggtgtggttctagctgaagagtttggtacagtggagggcgggtccctcagcctggcataggggctgtctcctggttccaaccaggccgccttctagtgcaactggaattcccacctcctggtatttctggacaccactccctttctctggatcatttatgcttttagaactttgagagtcttctatttaattgcaagtagtaacagctgcatctgcacagcgctgtctccaatactggttccccacatcaaaggcagagggagaaaacagaaggctgggaaagatcaaagtgacttctaagtcattcaaagtagctaggagcctcccagcgaatagaacccgggtgtcccaagcctagagcatgacctagaacttcgctctgtgggatgatgttagcttgaacttcttgttgggcaatgcataggtgctaggagaatgttgacagtgagtttggggttcgctgggatgggatccgagatgtgggcagaggtggacaccagcaggtggaagaatgtggacaaggtggggggtaggggcagccgccgcttcgccactttccgcagctctggttttgctactgtgctgctctccttgggtgcatcctgtgcctggccacgctgccaccctccttgtcacggtgaccacgattgtatgacaataaaatggaccttttggcca

SEQ ID NO: 215424 - DNA, 292 bp, Homo sapiens
  misc_feature (27)..(27): n is a, c, g, or t
  misc_feature (32)..(32): n is a, c, g, or t
  misc_feature (42)..(43): n is a, c, g, or t
ggacctctgatcatccatttcttgctnagatnatgtagactnnttcagaagtattggaccaattatagacccttgtactgctacacatatctacagctacatccctaacatatccctgttcacgcatagatccacttacctgtacatgtacccatcctcacattcacatctacatgtcaacatatgcaatatcttatacttactggcttacatgtgtacgtgtcccaacattctccttccaagtccaacacatgttgacccacgaccatgccgggacccatctctataggga

SEQ ID NO: 215425 - DNA, 242 bp, Homo sapiens
cacggccctcctgtgcccaggcagggtcacagcccacccagagggagctgcccacctgtgcctctgcctcccctgcagacccaggcacacccaggaactgaggcccccaagggatgggtcactcatcagacacccgggctcctgtgctatctcttggggggactttgtgctcccaaaatcaaggtcagagtggccttgttccagggcttctgggtgccccaaatgtctcctgccagaagggt

SEQ ID NO: 215426 - DNA, 281 bp, Homo sapiens
gccatcgtttgttttctctgggcttagaggagaatctagtacatctcttcttttttacagatgagaaaatggggattcagagaagtagtttaggccagatgtggtgcatctgtccccagagtccccagcggtcagtcaagctaaagtgtacttgaggtctaacgtgtggtcattgctgacccgatgtaaagtcccggagccccctccaatgctactgctgtaagagagccttcttgcatccctccaaggaccgtggtctattgattgagttggtgggatca

SEQ ID NO: 215427 - DNA, 542 bp, Homo sapiens
acgtgtaaataaatgttaagtataagtaagtcagaagggaaaagaggaaccatactttgtagtatcttcgtcctactaaaatatctgttgagcacctacaacttaccaggaagaaaatgtttctgctcttatggaaggggcagaaatagaatcatgtacacacatacaaacactatgtgtgtaaaaactatttggttggttggaataaatgcatgacagaaaaataaagcaggtaaggatagagggagtaccagattgagatgagagatactgttattttatataagatggagagtaaagtccttgtgcataatgagatatttaagcagaaaggcaaacaaagtaaaggactaagtaagtcatgaggatgcttgtggaaaactgtttcaaggcagagaattgatcagtacaaaagaccttaggcctgagagctgggcattttaggggaagtgggaggaagctgtggctggaacaaggatagagtagtaggaggtgaagccatgaatcatagagagatgagaaaccgctggaggctttaatca

SEQ ID NO: 215428 - DNA, 267 bp, Homo sapiens
catatgaggccagatttttctttgtatacttcaacctaaacagcatattgcaacaaagtaaatgtagaagcggataggaaaattcagctctttgctgttatgccagatagtgaagacattcagaagatcataaaacagtgctattgttctatcttttttgttttgtagaatatggttatttttcattaaaaattatttatgttaacataatgggtttattaagataaatatttttaaattttctcaagttcttttgagccctcaaca

SEQ ID NO: 215429 - DNA, 540 bp, Homo sapiens
gagatttttgtacatcagcaaaaagcacaaaagttgcactgagtgtgtcacgtgcaggggatggcaagaatttccacttgagtgaagcaaaggaagcaagaaagtggaagcagtctttgaggaagtgtaagtttcatgaccctcagtagggggccattccagaaaatcgtcagtgtgacgtagtcatgtagttagagtggtgggagaaggacagagaagaattaaaattgtctccactttctcagatgaactaattggccagatggcaccttcactggcgacttcaaagaactcagaaggggcaagcattaggtgaggataattaggccaagtctggtggtataaagtagaggtgtcctttcgtttaggttgatatagcaacagagagagaaagagagatagaaattaaaagcagaactgaagatttgggagcctctggcataataggacttgatgggataaacaaagattcaaaagctgggtcattgttactgagctgtgaatagaggtcagcacagacaacagagaaagtaaggtcag

SEQ ID NO: 215430 - DNA, 470 bp, Homo sapiens
aaggttacaatgacagaatttatctttttctttactatatagcctgagctatggttaaggtttgggaaactagtatcttacagaaccttcagaaatttctcactctagaatttagaaacaaattttacacactcggggttgagagaatccaggagcaatcaccacccctagtgttcagatgctgctctccaaagacccttccccattagccacagaaatcagagctccctggggaaacagacagttgaacctctggagcagggagggcccggctgtgcgtgcattagggaggtgggggtgggggcgtagaaaccaaagaagttagaccaaaacgggcccacagctggggcaaatgtgggcataaaaatgaataaattccatctgatcacataatctcaaatatatacatatacagaaatatttctgtgaggtcagaatggtactaaaaaacaaaacaagactggggaaaa

SEQ ID NO: 215431 - DNA, 467 bp, Homo sapiens
ttgggcatggtcaagtttttacccagaactcttcttatagtcaccacgaaaatacacatacaggagtgaagttctgtgaacgtaatcaatgtggaaaagtcctcagcctcaaacactcactcagtcaaaatgtgaaatttcccattggagagaaagcaaacacatgtactgaatttgggaagatcttcacccagaggtcacatttctttgctcctcaaaaaattcatactgtggaaaaacctcatgagcttagcaaatgtgtaaatgtttttacacagaagccactactcagtatatatctgagagttcatagagatgaaaaactctacatatgtactaaatgtgggaaggccttcatccagaattcagaattaattatgcatgagaaaactcatactagagagaaaccctataaatgcaatgaatgtgggaaatcatttttccaggtgtcatctctactcaggcat

SEQ ID NO: 215432 - DNA, 885 bp, Homo sapiens
agaagaaaagaaagaaaatgccagtgtcatccctaaccaaagattctaattgaatttgcctgggatgggtctcagaccaatagaacattccaggtgattcttctgggcagctggggttgagagcctctggtctcagagattctaaactctctcttaggaagagaagtccttctgtcctctccttttgccctgaccatagggtgtctaggcagggagtaggctgtggatggcccctccaggacctgtgtctaagtcattgctgccttggttggctacagggcggcagcttggggtcatatctggtcaggcaaaattgactttcagtctgggcttgagtccagcctctgcctgagtgtttgatattgagtaagtgacttcacctgactggacttccaaagccctcatctgtgaaatggggacagcaacaccattttgatagtcagtatttcgtgactattaaaaaacataacgcaggtgaaatgcttagctcagtgtctgacacataagaggtcctcaatagcagcccattaaaagctcaaagcctcttctgctcttgggttgtttttgccattacatatgggatcccaacagtattagtttcccccaatctctgggggccccggtgctagtgatgggtatatgttgaatcccaacaataaccctaagagagaagatgttccaggtctcactgtccctcttctacaggtgagaaaagtacaattcagagacattgagacccttgctcagggcctctcaccggttcaggcaccaatctggggctcatttctcttcatcctcaccagccccttactctccctgaatgccaagaaattgtgccacctgtgctgcacagagcttgaaaatgtcatgatatgtgggggaagt

SEQ ID NO: 215433 - DNA, 500 bp, Homo sapiens
tcacctctagacatacaaacaattgtaattaaatgtggtatattataaaatactgacatgaataaaggaaaaaatcacagcttattctgggtggggtcaggtaaggcttccctgagaatatggtacttgaaatgagttttgaagttggaggagtgtggccttaatttccatacggtacattttacatgcccaaatatataggacaactgagtataagttataccaattattaaaatttttgcaagttgactggaattaggagaaagcaattaaatataagctactaattgtgaagcatattagctattcttcattccccttgtagaagtagcatctggaacagacgtgttaaggaacggtcagccagaccctcaacaatttgataactaatggccagacaaatgaaggggatgacagagtcatgtttacaggataatgagaaaatctttcacatctgggacatgtaacaatggcagatggcaaaggctagagtgagagac

SEQ ID NO: 215434 - DNA, 796 bp, Homo sapiens
catgtagccaccttatcctgcacaggtctgtggcaggccgtgagacggtgaccagagaagcagtcagcactcacggcccctgccctttcagagtttacgcttgcttggaagcctccagaatggggataagcacaagacatttatgctgggcttcatccaggaagctctggtggaaggaagagaaagcagcccacacagcaaggttcaggagaagattcccatgaaggacaactggggttcagccccatccagcagatgacacggagccggcctcggaggtgtcctcaccgtgggacactggcatctgagctacctcagggcgtagccggccgatgttcccagcctccccctgggcacagccagcccaggccaagtggtctagccccggcccccactcagcatggcccaaaaaaggagcaaaaagcagaaagctcaaggaccctcagaatcaagttttgcagaaagacacaaagctcaagaacagaggtgcaactaagggaacacaccctgtaagactgcctcccagacacaccactgcagccagtgaattgcactgtttagactttgacttcagggtcagggtgagctgatgagactggccccttgatgaagtaagaggccaccaaggagtgagagcggctgagtttgagccctgcctctgccgtctgcaactctctcatcttgagcaggtccagccccagtgtgggcctcagatctcccatccttgagatgagagaattcaaatccagctccacctctgcagcccacgcccttcccctgcactgcatggcatccg

SEQ ID NO: 215435 - DNA, 419 bp, Homo sapiens
catgtagccaccttatcctgcacaggtctgtggcaggccgtgagacggtgaccagagaagcagtcagcactcacggcccctgccctttcagagtttacgcttgcttggaagcctccagaatggggataagcacaagacatttatgctgggcttcatccaggaagctctggtggaaggaagagaaagcagcccacacagcaaggttcaggagaagattcccatgaaggacaactggggttcagccccatccagcagatgacacggagccggcctcggaggtgtcctcaccgtgggacactggcatctgagctacctcagggcgtagccggccgatgttcccagcctccccctgggcacagccagcccaggccaagtggtctaggacactttgccagcaaggacaagatgatttgcttaat

SEQ ID NO: 215436 - DNA, 186 bp, Homo sapiens
gtattttttttttttagagatggggtttcctcatgttgcccaggctggtctcagaatcctgggctcaagctctccacccaccttggcctcccgacgtgctgagattacagacatgataaaaataaatgagcctggctaagtggtggagactgggtaagacaaggctccataaaccttgttcaaaat

SEQ ID NO: 215437 - DNA, 406 bp, Homo sapiens
agaggagaatgactgcagaaggaaatacagagattctaagaggaatgaggagcagtggaaagaataaagtgtgggtaaacttaactgaatgttaattgtatgcaataataatgtcctctgggatttagaatatagaattgaaatatacaccaacaaagcacaagcagctggtataggtggatggaagaagtgaagcttaaggtccttgaattgcccaggaaatggtataagtactaatttatattaggccttgataaatcagggatgcaagttataatttctagggtaatcactaatagtagtaaaagtaaaggtaatagcaaaataaaagtaaatagtaaaaggatgcataacataatagtttataaagaaaaaaatggaataataagaatatttaatccaaaaa

SEQ ID NO: 215438 - DNA, 301 bp, Homo sapiens
tctgtagggagaaaattcaaaatctactcttctggctattttcaaatatataatatgttattgttaactatactcatcctactatgcaataggacaccagaacttattcctgggttctacatccgttaaggcaaccaaggattggaaatattggaaaaaaaaattgcgtctgtactgaacatgtacagacttttttcttgtccttattccttacacaatatagtacaataactatttgcatgacatttacatcggatattatgagtgatctagagttgatatgaagtatatgggaggatgt

SEQ ID NO: 215439 - DNA, 477 bp, Homo sapiens
gagaatagagaggttaagatgggaaataaggctggaaaaagaagcagggaggagataacagattttcaagaaatagagctgttgaaggcttgtacaatattatgtatatattttttaaattttattgtggaaaatttcaaacgcagacaaaagtaggataataaattgaaccctcatgtacacttaacgcaacttgaacaattatcagcattctgctgttcctctttatactgtttgtacatttctaggtactttttatatccattgttgcatttgattaatagcagctttcaatttgagctcagttctactgtatgtagctactggctaagaagattttatttatgtaaacaatttctttgggttttagttgaccacttgctctgttgaatcaatgtgtaacatggccacttaaacacaactaatactgtttttaggttgtaatatagaaacttagtgtctagatccaggaagtta

SEQ ID NO: 215440 - DNA, 585 bp, Homo sapiens
cccagatgataagtggctcaggagttccacccaagaaacatgaggtgaagacttttgtcagatgaatacagaagcaaggcaaagaaaatagtttgattggctaacgtggagcggtagccttatttggatcattcaaatgaaaagtccccagttagagattagtttcgaattgattacacttaattttcgttttcctaaaatgtgattgttacactgagttgggtttcagtttgcttacataggatcccaggatgctgggtcccctcagtcttatggcctcctgattaattaattttaacactaggaaactgggaaacagaatctgggactgaagaagagggtctgagctaagaaaaaagtcctaaacagaggtcagagacactaggcaaaggaaaaagtgtgccaggaattcaataaacttggtgtggagctaaagcctttacaattatgggctttcctactgataagagtagatcactgcaggaaggacactcagaggacacctggtctatgaggctattggggaggatggaactccatctaccacaagtgagatttggtattgtagaaatagcaaaaaaaaaa

SEQ ID NO: 215441 - DNA, 592 bp, Homo sapiens
tccctctttcaacgtttttgaacctattccacaaactcctcagcatcataagataaacctgagcgtgaacccagcctcctaccagccccacctgtgagttggtgcagcctttgctgggtccccagggttagctagccctactgtgtgggtgccacgcctgagaagagcctgggagagccagggaagataagggaatgtgctttagggtggaggaagccaagaaactctatggttcacctgttttttggtttttagttgcaataaaatacatatagtcccccctcaatgcagctttgctttttgcagtttcagttaccctcggccaaccataatccaaaagtattaaatgggattacaggctatgagccacggtgcccggccatagctacatttttacaagtcaaaaaacaaaaagaaaacaaacaaaaaggtgaaaatttttgtaaattacccagcttgttcaaaatagtatcattccaatgtgggatcagtatacacggccgccgatgggaagtgttttacattctctctgtttaccaagtcctgggaatttcgcgtgtactttacacctagaccacgtctcaaaaaagag

SEQ ID NO: 215442 - DNA, 893 bp, Homo sapiens
  misc_feature (752)..(752): n is a, c, g, or t
  misc_feature (758)..(759): n is a, c, g, or t
  misc_feature (765)..(766): n is a, c, g, or t
  misc_feature (776)..(778): n is a, c, g, or t
  misc_feature (788)..(788): n is a, c, g, or t
  misc_feature (793)..(793): n is a, c, g, or t
gccgtctttcaactggcaagagtcattttgaccagcagattaatcaactgtaagacggatcctcacacaaagaggcaactgaaaggatgaaatcactgacttggatcttgggcctttgggctcttgcagcgtgtttcacacctggtgagagtcaaagaggccccaggggaccatatccacctggaccgctggctcctcctcaaccttttggcccaggatttgttccaccacctcctcctccaccctatggtccagggagaatcccacctcctcctcccgcaccctatggtccagggatatttccaccaccccctcctcaaccctaaggtccaccactccatcctgatgccccaggttatccacagcctccttcccgaccaagaccctatccacctggacctccatttttccctgtaaattctccaactgatcctaccctccctactcctgcaccccaaatatgaacaactgcagcaggtgccaccaccaccacaaaagacaccactacccttgtaactactgcttctactacccaaaatatgaattccaacactgcttccaagagacatttacataaaattgcttccatttttggatgagaatgaaaaattccaaaagtgctgagctttggggagaaataatcttagaaagaaattgtagaaaaaacccatgcagacataacatttataccaatgaggcaaaaataaagaattgagcaccaaaaaaaaaaggggggcgtttaaagttctcgngggcannttaggnnccagtttttnnncagggcctanaggangatatagagcaggcggcgttacacgtctgatgggaacgtgtgattggagacctcttgggggcatggatcccagattagcaggaaaaaacgtaggaagatt

SEQ ID NO: 215443 - DNA, 722 bp, Homo sapiens
gccgtctttcaactggcaagagtcattttgaccagcagattaatcaactgtaagacggatcctcacacaaagaggcaactgaaaggatgaaatcactgacttggatcttgggcctttgggctcttgcagcgtgtttcacacctggtgagagtcaaagaggccccaggggaccatatccacctggaccgctggctcctcctcaaccttttggcccaggatttgttccaccacctcctcctccaccctatggtccagggagaatcccacctcctcctcccgcaccctatggtccagggatatttccaccaccccctcctcaaccctaaggtccaccactccatcctgatgccccaggttatccacagcctccttcccgaccaagaccctatccacctggacctccatttttccctgtaaattctccaactgatcctaccctccctactcctgcaccccaaatatgaacaactgcagcaggtgccaccaccaccacaaaagacaccactacccttgtaactactgcttctactacccaaaatatgaattccaacactgcttccaagagacatttacataaaattgcttccatttttggatgagaatgaaaaattccaaaagtgctgagctttggggagaaataatcttagaaagaaattgtagaaaaaacccatgcagacataacatttataccaatgaggcaaaaataaagaattgagcaccaa

SEQ ID NO: 215444 - DNA, 613 bp, Homo sapiens
gggtgcacccagagtccacaccactctccatttttcccactgtcacgttatgtaactaatgacccattagcagtactggaattgcagatttgggggccacagaaaacatcagccagagcgtcacagaagggcaaaccgcaggcgagaagtcccatggggggggggtgggctccccgcagccgggtcagcagcacccagcacccgccctgagtggacaccgcctgcttcgcctgcacctgaccctgcacccaggtgggtgttcgctcctgccgaccccacagccatccaggcctccgccgtcccctttctgccacggggagagttgcagatggggaaacaggctccgtttgtgcctcgccttcctgacttgtgacaatgacaaacagtctcagctctgggagtctgggtttcctgtcgaggaagggagagttagaacagtcgccgtctcaggggtgcgtgggggaaccggaggggtgagcgcagctcctggcaccccgagcctcccgcagggcgctggggcgttgaggatgataaacccggaccacgctgcccgcctgctctctgccgggtccgctgcccacgccgtggccccgccgcgcggccccgcggccgc

SEQ ID NO: 215445 - DNA, 466 bp, Homo sapiens
ctactactaaattcgcggccgcgtcgactgaaagctgagctgaacataaaagctgggagagccagccattcagagagttgggagagcagtgccctagacagaacaaaggccctggagggaggaacaaacttggtgtatctgaggaagagaaagctggccagcccggccagagcacagtgcgttgcgggaggagagtggagacgcagcagggatcagtcgggggcttgcatgtctttgcaaagaatctgattattgtaaacatagtgagaaggcattgaatggttttaagcaaaggagtgatctgacttaaattttaaaaatattcccctggagagccaggcacggtgactcacagctgtaatcttagcactggggacgcggaggtgggagtatcagttgagctcaggagttggagaccaacctgggcaacatagtgagaccttgtctctattaaagaaagaaaaaa

SEQ ID NO: 215446 - DNA, 421 bp, Homo sapiens
gtgcccagtgcacttgtgttcacccaggtaactggatgaactgtgtggtgatggtgttctcctgtgagggggaggggcacagttactagcattaaatattgctagaagtaatatttttctgtttttctatcttgttgctagaagcaatatgtttctatttttaatgagtcaaatgctgactctatttatttattcattctgttcatctttattgagttgtagaggaagagcaaggggtaaaactgacaaaagtccctgacctcttggtgcttttattctttaggggagagatgcagtaagcaagggaacagataaacaaggtaatttctgatgggagcaggagatatgatgtaataaaatgacagtgtgataagggaaagggggagctgcaaatagggaagggggaggccagcacctggga

SEQ ID NO: 215447 - DNA, 279 bp, Homo sapiens
ataaatattctgcctttgtatttccatagcacacacctccaacatagcagtatcacatacaattaatttgtatgtccatttccttcactacaagaagtgccctatagaatattatttgtcctgtatctgtcacaggagttaatgtattttctaggacatagcaagtactacagaatgtttgttgaataaatgaataaaagtggactttatcaataggattgtatatttctttgctttcaatgggaattacaataaaaagtaaaatccatctacagacaa

SEQ ID NO: 215448 - DNA, 291 bp, Homo sapiens
cagagcaagttgtttgaaaatgtgatgctaaataacgggacaaggaggaaagagttgggagtagttaacctctgcagagtaagaaaagggtgagaaaggcctagcgtaggagaatgctgtttttcattataaatttcactaacaatttgactttctcaactatgtacctgtaaactatgtatctgtattacacacttcagattcatgggctctaagaatttttttaaatatccagaattaacatgtaaaaagttccaatttttttaaaaacaaaaaatttggaaaagcaaa

SEQ ID NO: 215449 - DNA, 166 bp, Homo sapiens
actgataaactacttgtgactataactccatgttctaattgtctatttgtgagcctgtttccctattagattgtgaaatcagagaggaagcttactagacatcctgtatctccgtttcatgggactataatgccacttattcagttgtcagagtctgatacatagt

SEQ ID NO: 215450 - DNA, 262 bp, Homo sapiens
aaggaatactggccaagtattttgtaggaagcttgtctattggaatatgacgtttttcttatgattacgtttttctcatgggttttgtggagaaagaccacagagactttcatcacctcatcttaagggcagatactgtcaactgtttatttcttttcaaaagtaacttaatcctccattatgaaaaaattagaaaatacagactaaaaaagaagaaaatagaagtcaccaataatctcaccttacttcccatgaagaaaac

SEQ ID NO: 215451 - DNA, 167 bp, Homo sapiens
cactgaggcttggaaggggaaaacacccaactcagtatcacttatcttgcatttagtacacccagcactttaactcaggggttctgatccaaaacgttaacatctgtctgtcctttgtaagattttcctggaataatcaaatgtctccctccacctttttcttatag

SEQ ID NO: 215452 - DNA, 483 bp, Homo sapiens
acatagcaagtacaaatgtgcagttactcgtccctggctgacgctggacaaatgatgtaatctcaatgtgtctccatttcctcagctgtaaaacagattattttcaggattaaatgagattgcatatataaatatggcctgacacatattagaagttcaataaacatttattttgttatttggaagcctttaagtgttatacaaatgaaaatgttactattttcactgctctagtctaatgcatgatgatgctttatttctctgacatacacacagaaacataagcctcatttcaaaacacctcagacacatgatagatgttaaggacaagaaagagttaaaagcataaaaatgtggagcatattattcatatattttatatatttatataatatttatgattttatattataattatgcattatatgtaatatataattacatatattataattatataattataatatgtaatatataata

SEQ ID NO: 215453 - DNA, 426 bp, Homo sapiens
gatcgtgccactgcactccagcctggtgacaaagcgaaagaccccatctcaaaaaaaaaaaaaaaaaaaaaaaaaaaagatttaatgactgccctactgggtttcaaacttgcttagggcctgtagcccctttgttttggctgatttctcccatttggaatgggaatgtttacctaatatctgtacccccgttgtatcttggaagtaaatgacttgtttttgattttacaggcttgtaagtaaaagggactcaccttgtctcagatgagactttgcactttggactttagagttaatgctggaatgaattaagactttgggggactattaggaaggcatgatcacattttgcaatttgaaaaggatatgatatttgggaggggcttggggcagactgatacagattggatatttgtccccacccaa

SEQ ID NO: 215454 - DNA, 283 bp, Homo sapiens
aacacatcacatgcaaaagagaaggtgatacgaagacagaggcagaaactggccaccaaccaaggaatgacggcagtcaccagaagttggaagaggcaaggaaccgattctcccctagagcttctgaaaggagtgtggctctgcaaacactttcatttcagcccagggatactgattttttttttttttttttgaaagggagtcttgctctgtcacccaggctggagtgcagtggttcaatctcggttcactgcaacctccgcctcctaggttcaagcaatta

SEQ ID NO: 215455 - DNA, 306 bp, Homo sapiens
gcaacatgcttttaggtttggaaaatttcatttgctaccttatgatgattacatgaggaaagatgaaatgctcgctttgagctttatttgagaaagagatgtaataaatgttgtggcttcccactgaatgggacaaatccattttagtcatgtgaggatattaaaaattacatatgtgtgtgcacagacatagcccgtgtgacttagttggcatttgtggtcccagatactgaaaaaggagaccttgggtggcttctttcagaaaatgctgaataaagtttttcgttttatctggctctgaaagca

SEQ ID NO: 215456 - DNA, 229 bp, Homo sapiens
aatgtcttattgtagtttcagataaaggaaaagtgtgttgatattctggattttcttgctatatcttcctatgtggttaacttctagatgccattaaaacctaaccataggccaggcacagcggctcatgcttgtaatcccagtactttgggaggcctagataggcggatgacctgaggtcaggagtttgagaccagcctggccaacatggtgaaaccccatctctact

SEQ ID NO: 215457 - DNA, 366 bp, Homo sapiens
ctgatagggagaacagtttgcccaaatgagcaaactgtcaagagagattagtttgcagaaatgttctatagcaagtaggaaaaaattatttattagtcttgtctttttgagcaggaattttctgcagtggttattttgacacaggtgttgtgaattctcagacttaagctgtgtagatatatataagttatctcaatactcaatcttgaaatcagtttaataggacataaactgcatttttaacaaatgaagtagaacagaattttaaatttctgttttataattttttttagttatatatacacgtgtactgggtcaagatgacaaaatgtaaaaatttttgaggatcttgatcaaaaaatttga

SEQ ID NO: 215458 - DNA, 534 bp, Homo sapiens
ttctgtgtctatatttatgagggatattggtctgtagttcctgttttgttttgttttttttaactgtctttgtttttggtatcaaggtaatactagcttttaaaaatgagttgagagaaggagaaggtgggatttggggggaaaaggttgcagactttttgactcaggtcattgtgggcttagtctctattgagtggctgggttactgcaggaagccactctccattcttaggtgcattcttgtctattaaaggagaaagttaaacgcctctggaaaacctcaggtttattttagtgcttaaagtctgtggctctaaattcagatccagaactcatgtggcctggccagggagggtcacggagtgctttcctcacacctttgtctctaggctctgtagacctagaggtgtgggacgtaagagcaggcccttacccatggaatttacatacaaatggtggaataagacaggaagtaaataaatgtgattattctgataatggtaaaaataataaatgagataaataaataaaatc

SEQ ID NO: 215459 - DNA, 368 bp, Homo sapiens
cggtgcccggcaggggctcgaaagggcccgggccgccccacagtcccgcccgcactgcttccgtccggggacgctccccagggccgtccgagcggactacgcgcgggtccccgtggctggggggcgagcgtgcggccggcgtctgcgcctctcccggaggcgaggcgggggtcgggttgggaccagagcgcgcttccctccccgccgcgcagaggtcggccggggccgcggctggcgacaggtggcggggacctgggggccaggtccgcgggtagcctgcgacggggaagacgcccctacggccctcagggcttcctccgggtatgatgatcaaccacacgaccgccccgcgctggccccggcagagc

SEQ ID NO: 215460 - DNA, 215 bp, Homo sapiens
atcctttgccacgatttttaaatagcgcctgccccgtggtcagtgcctcctgtgttggccgcaatgctgtgctcctcacagctggcgctgaccgctatttcctgctctagggcggtaggcggcatctgagagcatgaacaaaatgccctacccagaaggagctacgtctttgttgggagacagaaaataaacaggatacataaataaacaacaca

SEQ ID NO: 215461 - DNA, 417 bp, Homo sapiens
tatacgtgtggaagggaggaaggatacttcagtttgctaatattccatgcatttttaaaatgaaaattaaatcaatgagaatgagaaagaagaagcctagactggaaattttaaaaaagaatccatatttcttcttcttcttcttcttcttttttttgagacagagtctcactctgttgcccaggcataacagaccgatggaatcaactatggtacatacacacagcacagctgtgaaaaggaatgaagaagatctgagaaatgatatggagtaatttccggagacattgctaagtggaaggaacacatatgctaccctgtatgtaagaaaggaaaagaagaaaacatacacaaatctgcttatttttacagaaagaaacacaggaaggagacttcttcagtacacaatcaagttgg

SEQ ID NO: 215462 - DNA, 415 bp, Homo sapiens
tcctgggctcaaggattcttcccacctcagcctcccaaagtgctgggactgcaggcatgagccaccaaacctggacctaaaactcttgtttttatggaagtcctttcatcaaaaaaacaaaaaactataatggaaatcaggatctatttagatgtatataaactacattatcaattcgacagaatgactaacatcaaacttagaaaagaaatgtacatcttcaaatacatgacagcaaagattctaggtgttaagtttaatatgccaactacaagatacggaatttagagtatcaaaatgttctttttcttaagtagatttgttcccagtatttttaaaattacaacttagaaaaaaacttgttcctattttcttgtaattattccaatttaacgttatcagctttgctggatac

SEQ ID NO: 215463 - DNA, 256 bp, Homo sapiens
cagttttatttccctggaaggcagggaacccccatgcataagctagccaatggtcctgagactaggggcaaaactgtgtacaggcacctgtgtgtcattcctgaggacatcagagtgttctccggtgatggaaaacctctccttgattaataggaaggctttccatttatacctgaagcctaacgacctcagttggtacctgggcaggaacaacctcagattaaacacggcgatcatggccatccatctatcagtc

SEQ ID NO: 215464 - DNA, 370 bp, Homo sapiens
catgtcatcaccttgggaggtgagtagaaaagcctggtggaagggaaatgtaggcagcaagggaagagtaagaggtggaagtgtcttgtgacaagacagaggaacaaagattctgaaagtgcaggatgattgtcaagggtttgggtaaaaatgctttgatttggcacacctgttctcccagctatttaggacactttggctggaggatcacttgagcccaggagttcgaatctagcctgcacaacatatcaagatcccattccaaagaagaagcagaaaacaaggagaaggagaaggaggagaaggagaaggagaaagagaaggagaaggagaagaggaagaggaagaggaagaggaagaagaagaagaa

SEQ ID NO: 215465 - DNA, 219 bp, Homo sapiens
tgaaggtggttttttctgtgtagagttgttaaagtggtgtccttggcagggggaatgatcagtggagccttctattccaccatcttgctctgcctctcaatttcccttttgatttctgtagggtcagtagtaatatcttgtctttcattcctgatttgagtaatttaagtcctctctcatttttcttggtcagtccagccagaggtttgttgattttgt

SEQ ID NO: 215466 - DNA, 435 bp, Homo sapiens
acacatgctccagataaggtctgtcttaccagcagttttcagtgagactcttgcccatctgaagaaacctacaaatttctacttattatagttcaaaactaatcatgccactgtactccagcctggggaacagagaaagaccccatatcaaaaaaacaaacaaaaaatttcctttactgttatgccagggcttcattattctctaattgtgtatatcatttcttaaacctccaagtaagactttgcatttatctatgttaatttgcctcttgttgatgtgggcccattgttatagccattcaaaccctaattatgacatacaagcataccttcatttaagcagttttttaatacatttcatatttattttctgaaaaccagactaatcattcattaaacactttccctgtgtaagacactgtctcatttctcctt

SEQ ID NO: 215467 - DNA, 464 bp, Homo sapiens
ggaagggaatagtcaaatatatatgttatcattctcaataatctgagatgaataccttcacttctttttattccttcatataattttaaaaataaaatgttaaatataattcaaagaaaactcagattggaaccagcaactaataattaaatcatgacagccccctccccccgaaacaggaataaaacatttgctgaaacacaaaccacaattctaacttaaaaaaaaaaataaacttcaagtatgcaacgaaacaacaagcagaggtgccatgaacactgaattgcaaacaataaaaaatcacactgtacccccaaaatatgtacaatgattatgtgtcagttaaaaataataatacaagcaaacaaaataaacaaataaacctaaaaaggaagaaccaactttgaaaaataaatgcacagagactggaaatgaaaggacaattataaacaaaataatatcac

SEQ ID NO: 215468 - DNA, 303 bp, Homo sapiens
ggaggatcatttgagatcaggagttcgagaccagcctggccaacatggtgaaaccttatctctactaaaaatataaaaactagcggggtgtggtggtccacaccggtagtcccagctacttggaaggctgaggcaggagaatcccttgagcctgggaggcagaggttgcagtgagccgagattatgcactacactatagcctgggcagcagagtgagacttcatttcaaaaaacaaaaacaaaaacaaaacaagtaatttaggagtgtggagtcaatgatgtccctgcacccttttcatgttt

SEQ ID NO: 215469 - DNA, 227 bp, Homo sapiens
taactatcaagctgttacctgaagacagattagaattatatgaagctgtggccctcacgcctatctggagatcttatcatatagttattcatcagttttaaatgttatatattgttcctacggagaaaacagccactcataaatttaaatgaactctaaatgttttatgtgttattaacctttttttcctcagtcgtgctaatgtctcctaatttagatatatacat

SEQ ID NO: 215470 - DNA, 466 bp, Homo sapiens
agtgtatatacattaagaattttatgtcttcttggagagggtgggccccctttattattatgtaatgcccctcttcttccatgattttcagtgctctaaagtctgatttgtctgagattaatataactactcaaactttttgattactgttaacatactatatgtacttttctccctttcttcagttctgtccactctgttgatgacctcatcaaagtcactgttctcttgttagttttttaatgctagaatttccttttaattcttccatttctttgcttttattgcccatttgttcttgcacgttgtatactttttccatcagagctcttagcatattaatcatattttaaattcccagtgtgatcactgcaacatccctgccatgtctgaatctgattctgatgctcattttctcttcaaactgtgctttttgtctttcgtttttgttgactgttggacgtga

SEQ ID NO: 215471 - DNA, 504 bp, Homo sapiens
tgctacagaggtaaaggtgtggcctttgtcctaagggcaatggggagccagtgactgtggtggtgttaagcaggagagtgacaccacaggtcaccttcgaaggctcgtcactctgactgccccttagagggtagtttgtggagtgttttagtccagcagcagggagacccgttagcaagctgcacagggatccaggacaaagacgacagatagaagggacagtcagaatagataccaggaaggccaggaagttggagtctctgggacctggtaactgaatgcaactgaatgatgcagggagtgagggacagggagggagtcaaagatgcctcaatagccataagtaagtttccaaatgtacaggtgacttgccgtgcacctgagacctgggaagacaaagaggagtaaaacccaccgcccatgtcctccaaaaacacagaacctagccaaagaaacaaaaatctcacagagaacaattaaatcaccatcacaataacatttact

SEQ ID NO: 215472 - DNA, 217 bp, Homo sapiens
cccttcaatctgtggctgaaggcctgacagcccccaggaatcccctggtgcaagtcccagagtccagaggctgaagaacctggagactgatgtccaactgaaggagaagagggaacaagtgtctggcacaggaagaaagagagagccagaagactcagtaaacaagcttaaccttgcttctttcgcctgctttttctagctgcactgcagcttattg

SEQ ID NO: 215473 - DNA, 372 bp, Homo sapiens
caacctgtgagaagccttccaatactctaaagattgagccatctgtgtcgtgctctatagcactttacatctatgctagcaccctactatgttgtatcacaatgtggtgtttacccatctgcccctcctacaacttttgaaactccaagaggaagaaactatgcctcatttatctctgtatttctttctttttttttttttttggttggggggaggggtcatctttataggacaaataaatgaaccattttcttcccagacgtgctctccatttctacttagctctctttcctgctctcgattggagggttctgttgacaagtttttactcttaaatttcatataataaataaaattacattcacaaactta

SEQ ID NO: 215474 - DNA, 934 bp, Homo sapiens
gtgagggtggctttgtgaggatggctttgtgtggctgcacattgcccttggccaagccccgctgccaggagaggcagctcggctgccaaacctcctgaacccaagttacctgagcaagcagccctatcccctcgcctgcttctcactgcctcgcctgccttgggcctgcccgacccagggggtcacatgccttgttccccatcagtggagaccagggacaagaagacagttctgtgggaagagccaggaggaccatttgggaaaatacaggttccaggtgtgtctccagaccttgagagttggtgtctcctgggaagaggccctgatgagatctggggagattcggatctgatgagattcaggaagccctggcctctccgtacttgaggagacgggacacacaggacaagctgcaggctggtgagcaggttcaccttctattttgaagacccgcttcttcctcaggtacctgatcttgaaaacgacctcccctttcaggccggcgtgcagcagggcaatcgtggttcactgcaacctcgacctcccagggtcaagtgatcctccagcctcagccccacaagtagctgggaccacagacggttgagcccatagaacaggagtgagaagatggaagggcgagggggctgggatgatgaaaacttgcgcctgcagccaccattcattacagagcgccgggggccagctgcagaactgtagactcctcatacatcatcgtgttgagtcttcaaaacaaacctatgaggctggagtgcagcagcgcgatctcggctcactgcaacttccacctcctggtttcaagcaattctcccgcctcagcctcccgagtagctgggattacaagcacccgccaccatgcccggctaatttttatatttttagcagaggcgggatttctccatgtagcccaggccgg

SEQ ID NO: 215475 - DNA, 803 bp, Homo sapiens
gtgagggtggctttgtgaggatggctttgtgtggctgcacattgcccttggccaagccccgctgccaggagaggcagctcggctgccaaacctcctgaacccaagttacctgagcaagcagccctatcccctcgcctgcttctcactgcctcgcctgccttgggcctgcccgacccagggggtcacatgccttgttccccatcagtggagaccagggacaagaagacagttctgtgggaagagccaggaggaccatttgggaaaatacaggttccaggtgtgtctccagaccttgagagttggtgtctcctgggaagaggccctgatgagatctggggagattcggatctgatgagattcaggaagccctggcctctccgtacttgaggagacgggacacacaggacaagctgcaggctggtgagcaggttcaccttctattttgaagacccgcttcttcctcaggtacctgatcttgaaaacgacctcccctttcaggtcttgcttcccctcaacccagacaccgactcgcccaagggtcttccagctggctgagttggaacctgcattttttaaccacaaggaaaagaagcccagagctaccaagaataatattttattgacttggaatgagttttggaatctgtatttttaacaagctgcccagtgaaaaccatttcctcctcgtcgtggcgcaggtccagaggctgcgcccatctctcccacgtcaacagtcctgtgtccttggcgaaggactgttctctcattcagtgcctttcctctcttcctgggccaaatccctg

SEQ ID NO: 215476 - DNA, 725 bp, Homo sapiens
gtgagggtggctttgtgaggatggctttgtgtggctgcacattgcccttggccaagccccgctgccaggagaggcagctcggctgccaaacctcctgaacccaagttacctgagcaagcagccctatcccctcgcctgcttctcactgcctcgcctgccttgggcctgcccgacccagggggtcacatgccttgttccccatcagtggagaccagggacaagaagacagttctgtgggaagagccaggaggaccatttgggaaaatacaggttccaggtgtgtctccagaccttgagagttggtgtctcctgggaagaggccctgatgagatctggggagattcggatctgatgagattcaggaagccctggcctctccgtacttgaggagacgggacacacaggacaagctgcaggctggtgagcaggttcaccttctattttgaagacccgcttcttcctcaggtacctgatcttgaaaacgacctcccctttcagttctggaggccagaagcccaaaatcagtctcgctgggctaacgtgaaggtgtcagtcgggctggttccttctggaggctccagaaaagaatctgttttcttgccttttctggctcagtttctcggcttgtggctccttcctccatcttcaaagagcaccactccaatctgctcctccatcaggtcaccttctgcctgactcctacatccctttcagaaggacccttg

SEQ ID NO: 215477 - DNA, 229 bp, Homo sapiens
agaagtcctggtgacttcaagctcagaaccatggacggcagggctccctctggatgtggaattctccgtccctttccagggagggaacaaagcccacagcaccggaactggccagtcatggtggcttatgcctgtaatcccaggactttgggaggccgaggctggaggatcacttgagccaaggagttttaagaccagcgtgggcaacatggcaaaaccccatctctac

SEQ ID NO: 215478 - DNA, 894 bp, Homo sapiens
attctataataaaataaataagagataatagaatccccggagtccaacatttctgatttaatatgcttgtaacatttgcctaacacaccactgtgctctctgaaaagggcgatcattttcactgtatggtgttacctagactgcctatccccagggtcttccaaaagtccatgtacgtttgacagcatggaaacgtgtactgttgtagagcataaatactagagacttattgatggaagcctatttctgatacgtagctttttaaagaccactcaatatacataaactaaatgttaagtgacaaaaatattttcaaattatatttcctaccatttaggacctccttaaatttaacagcaggttaaaggtttggggttggcttattttttaagaaaatatacattttgattgttttgaaagtttatacatttaaggtttctaccaaacaggtagatataaccatactttcagcaagattacattttcctttttctattaagatttaaaatgttccattaaatctgagtagctagccaaaactgagctttccaggagactttctataccagtcttgctgggagataattgttgctaatctaagtccaagggatagtgggatgtttttcaacactggcaataaaaacaaaataactctttcaaagagggagaagcaagatttggattctaagaattttccttgtgaaagaaaactttgtttatatctaattggttgatttcactactgtagcaaagatacaagaaaaaaaactgggaaagatttttaaaaactagaaaattaacagtctatttcatgtcgtttggggaaaaattaaatgacattatgtttgtgaaaatgttttgtgaattgcaaagttatattaaaattaattgtta

SEQ ID NO: 215479 - DNA, 399 bp, Homo sapiens
ctgttgaattttaagattatttgcacttctcttaaggatatcaaagagatctgagttatcacccgatgccccatggtgagaacaatcacccctatttcctaattaggaaaattacagtctcatctaggagaaggtacactgacttgtcaaggacaaaagtggagagtgagggaaatggcatctgaacccaggaagtgcttcccacttcttcagaatgaggctgaatcaatttctccaagttcctccttcctagggatggaaggtagacctgtacttttcagaactctgaggtcagaaagctgaaaagaacagcagggagggactaagaggcctgatgtgtggttgtgggttttcttctcttaaagacttttcttacatgagatatcttccaggaaaatg

SEQ ID NO: 215480 - DNA, 449 bp, Homo sapiens
gaacaaccaagactggctttggtccctggcagcccagctctcacaaagccgggtggatgggtctgaaagctcccagagacctgagcacccctgtctcagatcccagcatccgtgagtgacccaacctgcctacccattgagctgtgtaattccatgcagaacacagggatccattcttcttcctctgtaatcttccacccctgccctcccagctccccaaaggtaaacaccttcataatttggagtgtttccttctagaccctttcccccacctacacagtcatatatacagagccatagaaaatatgtaaaatacttagtaatgtagtaatgttgtaggtggatatttaatagaaatgatgcaacccttgggaggctgaggagggcggatcacttgaggtcaggagtttgagaccagcccagcctacatggtgaaaccccatttctac

SEQ ID NO: 215481 - DNA, 348 bp, Homo sapiens
caaggtctcaccttactgcagagacaaagcagatccagagcccctgggcatttactcttgctacctccagcttcctagtgtctcaaaaagccacaatctcactcagaggaacaccccggtgctggttctaaatttgatccaaggaccataattgcaaacccatttctctaaactgtagaagctcaatcttccaacttgccaattgggcatgaaacaatgtaccttacaaggtttcaacgaagagctaaggaggccccaaaaagtaagatcctttccatcataaacattcctgctcttaggtcctgggccctagagcacactatccgagcgagtcagcatgagacatac

SEQ ID NO: 215482 - DNA, 154 bp, Homo sapiens
ggtctagggaacagtaaatgtggacagactggcattttacctcgggcacacttggacctggataggctccaccagtctgccctggaaacagaaccacagtgggtcagacagtcttttgtattagttttaaatacagagttgattgtctctcttg

SEQ ID NO: 215483 - DNA, 347 bp, Homo sapiens
tacataggtattttaatggttttgaaatttagaattaaaaaagatataatgtatctacccttctgtaaatgtatgagattcacctatgatgatataggtaattctagttcattccttttcaattatttattccacaaaataattccaaatattttatatatatatatatatatatatatatggttggggcaaaagtaattgcagtttcagactgtgaattttaaatcattataactaggctaaaacacatctttattaatcaaaataggaaccataacaatcaatacattttttgccaatgagaaataggtatgtttattccgatagcataaaaatccatgctttgg

SEQ ID NO: 215484 - DNA, 399 bp, Homo sapiens
atccactgtgagtgcaaggggaagaaataagtaccccctctcagcctgtagtcacatcttccctctctctatatggctatggacgcagtcccagaattctggatttcttgcatgtctgcctttaataagaaagcagagtttaaataggctctcactattgtttcgctgcttcacaccctcctggtttgctattgttcatgttcaatgtgtgtttctctactaggtacataattaactttctatttttccctcacagttcaaaagcttacaagtataaaagcttgctgttgtaaatacattgaagagagaacaccatactgtgtttatgggtgggaagatggctagaaaattttttccaaggaaaaggaaataaacatgtatccgaagtccctgaataca

SEQ ID NO: 215485 - DNA, 363 bp, Homo sapiens
gaattacataaaatgttaaaatttgaaccaaattcactttgagagtgaacaactcaacctagaaaaattgtataatcagctatcaaaagctacatacatgcagggttgtaggattctcatagtaatcacatctgagctatatttgtcgagtttataacagatatactttgcatacataatcacaaatcttaccaacagctctccagagtaggtaaagcattttttactgttcctgttaaggagacagaagttaaggatgtgaactccccaaggtcactcagaaggtaagaagatgggctaggattacggaaagggaacatgggaatgtgctgtaaaagttttctttctaaacaacttacagag

SEQ ID NO: 215486 - DNA, 817 bp, Homo sapiens
aatgaggaggacaacctggaggcaaacagaagagagattttctttttcaagagaaatgatatgaatgacagtgtcttgtgtcatcaaagtttaagtaaggtaagggttgaaaactctcttttgaatttagcacctggaaactcattggagttaccatcactatcagttacttaccttcattaaatttgtacatacatggagacctattacatcatattctaaattcctaaagtttgtgagttcacgggaaatgaggaaagggaagaggtgggactttggagagctgttttaaggagacgtgaacacacccaggtgcagtgctatgcaagtttccccattcagtgtgatggactcaagtcacctccgctcattagtaatatgatagggacagtttcagcaaagaggtgaggcagaagcgagcttgcagaggtggagccaggggaggggaggatgtcgacacaatgaagtgtagtcctttcaggcagctgcgcaatcccagcggagagacactcgcaggttcagaagatgattttacgattggcgaacctacttgttggagggagaagtagagtttggagagatgagtgttcgctgagcaggcactctgcaagcaggcagaagtggatcctagtgtcgtaatttgtcgctcattctctctgggttggcgcgatccggagtacttctatggcatttcacttgctgtaaagctcattttattccaacctttcctggtctctgttaagggagggtcctcaaccttttttgtaaggttggcacttttttttctatttgttgcctgccgccattattttttttt

SEQ ID NO: 215487 - DNA, 394 bp, Homo sapiens
cttgaggaaaaggatagtggattgggtatctggtactgcattaatctcctgcatcaatcgtgacctaccacttagctgcgtcaggaccccttctcttctagagagtgctaaaggcactgcctaatcacctctcataaatcccctgttctaacttacatagttgtctgctttcgggttgcatgttcttaaaagcagacagcaaaaccctggaggaggttttatacttagtcattagcctgtcattcctgctggagttttacagcctcaccttagttggattttgggagcttaaacagacttctaaaaatgttttaaatttaaactttgtattaagtgtacagaaagttttaagtatacaaaaacctaaggaggattgtataattaacccctatac

SEQ ID NO: 215488 - DNA, 197 bp, Homo sapiens
ggtagagatggaattttgctatgttgtccaggctggtttcgagctcctgggctcaagtgatctgcccgccttggcctcccaaggtgttagaattacagatgtgagccaccatgcctagccaccactacttcttaatagctaaataggatttaagattaaccatcacaccatcagatctgagcccttcaacaaccctt

SEQ ID NO: 215489 - DNA, 820 bp, Homo sapiens
agtgggctcatttagcatttcataaatgttctctgttctcaggtcatgaccctttgcccaatggtttcactatggagaatttacagatgtaactgaaaaaatataaactacaaataaattcattggataacctattttttttagagtcatttactcaagaaattaatagggaacccagagtctagcagtcgggcaattttgttttctgattctgcaacctgtggcagatggttttcttggcacgtgtgaccctggcattttgcccatatttacacggactgacaggagtttaaggctggagggagcatttattttacgtgaggtaaaaggtcatgtcaggcttgcttgtcacctgtgtgtacatgtggttaattcccagtcacttccatgtatatccacacactggcaaggggctatatgagcatgaagcagcaagtagcacttgacctctgttctataaagagtgctaacaaacaagcggaaattgtgatcctatcattatttggtttttcatcccttccttccctatatgaaaggaaaagctcttgaaatagtccattctggcggggtgcggtggctcatgcctgtaatcccagcactgggatggtcagcccgaggccaaagtgggcagatcacttgaggccaggagttcaagaccatcctaggcaccatggagaaatcctgtctctacaaaaaacaaaaatgagcggggagtgttgtcctagctccttaggaagctgaggcacaagaatcgcttgaacccggcaggcagaggttgcagtgagccaagatcactccactgcacttcaccctgggcgac

SEQ ID NO: 215490 - DNA, 500 bp, Homo sapiens
cctaaagaaaggaaggagagggaaacaagacagcctgctcggctgggagccgagagacaaatcccactgcggagaaaacagtagtgggagactgcctgtggtccacattcccactgtggactcctgcaattctagccattggggagcccctaggacctcatgggctctgaaactaacataaggatctgtctggaaatggtgcaacagcaccactccactgaggaaaattgcactgggtcccataatccccctaagtcctaagcagctacaacaaggcaccattttgacaacccagcccacaacagactgagcactatcctggggcccagcagctggtgcacagacagaagtaagaaacaggctgccaccaccaggactgaggcacaagcggggcatgtgtccccgaccgccgacctaggctgccaccattaaaggcagcctcatgttccccagtagcagcagcacagcacagccactgctgcccctcacccaatcattcc

SEQ ID NO: 215491 - DNA, 574 bp, Homo sapiens
attaaaaacctcaaaccgttgctcttcttggagtcacttgaattggtagccctgaagaaaattcctaaattagactttcttctgttcttgactgaacgaggatgaatgagtcacccaatcctgtgccaggtacaggaataaatgctggacagttacagatgaaagagagcatgttgccctttaaggacttcaaagtttacagagagaccagaaaacaagaaattaaagtacagtatgatatatgccacagagctataccttggaaagaaaaaggatggacagcacagactttaaagcagtaacaggaggtgggtaggaaagccttccagagaaggtaagaatcgagaggagtcttttattttccctgttactttattattaaaaaatgtcaaacataactgaaaggttgaaacatctgcagatccaccagcttcttctacaattgtgtaaagcatagttcccataataaattccttatctcatcattcatgaaggttctacctccctgactgatacacttactggtactggccgtggtttcaggggacagatcattaaggataggaattggaaa

SEQ ID NO: 215492 - DNA, 665 bp, Homo sapiens
gttttattcactgattgatctcaggtagaagctctgttgggcgccattcttccattctttccttcagctgctttttagtgagaagctaccatgtactgggtaccagtctaggatctggggatacagctggggttgccagataaaaatacaggatgtccacttaaatttgaatttcaggtaaacaatgaataacttcttagtttatgtctgtcccacatactattttggacatacttcttctactaagaaaagcattcattgtctgaaattcaaatttaactgggtatcctgtatttgtatttgctaaacttggcaaccctagatatcccagggaagaaaacagacaaatatccctgcccttgtggggactgcattcaagtgaaaggaacaggcaataaaagaaatatacatatgaataaaatacaccatagcggaaagggcaatgaggaacatgaagcagggtgaggagacagagaatgccgggggatgcgatttttattaggacaggcagggaaggtctctaacaggtgacttttgagctgtgaaatgaacaaagtaaggtagtggccaggcaatatctgagggaacagtaagtacaaaggccctggggtggggtcatgtgggcgttatcaaggaacaggaggacgatcagggtggcagaggga

SEQ ID NO: 215493 - DNA, 540 bp, Homo sapiens
tagcaaaaccttgtctatacaaaaaatacaaaaattagctgggcgtggtggctcacacctgtggtcccagctgcttgggaggctgaggtgggcagatcacttgagctcaggaggcagagggtgcaatgagccgaaatcacgccactgcacaccagcctgggcaacagagcaaggcactgtgtcaagagagaaaaaaaaaaaaaatgttctaatagagatcagcacagacagaacagacaggttgcaaggctggtgacagtgcactgaggtctgcatcattagcatccctcatctgccctgctggagctgctgacctctctgaggctgcctttcactgtctcccaatgtagccttgtctcctacctttcttcctcttcacctgctccaaataccctgctctagccctgaaaagaccaaaggtatacatcaaattctttctaagaagccaatcacaagagagttctctctcagcacagaaatcctgccatgctttatccctgtacctgcttcctcagctctgaaaagggagagaaagggaaa

SEQ ID NO: 215494 - DNA, 426 bp, Homo sapiens
cattctaatctgcactcgatcttagccaaaagtctgagaagcaatttccattctaattgtaaaacaagtggcaagagctaggcatctctgggactcctttaacagaagacgaacaaaggggaagaccattgcctctttctctcaatccctttcctctcccctcagctcagagctccaggtggctccagcagctctgacatcacctgcacccatagcgcttgacagggcagcacctgaacgcttgtaagtcagacctgacaggagcacctgtgctgcttggcagggtggtgtggggcgaactggagtgaatctgtccttgggtacatggaaaacatactctaaggactcctgaaattgaagaaggcttactgctgtgaccatggccatattgatagctgtaggcaggctgttggggtgtggtgagac

SEQ ID NO: 215495 - DNA, 748 bp, Homo sapiens
agaagatatgaacactgatatcaaaaatataagtcttgtcagctggccacagtagctcacacctgtaatcccagcaatttgggattgctgaggtgagaggatcacttgagtccagaagttcgaggctgcagtgagccatgattgcgccactgcattccagcctaggtgacagagattcatttggtattttttaataaattagaagtacatcatattgaagcatggtatattaaaaactgtttctacataaactgctaatttagatgtttaatcatcatttccacaagtgaagaatcttgctgtttctcttacttggtcttaatcattttccaaaaccagtaattttgcagagtgaaataaaattagcttctaataagaacacaagagaaaaactgaactaaaagtgattctcatatataaaatttaatcactaaactacaaatttatcatccaaatttagaaactaaatttagaaactaaatttagaaaactatttttggaagcactggaagtatatatttaatctgacagactatgaagcactgacaccttggcagtggtaatcagatggtaattattccctaggcacaactcctaatcaataaaagtacagtcatgtgcagcataacaacgttttggtcaacaacacactacatactgacagtggcctcaagagattataacagagctgaaaaattcatattggccagagatgtcttgatgtctgaccctgtgtaggtctaggtta

SEQ ID NO: 215496 - DNA, 324 bp, Homo sapiens
tttttttgagacagagctccaggctggagcacagtagcacaatctcagctcactgcaacctccacctcctgggttcaagtgattctcctgcctgagcctcccaagtagctgggattataagcacccacaataacacctggctaatttttgtatttttagtacagacgaggtttcaccatgttggccatgctggtcttgaactcctgacctcaagtgattcacctgcctcagccttccaaggtgctgggattagaggcatgagccactgcacccagcccaaattgattcttttataagcaaaaactaatatgtaaaatcatcttt

SEQ ID NO: 215497 - DNA, 621 bp, Homo sapiens
tcagaagtctttgtgtccctgtttttgtgtccatttcatgtaccttggcactttaaggcttgtcctgcaaaataaaacattgcatcatcacttgtgaaggcagagcttgggagtttgcactgctaagatgaggataggaaagaaatttatgccgcagggcctttgatgctgcccactcacctgtctgcacagccagggcacggccagcgggagtggagaagatgagcgagaccaaaaccttgccgtggggaggagggtggcatagccattgataaatcgggacttgaactatcccatcactctaaaaatattttttatctgattacaaaagtaatagatggccaggcatgatggctcatgcctgtaatcccagcactttgagacagcaaggcaggagtagcattcaagcccattagtttaagaccaaccctggcaacatggtaaaatcctgtctctaccaaaaatacaaaaattagccatacatgatggtccatgcctgtagtcccagctactcagaggctgaggtaggaggatcgcttgagcccagaaggttgaggttacagtaagctgagatcatgccactgcactccagcatgggcgacagagtaagaccctgtctca

SEQ ID NO: 215498 - DNA, 521 bp, Homo sapiens
gtgtgaatggtgagtgttactctataatagtttatataaaccagaagttggtcactgtggtggcaacttgtttggtgctagtcattaggcacatcagttcttaggaaattctggagcatcttttggagacagtgaacatctgtctttttttgtatcaggtctttgataacttttgatggttattctgttggttacttcagctttttaaggtttacagcaggcctgggaaataaattctcgtgataacctgaaagtcttcagttaatttaacatcagatgttgctagtatgagatgataaatgttagggtttttaagtaaaaggagtttcatgctgttacttctctttggtagtgggttttgtgacttctacttcagatgtagtggtggtagtgatgttcctttggcataaaatgtgtatattaagtcactttgtttgcagtactgctaagtggtctgatagagcaggatgcttagatataagatgtctgctatttatttttgttggcacatttagtcactt

SEQ ID NO: 215499 - DNA, 277 bp, Homo sapiens
taagccaccatgcccaacaaccttcttcatttctgattttatttacttggatcttttttttcttcttagtctacctaaaggttgttgggcatggtggcttatatctgtaatcccagcactttgggaggccaaggcaagaggagcacctgagcctaggcaatgcagtaagaccccatctctacaaaattagtcccatctctaaaaaattagccaggcatggtggtgcacgcctatagttccagctacttgggaggctgagtcgagaggatccttccag

SEQ ID NO: 215500 - DNA, 1084 bp, Homo sapiens
ttcagtccagtgcctgggacataaaagacactcaggaaatggttattggtatcattttattattgtgtcttcactgtggatgcatctctgccccttcctacttcgtaagaaggatattaaagttcagatactttattcttcagttgctttcaagttcaaagaaagtacgtatgtgttaccagttcaactgggtctgagccttccttgttcccacctgcattgtttcctcatcagctccttgctctcttctaccagcacttgttttatttttatctctactcgtttctgcttttttctgttcctcattttctttcagttctgtttgtgaaacttctcacagctgaaatcatagcagtctcctatcaataaaaaatagttgaatgaggatagaactctttcgcatgcatgtgttgccgagggcaagcttctttcttgtagcatcacggggaggcattgcaggagagaggggcaggtgcactggctttgcattaggaaagcccagtagctcttagacttgctaaccgtgtgacccagcctcagtaagctttagtccccccatctgtaaaatgggagcagtgagagtttcttgaccacagtgttgttgtgaatgcaggtcctcacttccttatatgaaactcgggccatatgctgtggatttcgcaatagccctgggagttctgaacagcatcctatagtaaagcacattaattattttgcagtcaactgtatgaatattcatgctgggataaataaagattataaatgggtttacatcagttcaggtcaaacttttcaaccaaatgagttcaagtctggttgggctttgccaccaaataaattatgaataaattttcagttctcagagccttgtggctttcaaaattgtgcataatggattctgaaattatatcatgttacaaaagacatacaaagctgtagctggtacaataagctctcagtaaatgttagtggttatcgttaccatggcttcagaaactgtatagtgcaagtttgtccttattactctcttccatttttcaaaaaaataatattctcaagtatattttcttctctgccttgtcca

SEQ ID NO: 215501 - DNA, 120 bp, Homo sapiens
ctacttctgctagtagcactaaatcacactggcagttttctcttttgactgtacttatctcatccatggaccttgtgtttattcttgtaccaatcagaacaattagacatattgtgttct

SEQ ID NO: 215502 - DNA, 422 bp, Homo sapiens
aggttgagaccagctgaggcaacacagtgagaccgcatctctacaaaaattttttaaaacttagccaggtgcagtgttgcatgcctgcaatgccagctacttgggaggctgatgagagaggatcgcttgtgcccaggagctagaggctacagtgagccacgattacgccactgcactccagcctgggtgacagagtgagaccctgtgtctaaaaaataacaaaatacaagtgtgtgactgtgggtgcacataacgtgtgcacgtgtgtgcgcatgcctctgtgaatgagtgcttggggtgtgtgtgttgagtgtgtggccttgtgtgtgcatatcagacggagtggctgacattgctgcagcatctgccagaagggcctggctccgggggtggaaggcagcacccagttccttctttctgtg

SEQ ID NO: 215503 - DNA, 452 bp, Homo sapiens
tcagtatttctcagagatgtctgcactcccgtgttcacagtagccaagatacagaatcaacctaagcttccactgatgtgcacggatcaagaaaatgtggtaaatatacaccgtggagtattatccaagcttggaaaagggagaaatcctgttgtttgtgaacccggaggacatcatggtaagtgaaataaaccagataccgaaagacaaataccacatagtctcactgatgcctggcatctgaacaagttgaactcactgaagcagagtggaatggtggttacaaggagctggcaggtgggtggggagagggaattggggagtttttaatcaaaggctacgaaggttcagttctgcaggctgaataagttctggaggtctaatgtagagccccaggcaggtgactgtagttaaccagtaccatgtgataggcttgaaattggctgagaggg

SEQ ID NO: 215504 - DNA, 126 bp, Homo sapiens
ccttattttatttataacaaattagaaattcacacatataaggtcaattttccaagttcaaaatatgagtaagaaactgagaaataatttagattgaaatctacctggctccaaatcaccacacca

SEQ ID NO: 215505 - DNA, 442 bp, Homo sapiens
tgcttttcatactcctgatgagacatgatgctcatttctcaacaaagatttattgaatgtctgctatgtttaatgcaccatggtggagcctggggaagatgcctacgccatacctgctgtccttaatgaactcacaggccagcttcgggcagacattccagcaagcattggagtccaggctaatagtaaccagagagaggtacaaactgggtgaaagaaaggaacccttcctggaggagtcagcatttgagcagttcctgaaggtgctggtgggtagagggcattccaggcaggtgggtctcttcacagagtggactgcagtttgggttgcctgacaaagatgagaagggttaggtttttccttcctccctcctgcatgaaataatgggaaagaagccgtgatagaaagatttagtttggagtaggataaaggtgctaagaa

SEQ ID NO: 215506 - DNA, 843 bp, Homo sapiens
taaattttgtatttttagtagagggagtttcaccatattggtcaggctggtctcaaacttctgacctcaggtgatccgtctgctttggcctctcaaagtgttgggattacaggcatgagccaccatgctcgactacagttactttattatttaatttattccttaatacaacacctgtatgaggaaactgttataatattcattgtttggggaaactgagcacagaaagctcagtattttccctaaagcaaacaagtcatatgtggcagaaatgggttcataactatgatggtgtcacagcacctgcttttagtaactacaagactcaatttatttaaaatgttgagttcactgacataaaggaagtttcagtatcgtttgtcataaactgtaggagctcctgtgaatcaaataaaatgagaggtaatagttttgtatttagggtagttcatagcctagaataaaataatcatttcaagagacataagagaacctataatgtataagtgttttgttctgatctcaataatatcacaaaatattcaacgaagactctgaacaggtaaaggtataaataaacctcgccatcttagtaggcggacttagtattacagtcagaattgtagtgaagctctaaggtttcaggtcttcactagggtagcatgctcacagggcagggcagtggggtgtgcagaacacttgctggagcgtgtttgatttcggaaatctgtgatgtttgtctggggagggtattcctcacactttaactgaacacgtgtggaggggtgagtggcaggaatggtgaagggagggccagtctggaaagctaactaggaggatgcc

SEQ ID NO: 215507 - DNA, 417 bp, Homo sapiens
taaagggagtctcactctgtcattttagctggagtgcagtggcatgaccttggctcacagcagcctcaacgtcccaggctcaagcaatcctcccacctcagcctcccaaatagctaggactacaggcttgtgtcactatgcctggctaattattattattattatttttgtaaagatgaggtctcactgtgttgcccaggctggtctcgaactcctgagtgcatgtgatctgcccacctcggcctcccaaagtgctgggatagcaggtgtgagccactgtgcctggccagaatttttttttttgtttataaaagtgaaaaacaaggatttattttatgacattttgtagttgtaaagagccttattgttccttgagtccagccctctgctgtgggccaaaggacaggagtcacctct

SEQ ID NO: 215508 - DNA, 171 bp, Homo sapiens
ttttttttttttgaaggagtgacagtacaattttgtgacatagctatattgaatagtggtgaagtctgagcctttattgtaaccatcacccaaatagtgtacgttttacccattaatttctcatcatccactcccctcccatcgtcccgccgcccttctgtcgtcttctcg

SEQ ID NO: 215509 - DNA, 434 bp, Homo sapiens
atagtgtcttgtactcctgagctcctagtatactctgatgtctagccaactttaagtaaatggagtgagcgacatgtaaatgtctttatggtttgacattttattaatcttgagcattggaaaagtggctggtatgactaaagaactgaatttttattttttatctaatttgaattgcaactgtggacagtatagctgtagccccggacttgttctgtggattacagaatacgtggacattgatggttttctctttttactgagcagtaaggaaataaaagctgaagctctctggcccattacatttcatttaactgcttgttttgttttatttattatatatttagctgaaagctaagtccaacaaaccatttttaaagatgtgcctgccttggacaacagtgaaagcaagcgttaatgagtttggatttcaa

SEQ ID NO: 215510 - DNA, 444 bp, Homo sapiens
cctcagtgttaggacctgagggctcatgccgattgtatgaagcaagaagagaggcaggaggagggaaaactggcgtctctctcactttctctatatcgtcttgacagtacggttgcttttcttggtgtgattctgtcttctaaaatattagaaccaggctgggcgccaccgtctgtaatcccagcactttgggaggccgaggcgggcagatcacctgaggtcaagagttcgagaccagctgggcaacacggtgaaaccccgtctctaccaaaaatacaaaatttagctgggtgtagtggcgggtgcctgtaatcctagctactcaggaggctgaggcaggagagtcacttgaacccggaaggcggaggttgcagtgagccgagatcgtgccactgcactccagcctgggtgacaaagtgagactctgtctcaaaaaaaaagaaa

SEQ ID NO: 215511 - DNA, 282 bp, Homo sapiens
attaaagttactgcaggtatggtagtttaggacctgtgggttcgttagccaatttgcgtgtgaacgcacttgtaagagagaaggtactgaagccacataacatgggaagaaccaaaaggaagaggaacatttagcttgggtgagagtgggcttggggagaaggtagacacaggctgcttgtcagtaacagcttaggacttctgtatggaagaaggagcaaatattccgtttaggcacagccagagggacctacggggaggaagattttcacctcacttaagg

SEQ ID NO: 215512 - DNA, 849 bp, Homo sapiens
tgtcagggtagtctggggagtctgggacaagtgagagccatatagctgtgcctggctttaagagatgatgtattttcgagagtgctcttccaacagtcacagttgggcagagggtgctccatgtggccattgttttctgcttcatttggccaacaggtatttacagagtgtgtgttctgtgtcaagcacgatgctgcgttttggagaacacagagaaggcccccatgcccaggagtgtgtgattccaagctctgcagtgagcgtggcctccaaaacatacattccacatttcctggagcctctgcattcccctgggctgtgtgtcacacaagcttgtgccctgtcaacatgcatttaaatgtactaggagagcctgctgacaaagatcatccttttatgacataattacttgccctacctcctgcaattttacctatttagaaggttttgcatttcacatttcataaagtgttactaatcgaaatgtcactaatttaaaattgagaacactgttacaaagatttaactaaagtttatctttgtactctatggtggaggtaaatacagaggctactacttttcaagaatattagaagcataatttagctaaaataaaacacgttcaccatgtggtcattcttagcactaaagaaagaccttacggtatctgtgctggccttgtctaaggctccatatgtattttaaaggatatttttaaggttattcctcaatctcccgctggcctgccactagtctgaattggtgagcttttccccaatcaggttcttaaggccaggcacacctgtataggcaagttctagagggattacccctcaaaataatgttgcc

SEQ ID NO: 215513 - DNA, 197 bp, Homo sapiens
acctgcatccaatgtgtctgccaatcctacagcccccatcgccttttccttcaaaacagacctagaagccagttatcactgaccacctgcacttgccagctaggtccagccccttcctgacttctggggatcagtgcagttgtcccctccctggtctccctgcaggttctgttctccccactgcaaccagaaacacc

SEQ ID NO: 215514 - DNA, 852 bp, Homo sapiens
taagatgaagtcactctctgttgcacaggctggagtgcagtagcacgatcttggctcactgcatcttttgcctcctgggttcaagcgattctcagcctcctgagtagctaggactataggcgcgcgccaccacgcctggctaatttttgtatttttttacagagggggtttcactatgttggccaggctggtctcgaactcctgacctgaagtgatccacccaccttggcctcccaaagcgctgggactacaggcatgagtcaccacgcctggccaaaaaaaagattaatcttaaacataaccagaagtctagatgtttgacaggtttatttatttattgagacaaggtctagctctgttgcccaggctggagtgcagtggcgtgatctcttgggtcactgcaacctccacctgtgggttcaagacaccctcccatctcagcctcctgagtagctgggactacctgcctggctaagttttgtatttttagtagagaccaggtttcaccatgttgcccaggctggtcttgaactcctggcctcaagtgatccagcacctggcctcctaaagttctgggattacaggcgttggccaccatgcctggtcagtttggcaggtttaagggttgacttatgcctgtgactgtggctatctttctttatattctcatggcttaccccaggctggccacttgtaatatatggtcatcttaaccaaattagaaaaaggtattccagttgatgtggtggctcacgcctgtagtcccagcactttgggagaccaaggtgggtaggtctcttgagcccaggagtttgagatcagcctgggcaacataacaagacctcgtctcta

SEQ ID NO: 215515 - DNA, 383 bp, Homo sapiens
gcaacataaaaatgatttagttttgccaatgacaatcatcatcaccctcatcacgtagccgtggttgaactgtgccagatttaggaccatagccacagctttttatgaataactattctataggattatcttgcttgagaaattctcaggagtagggaaagacagcaaaattttcatgagctatcctgtcaaccttctgaaaagaagttctgctctctttttagctgtactctccttttttgttgttgagatggagtcttgctctgtcgcccaggctggagtgcagtggcacggtattggctctcaagaggtcatggctgcagtcagctatgaccatgtcatttcactctagcctgggagacagactgagaaccggtctcaaa

SEQ ID NO: 215516 - DNA, 343 bp, Homo sapiens
gagccacaaaattggaaacaatacaattttttttaaaatgtgtaggatctggccgggtgtgtggtggctcacgcttgtaatcccagcactttgggaggccaaggcaggcggatcacgaggtcaggagattgagaccatcctggctaacatggtgaaaccccgtctctactaaaaatacaaaaaaaaaaaattggccgggcgtggtggtgggcgcctgtagtcccagctactctggaggctgaggcaggagaatggcgtgaacctgggaggcggagcttgcagtgagccgagattgtgccactgcactccagcctgggtgacagagcgagactccgtctcaatt

SEQ ID NO: 215517 - DNA, 1231 bp, Homo sapiens
agagagagagagagagagagctattaataaaacagaggagtacattttacccttgcaattccagtcaatactgtggtgtcatttcagccaacataccaacattcagtcaaatcccaaagccaaatggataatttcagatggaatggagttagacaggaactggcttccctttctcctgttactatgaggacaacccacacctgctcagtggcctaaaatattttaaatatgttcatgacaattatgctgagaatgccaggataacactgatggaacccatgacttcaccaggattgtggtctacatttacaggcctagtactagaactagaccggcttagagagtgggagatatccctctgttgtccatcgaaagataaaaatacaggctttcagccgggtgcagtggtgcatgcctttggtcccagctactcagggggctgagatggggaatcctttgagcccagaagtttgaaaccagcctgggcaacatagtgagagacctccatcttaagggaataaataaataggcaataatgaacaccaagggaagcaaaacactgaaaagaattttaaaatttgttgtagaacattaatacgaaatttgaaactgcaaaacaatgtaaaatttaatgtcatgttgtcatttacttttgtgtatattgtgccatgtttattttcaaagtcctatctagaaattctaaaatgtctaattttcttaattaaaaatccagaattctgtagtttctgaaattcaaaataaatactttaacataccaataaaaacaattttcactaaaaacaaaaccttgtggcctcgttttgccactcgacttttaactctggcaagcttttccatgggccccaatttgggttaactgggcaaattgcctttaaggggcggattacaattatgggccggtttaaaacgtctgccgggaaaaccttggtttcccatttatcctttgggcaaatcccttttccactgggctaaatcaaggagcctcccatcgcttttacaattgtactcttatgctacggaatttggcgctattttgaaatccggttttttaacccttttttactagcgctcgtcgtaacctctttaacacaatacccctatcttgatgttctcttaacagcccttataagcgcctctctttgggcctttctgggtgctctcttccatcctcttttctagtgtgttcccttacttacttctctctcggccg

SEQ ID NO: 215518 - DNA, 324 bp, Homo sapiens
atgtgtatactatgcagtggtattctatgggaaagaggtggttcactggtcatctacaaggggatctttgagatgagaacagagaaataaatgcacattatgccagctcatgcaaaacacagaatgcatcgccactttcacaccaacaggtataaacattaccttttctgaacatatggaaaatattttaatctaaagactgaggacaagctagctcagcaagtcagaggatgacagcatgattgaatttctctggacagggctgtttgaaaacatttggcaaacattaggtcgatttgacaaaaatgacactttcacagtgta

SEQ ID NO: 215519 - DNA, 402 bp, Homo sapiens
cgagatgtttgtgtacatgcacatcaaggcacagcacctttcctcaaacttatttatgacacagagacctttgctcatatgttttcctgctgaccctctccccactattaccgtattgtcctgccacatccccctctccgagatggtagagatagtgatcaataaatactgagggaactcagagaccagtgccagtgcgggtcctctgtatgctgagcgccagtcccctgggcccactgttctttctctatactttgtctctgtgtcttatttcttttctcagtctcttgtcccacctgaggagaaatacccacaggtgtggaggggctagcccccttcagaactcaggtgtttgaaaccagcctgggcaacaaacatggcgataccctcatctctattaaa

SEQ ID NO: 215520 - DNA, 454 bp, Homo sapiens
agccttggctccacaggggttcacatttgcagaggggttggggaataggagattgtgattttgatatggaggaaaagtaatgttccctgtttatcccagcatttgttacgaatctgggagctcatgaaaggcaaatcgtggttttgcatggaaagcaggtacacaggacaataaaggaggatggcgaagggcatgcagggagagtagacacctggacatgaggaagaggaaacgcaggcattcttacctataccaggaatttcagggactatggggattgtgacaacaaaaataaacagaggatagaagagaacctatttgtccacccctaggggatgaaccagttatttaaaagaaaaaacccagccattaaagtcacatcatacattaaatgacagccaacatatacacgccaggtatttcaccgagcaattcccatggattaattcactta

SEQ ID NO: 215521 - DNA, 394 bp, Homo sapiens
tccacccgcctctgcctcccaaagctacatttattaacactaagttgagtttacatgacagtgatgcatattgaggtgctttacaggaagcggttagaaagttcttgcctaggcctggtgcagtagctcacgcttgtaatcccagcactttgagaggccgaggtgggcgggtcacctgagttcaagagttcaagaccagcctggccaacatcgtgaaaccctgtctctacaaaaatacaaaaattagccgggcatgatggcaggtgcctgtaaccccagctaacttgggaggctgaggcaggagaatcgcttgaaccctggaggcggaggttgcagtgagccgagatcacaccattgcactccagcctaggcgacagagtgaaactccgtatca

SEQ ID NO: 215522 - DNA, 356 bp, Homo sapiens
cgtccttcatcatactaccccttcatcatacctaccccacaacacgcacacactcacaacacgctcacacacgctctcacattcacactcacaaacggtcactaacacactcacacatgcccacattcacacacatgctcacactcacacacgctcacattcacacacactcacgctctcacattcacattcacacatgctcacacactcgcacacacattcacacatgctcttattcacacacattcactcacattcacacattcacactcgctcacacacgctcacattaactcacattcacacacacgctcaggtaggtatgatgaaggacggggatcctctcgattccggtc

SEQ ID NO: 215523 - DNA, 461 bp, Homo sapiens
catgctcacacactcgcacacacattcacacatgctcttattcacacacattcactcacattcacacattcacactcgctcacacacgctcacattaactcacattcacacacacgctcacactcattttcacactcatgttctcacattcacacatgctcatgttctcacattcaaacacacatattcacacacttgctctcacacgctctcacacactatcacaggctcacacatgctagcacacgctgtcatacatgctcacattcacacacaagctcacacactatcacacacgcactatcacacacacccacatacacactttcactcataacacgttcacaacgctctcacaacactttcaaatttgtgctcatgtacactcacaagctcacatgctctcacaacacacactccatacactatcacacacttgtcctctcataggtgcactcacg

SEQ ID NO: 215524 - DNA, 665 bp, Homo sapiens
agggatgacaccaaggtaatcatgagggatccacccccgtgacccagccacctcccattaggccccaccttcaacactgaggatcatatttcgacatgagattcggaggggccacacatacaaatcatatcccttgtctatacaccacaattttattgcataaacaggacacattcttctgctgatcaggtattctaggaaaccaacgtgttaatcagacaattgcttgcattgttgaaaactgactagaacgaatggaatgatattacattatacatccatggagttacagaatcttatgcaattttttctattagggatatttgtgtctaaaatagagaactggttatttagaagcaaagttctcctcccataaatggacctggggtcccactgacaatagtattgggtttttagaggtgcaaattagttgtagtcctgccttccacactgaacatggaaataattgagagacacatgaatcagacggatattactgatggggcgcattgctgagcagccttaatcaatcttcagccttgaattaaacagaccgtctgagttccagtctcctgccagcctccatctcatggcagagactgcccagtaaactttgttgttactggagagggaagcaggcaggctgacatcagagagaaagccca

SEQ ID NO: 215525 - DNA, 466 bp, Homo sapiens
gcctgattgtgagggtgctggggagccaaggagggctctgggaagtaggcatcctgcttagactcgcatcgggaagagcaggccgtggcttcagggatgcaggactggagatgctgctgactaggggtcagggtgtccgtctctgagggcctgatggggggctggactgacagcaaagttcacccaccctgtggcagggcccgtggctccctgtctctgattctggaggtgagccaggcctcttacctgccgctgcaaaggacaaggcccagggaggcagtcagcttggggcgtgatggagtgaagttggaacgtgccctggggtgggggaggcgttgcccagcctggctggcagattcctctcagcccgggccaagggccgggcctgtctccttcacaagccggcggaaaccggggctggaaaccccagacccgccacttccctcagaggcgcagccgcggccgc

SEQ ID NO: 215526 - DNA, 124 bp, Homo sapiens
taccaactattgtcacatacatataacgcatatagacatatggacacacagaagatacttcttacctggagttatatactagcaatattttctgctttcactcttgcccttctgtcgtcttctc

SEQ ID NO: 215527 - DNA, 333 bp, Homo sapiens
gctttatgtttattgtggaccttgaggttgaatctacagtctaatcctatcatggtaactcacccatttccttgcctatgatggattctggcacctcggcttaagccaatcagagcattgcattcacctaaggactccttggattatggctgggcatgagacctaaactgggcattcagactgagaggaatattttcccccattttgggggaagggtttagctgtgggcaactgattaatgcaaggatctagaaccttgatgtcattgagtcacgtattcagtcaaccaagctgaaaccactttacagcaaatatcttctcttcagtcctcat

SEQ ID NO: 215528 - DNA, 376 bp, Homo sapiens
tccttatgagtgagtgaatgaatgaatgaatgaatatatctataatattcaagtcctcatacttgatagatgatcaaagtatatataactttaatttaaaatataaaaaagtaatttaaaatatacattttcttggtgacagagtgttctgaaatatagaatgtttcctttcaagatatgtcaatatcccaaactggtacgtttactgtttcattagtaaaacatatacacatagaaacataaaattaggctgctgaaagagtcagaaacataaaaaaggaaaagttagaaaggtaaaaaagctctcaccattttttttcttaaacaagaaattaactgcaactaaaatacattaaaattttgaataacaagctca

SEQ ID NO: 215529 - DNA, 424 bp, Homo sapiens
acatcctgcagtacacagggcagcgcccctgcagcccccacccccacctgtccaaagagtgacctggctccgagtggcactagtgtcgaagttgacaaatgctgcaggaaaccaacgtgtatttagtgtttaatctgcatcatggactgtgttagcttcgatggagatggattaagaattaagtgaagctggccgggtgcaggtggctcacacttgtaatcccagcactttgggaggctgaggtgggcagatcacttgaggtcaggagttcaagaccagcctggccaacatggtgaaacccccatctctacaaaaaatacagaagttagctgggcatggtggcaggtgcctgtagtcccagctactcaggaggctgagacaggagaatcacttgaacctgggaggcagaggttgcaatgagctg

SEQ ID NO: 215530 - DNA, 232 bp, Homo sapiens
gggaggttagaattgcaggcagaggagaccctggagcaataatccctggaaataacaggaatttcggggacaaatccagatcctcaaaaactgtgaaactgagagagtctgagcagagttctccaatgaaccaggtatcatctgtgtgccagggtgagaggacggaaaacgggccaggtctgtctctgacaggttgagaaggtggagtgggaaggagggatccggaaggcca

SEQ ID NO: 215531 - DNA, 393 bp, Homo sapiens
cggggaccatgtgtcccaggcgcctgagtccacagcctgcagggagggctgctcacagctatgagctctggcaccccgttgcctggcagtgggttaagagcgccccctggtgtctgtggccacagccacaggcacaaattccagggaggagactgcccggcggcagacgggccgcagcatcctcacccacacctgccattgggtcacctctggccggaccagaggaggcctgaccctccagggatggccagcaagagctggccagaacctcgcaggttccagggaaaagcaaacagactctcggcaaaggccccctaagggtgaccttagttcacacccaggggacacagtggacgacgtgggtcactgctcgggaacacacagtaggtagca

SEQ ID NO: 215532 - DNA, 345 bp, Homo sapiens
aaaaatggtgataagtcagtctttccataaaggaaaatatggaagcaagtgaacactgttaatgaaattcaccttctctgtgcattatgcaagaaaaatataagcagaattctcaccctacagttgggcatgttctttataacaaccagctgactgactgaacgaaaagaaaaccttgggaacaaggaaaaattatcaatgaaaataaagaagttccagaaaggagtgcgggggtggaaacagacagacacctgacatgaaataaatcacctgatatacactgccaaggtctaatttgtttttccacctgtttttcctcatgccatgtgtttttcattaagataa

SEQ ID NO: 215533 - DNA, 508 bp, Homo sapiens
aaaggcacccactttagattcagtgatataagaaacccaccccacaaaccacacaggtctccagcaggtacccttctctggagtctcctccttcagttgttcagaaaacaatgccacagcaccatctactgaagtagcgtttcctcaaatgtcaagttgtacaacccgatcttggaagttttcagacaagcttttactggttgaaatctagggtattttgcgcttggaatcttccttcatttgacaaatcctggtgaaagtgtgctgaaatctaggccattctcagtttgctgagctggtcaaggccccatttcttgggtctggtcttcaaccctgtgcaacccaaggagctggggcacctgcacagctcccccgtccctccttcgttcaccccctggtggtgtcccgaggactgctgcgctgcaatccttcttcctcctactacctggaccaccctatgtctcagatgaagaactctgtcccattcattttctaatccagtgttgag

SEQ ID NO: 215534 - DNA, 488 bp, Homo sapiens
aatctctaaatcctaattctgattgcttttcttcctcagctaaattgttttctttctattatggctttcctaattcatactgtaatcaccgcctttgttgttatcttcaaaaaatgaagttttggtcaagaccgattagactatcaagccctaattcatttgataacatactaaattggggactcccaatatcacatttgttcttgaatctaagcccttgggatgccatccaattggaattgtgaactaagtgattttgcttataactctgaaagcagattattatacatcagcaaatcaacatgatcttgggcctggtgaactttaaattgtatgttatcagtttccaataaggtaaaagctgacattatttcttataatcacaaacgatttctaaagtaaaattatggcaaatgaatgttgaactaaatatttcaatatacaagtcaaagaaatatgcaaaataaaagagcaatatgcagaaattg

SEQ ID NO: 215535 - DNA, 454 bp, Homo sapiens
agggcacatggatgcgtggtcaggggcagatggagccttctgtgagtgaacttcagagggaggtgcgtttgttgccctcaggaccagggctcgtcacgtttctgtagcagagaaatgttctcccgcaaataaaaccttacacaggggcccaaatgaggtggtggtgaagcagtgtgttcccaggcccctgcacgctgcagagcagacaatgtgtgtgctgacagacactcagcctggagtcagggactgcatgtgaagcaacagccccacagagtccctagcctgtcatcgccatgccttgttttctattgaacaatatttgggaaattcgattcccaaaactaagtcgttataaacagttgcacctttttaaatgacttgccttgaaatttcagggcactcttcaggtaactgatgcaggaatctaagagggaagcagcctcaccactcagga

SEQ ID NO: 215536 - DNA, 97 bp, Homo sapiens
agtagacttagtggttacgaggttgggcagagaaagaggtcagaaacagcaacacggaggtttctaggagttaaccaacagtgaacattgaattcag

SEQ ID NO: 215537 - DNA, 287 bp, Homo sapiens
ttcacattattagttgaagaaattagtccagtttacttttttccctcaaatgtgttttctgagatgtataaacacatgttttggttcaataatatatacagtgttttaattgaatataaaatgttattaataaatgtctacatatgcagaattatccctatctttcatatatctgtctcagttaaatgtaacttagctaaagatctctgtatcagtggtcagtaaaaagaaaatattttgtgaggatttttttttaatgcacaaaatagttattttttttctttaaa

SEQ ID NO: 215538 - DNA, 483 bp, Homo sapiens
attgacagcccttccatgtggagagggagagttcccaaaataaaatgataagcaaagaggctcatagcacaacacatgccttgtgctttgctacctctggatctttgccacgtacctttccttccttcttcctaattgatgaaagcctgctcatcccccaaggctgtaacaaacactacttccattgatttaccctcccttctcaattagatggacttcttcttttgaattttgagtcccaataactttagtataggaactcatctaataatactttctgaaatagttttttttgttttgtttttgttttgacatggagtcgcgctctgttgcccaggctggagtgtggtgtgccatcttggctcgctgcaacctctgcctcccagcttcaagcaattctcctacctcagtctcccgagtagctgggactacaggcttacaccaccacgcccattaaattttcttttttttttgtatttttag

SEQ ID NO: 215539 - DNA, 429 bp, Homo sapiens
tggatgtgggtggaatggggccctgattaaaaatacaatgtgttgttggcaacacagtaagcagatactccaaatatgcataatctggacttaattacagaattggataaagcagtagcttcattttgcagagtagtggtcatattagggaggccgaagcccaattttgttggttatctaaaccagggaagaggagatttcaaataatttcagaacggtctcttgctgcctctcaaaattcatcaagaccattcctttttgttggggtcctcaaaagagaatttttaaattttttattattaaaaatttcgaatatgttgttacaaaagtagagggagcaatgtaaaaacttcatgtactcttatgtagcttcaacatttaatagtccatagccaaccttgactaatttacatctttaatttctcccca

SEQ ID NO: 215540 - DNA, 421 bp, Homo sapiens
cgggcaggtagggaatggctgggggtgccgggaagtccgctgaagccgcgtccactcctccctcgcgcagagagaccaccctgggcgcgcccgctccgttctcccgtgctctcctggctcggaccagacccaggttcccaagccgccgccagggcaggagttgggaagcctgtcgcagccccactcgcggacgccccccaccccgctcgcctcgctccccacgcgggccaatcccgacggcccggccccaacccaggtgactacaggggtcccagccctcgccgggctgcccggaccccggggctgggagctggggagggcgccgctgtttatctggtgcggactccggagggggcgggggcggcccagaaggcgccagcccaactccgcagggccgcacaaaggccgctgtgtcccacgg

SEQ ID NO: 215541 - DNA, 440 bp, Homo sapiens
atttccaggccctaggacatttcctaagacatggaaactattccataagtgttaattgaattaatgagcaaatgttaaaatttgacaattacatccaaccaggcattcaaattaaaacaagccaataaaaatactccaagggtcccaatcacctaatttggcctagttgtgataatgaaggcaaaactaagacttgaagaacctgatgaacaattcatagtaaagattttaaaacttctactagaaatgctaagcagtgtgatatattaagttaatctttaaaaatagtggtttcagggtaaatgttgcttaaaattaactcccctaatgaataaaaggcagaaatatagaaatgtcccttttttaatattcccattattaaaaaaaggaaagtcaaagcattttttgtactatttgcctcgtgatccaacaggtctacc

SEQ ID NO: 215542 - DNA, 507 bp, Homo sapiens
agaaaatttaaattttatgtagagcctgaagacatgactgaattgctgcaatctaatggtaaaactttaatggatgaagggctgcttcttatggataagcaaagaaagtagtttcttgagatggaatctactcctagtgaggtgctgtgaacattgttacaataacaaaggatttagactattccacaaacttcactgataaagcaatggtacggtttgagaggattgactctgattttgaaaaaaagttatgacactataaaatagtattgcatgctacagagaaacatttcataaaagggtcaattggtggggcaatctccattgggttgtttatcaacatctttgtgatcacaaagagagagcctggtgtttctctcaattatatctgacaaatattgcaggtgtgttttgtaatcaagtttctgaaatttcatgtaatatcttcaaagtctattttgggtcaattcacaacaagaaataaatgtcaaagccaacattgcacta

SEQ ID NO: 215543 - DNA, 409 bp, Homo sapiens
tcaggaacatgtgcactttgctaatacaacacatggctttgaaattaaaatgcaacatgatcgagtgcttcgggatattttaacaactagacgagagattacagctagataaaactgggctttcaggtcacttttgctcattcatgtttcttcccgtttctttggactagacaaatttaatttcattgtatttcttaagaatttgctagaaaaacaaaagtttggtaagttatttcatggctgattgatctcagggaaatggggatgttgtaaggtttctctgcgacatgtgtcacctattagatagttagctttttctatttccaactgagccaaaccaaattaattagaaagtggtttgaattacaagctaaatacaataaaaagtaataaaaacagaaaatgaaat

SEQ ID NO: 215544 - DNA, 328 bp, Homo sapiens
gagttttaaacagaagggtaaaatgatcagctctttggggaatctggaatcctttaccctagtcccagatccccagcctctatgttttgtgatagtgccatagctgaggcagacctacagcagtgtagccagtagtttctctaggccttgtaagcccacggttctcaaaatgtggccccagaccaccagcatcagtatcacctggcacaggccagctacttgggagactggggtgggagaactgcttgagcctgggaggtcaaggttgcagtgagccatgatcatgccactgcactccagcctgagtgacagagtgagaccctatctc

SEQ ID NO: 215545 - DNA, 260 bp, Homo sapiens
accacgcccagctaatttttgtgtttttagtagagacaagatttcaccatgttggccaggctggtctcaaactcctgacctcaggcgatccaccgctttggcctcccatagtgctgggattacaggcgtgagccaccacgcccagcctgatacagttttaagcaggaatttggcagaaatttcgtaacgaagacaaattggaggttctctttaactcgagattattaaatttatagtaacttcttgggccattaaaatgt

SEQ ID NO: 215546 - DNA, 559 bp, Homo sapiens
tgataaaattgctgtaagtacttacgtgcaggattttgaatgaacttaagttttccaaagtgactacacttttgatttccactagctatggagagttctggttgttcctgatctttgacagcatttggtgtgttcaccgttttgtgttttagccattctgataggtttatggtgatatctcgttgttttaatgtgcaattccctcacaaatgattttgagcatctttctcatatgcttatttgccatctgtatatcttattaatgaggtgttcagatctttcaccttttttttttttgctttgtgttgtttagttctcagaattcttcatatattttggacagcagtttttccatcagattattttgtaagtattttctcccagtctgtgacttgctttttccattctcttaacagtgtctttcacagaacagaagtttttaattttaatgaggctcaacttaattttttttcattagtagattgtgcttttggttttgtatttaagaagccatcattgaacccaggatccccgagattttctcctatgttatctccta

SEQ ID NO: 215547 - DNA, 554 bp, Homo sapiens
tcagttttcatactggaaatatagactgcattttcagccagggtctctattgtcttgtggtaagaactcttttttaaaaaactttatggaaaatttgtatcttggctatgtttttattgatttttgaaccttccaaattgctgctgccgctttagtagtacatacacagctgattaaagtactcctaggaccctgttcattgtagaatttattgatgatgccatatacccttggtaagatataaatgttggaagacttttcacaatatttcttctgtagcttatctaatttcatgctgtttgataaaattgttttcttaattctcttcacgtctgactcatttccatgactagtggttggtttttcttttttgtgttttacacagataaacatagtttatataactaatttcacatttgcaatattgtcaagtatagaataccaaagcttagttgaaatgcatcaagttcctgattgcttgacttacttgctaattgatttcttttccacataccagcatcacattgcataggattcagatttgtatcctcaaa

SEQ ID NO: 215548 - DNA, 339 bp, Homo sapiens
gaattccagttttccctttcagttttggcctggtaagtccttaatatcttgtcaatttttcagtgcttttaagaatatgtttttaaaatcttttatctcagtgcttttcaaactttaatgtgcaactgaagtcacctggtcatcttgtgaaaatgcagcttctaattctgtaggcttgagatgggacccaatattctgcacatctaacaacctcttagagagtgtggacgctgcagatgcacaagccacagtttgatcagcagggttttatttcatatttttagttatttttagtgagtaagttggctcaaaggacctggaagaccattgttactcgac

SEQ ID NO: 215549 - DNA, 435 bp, Homo sapiens
agtcccattttacagctggaaaactgaggtataagaaggagctgaccagcagtggggctgggactcgaacccagagtcggctgacttctgcctgagcacctggcgctacttggtgaccagcgtgtctccagcctgagggtcccatcaaaagcaagtgaactttctcgatcttgcttgtctgtgtcccaaaaacgttcttccttctgtagggcctttgcatatgatgttctttgaaccatctccccaatccccacagcccgtttcctccaaggtctcctttagatcttagatcagggtcatctcctcaggaagcctccctggaatgcaccatagccccaaagatggcgaggatcatttgattaatgtgagtgatcctccccccaaactgtaagttccatgagggcagggagtgggtgtgcttttctgttcagcatt

SEQ ID NO: 215550 - DNA, 510 bp, Homo sapiens
tctttaactcatgggttatttagaagtgtattttatttccaaatattcagaggattttccatatatatttctgctaatgatttctagtttaattgcatctttaatatctccgtcatcccagagtttgttctgctgattgctttgtttcttgacagtggattttctttttcattttatgtgcctcataacttttgattgaatgttggacatcatgagttgaacagtagaatacttacgcctgaaaagggcacacctgttctttttcaaggctgttagtataggggagttgagtcagtttaatctggagttgagctgggcttatattttcttgttgctctgcttacctcagtgtaccacaaggcttcaggtttctttggatttctttactatttcctgtgtttctggttgaggttgtaatgccagagtgcttttcgtcatttgtactcccctgttaaatttcacctttctctgtatgcttgtgctactgaagaagccccattgcactgtctt

SEQ ID NO: 215551 - DNA, 392 bp, Homo sapiens
ggtggccgttatgctagtgaaaaaaagccaatctcaaaaggctatatactatatgattgcatttatataacattctcaaaatgacaaaattatagacagaatgtaaagtggttgccaaggactagggatggtgggggaagggtgtgggtgtgactccgaaggggtagcaggagggagatccttgtagtgatggcacaatcctgtcatcttaattgtggtggtggttacaaatatctataccataacatacgttgtgccaatgtcagtttcctggttttgctattgtactataattatgtgagaaacggagtgaagagtacaccgaaatatcactgtactagctctgtaacttactgtaaaacaaaaattatttcaaaataaagttaaaatga

SEQ ID NO: 215552 - DNA, 390 bp, Homo sapiens
ggctttcagagaatctgctcagaaggggctcgtgccacctccgctcacatttcgtaggcccaaatggacttggtcaatgtgggaagaattataatcttcctgtgcagaggggctgacaacaaatgttggacagtaaaacaaacagccacttgtgctttgcgaaagccctgtgttctcacgactttccatttgccttcccctgcccagaatgcccccttctcttattcatctggagaccttcttctccttcatgtgccacctctccagggatgcttcttctttttttcattttatttttagagacaggatctcactcggtcacccaggctggagtgcagtggcataatcttaactcattgcagcctccaactcctgggctcaagcaatcct

SEQ ID NO: 215553 - DNA, 362 bp, Homo sapiens
gaactgccagactctgtgactagaggtttagggtctgtggtttgcagaatgatgctcccatccccggaaaggtgtccatgtcctaatcgctgaaacctgcaaatgttacgttacatggcaaagggattttgcagaccttattgaattcaggatccctagtgaggaggtgggcctgcatgccccaggtgggcctagtgtactcacagtcatcagtgccagagtgaggggacctgagaagacaggtgcaagggggagcccaggaatggggtggctctaggacccggaagcggcagggaaacatttccccctagaacctccagaaggaatgtggccctgctggcaccttggttttagcccggtga

SEQ ID NO: 215554 - DNA, 311 bp, Homo sapiens
aaaatgtgtatgtgcgggagtgggggatggtgctcacagaaggcttctaggagaaaaagttatttgagatatttgggcatgagagggaggaataagagaaggtacaaaggagaaacgtagaaataaggagggataagaaatggggcaaagtactctcttaggtgactcttaggtgagggctaagttaaaaatatacatagagtattgttagctctcttagagatctatttatttaacatattatctttgtgatttttttaagttaatagtttcttctatttatttccatgatgtcaagatacttttctcct

SEQ ID NO: 215555 - DNA, 371 bp, Homo sapiens
ccaacagatttcaagtgtcctagttctaaaacaattttacgaaggagtctgtgacaggatttaccaaggagttgtagagcaaaatatatgtgaagaggctggtcagtattcagatggtcatcttcaagccatacaactttcctgcattagtcaatgttatctagagagggagagagatattaattttaaggaattggtttatgtgattgtggaagctggcaagcccaaaatctatagagcaggccataggccggggacccagaggagctgcagtttgagtgtgaaggcaatctgctggcagaattctcagaaaatctcatgggtttatggaggcatttatacaacattccattctcaaaatggatctcaac

SEQ ID NO: 215556 - DNA, 466 bp, Homo sapiens
cagtgatgcccagcagaacatctcttccttcttagtcagatgtcccttgggagtagttgtgcaaggttaattctttgcctggtagaagactgtggtgcattttggattatattttgtctgtgagatcttaggttggttcttcagatgttagccttctactggggcaatatttctttttctgtgtttatttgttgttattgacttctaatataattgcattgttgtcaaaagatgtggtctgcgtgattgtagttctttgatatttgttgagactttcattatggtctagttttagttaaattttataaatattcttcatatgcttgaggataatatgtattctgtaatttaaatatatattaaattagccttgataaccatcctggtcttctgtagctttattaagtaatttttttggtctgcctgaactaccaatacataaaagaaatgtattaatctcccacta

SEQ ID NO: 215557 - DNA, 405 bp, Homo sapiens
catgggggtgagaaagcttcccttagactatgtgcaagaacttgatagccttatgcaaagccatcttcagtgaaaggccacagctttgtcaccatgtcagtcacaggccagtgttgtggaagcaggctacaagtggcagccatctgagactggaagaaaagcccaggggcggagctctaccctaactccagtgtagggcttagagaggaaaaggacactgcccccaggtgcttgtggagcagcagggaaagtcagaggagtgatctgactttttttttcatcctattaacttttgggagaattaaccataaggctgtaaagtgaattaattgcttcagaaaagaacatgagcagtggtgccaaacactaattttactttttaaaaccatctctaaaaataagggt

SEQ ID NO: 215558 - DNA, 1190 bp, Homo sapiens
  misc_feature (957)..(957): n is a, c, g, or t
cgtggtggcgcatgcctgtaatcccagctactcgggaggttgggataggacaatcacttgaacccaggaggtggaggttgcagggagccgagatcgcaccactacactccatcctgggtgacaaagtgagactctgtttaaaaaaaaaaaaaaatactcttaacgagagtcaaaaactaaggagatagtctcaaatttgccaaaaattagctgtgtgttttaaagcaagtcaagcaagctacctggactaaatattcttcttcacaaatttttgcaattttagattgtatgaccactctaagttctcatccagctctaaaatactgtaattatgttctaatatcaaatcaaagtccaaatcatttaaggctatggtccaaggtttaaaacaaagtaatttttgaaaactctttctataagcttaatatggattaaactagatgctattatcatcctcattttacaatcatgtaacaggcacagagaggttaagctacttgtcccaggtcacacagccagtaacggtcagagatagggtacagacccagacactctagaaccagagtttgtgctctgaacacactaatctatactgattttaatcactatgaaatacagatatcctgtgctatcttattgagagggttaaaaccaaattcagggtcccaaaatttgtactgtatccagccacatatcaatacaccccagtttttcgtctttttgcttcatcttaaccctcagtatctcatgttgctatattaagaaagtaaaaatagttttaaaaatctgcttcctggccaggcacaatgctatacttgattcaagatttggaggctaatggccgttacagggcagagttcagacagctgccaacggtgaacccatttataaattccaaatatcaggcggggcccccctgtatcagtttcagaggttaggcgggaatccttgacccgngggggggttcaggcctgtaggccacgtgctcaactggggaaaaggggacctcgttaaaaaaaaaaccgcattggcaatcgcctaaaggggggtcaaaacaggcccggtttaaacgggctggaaaacctggtccaatatacttgtggaacaccttccggggggtaaggacccccaaggcttccacattggcccgtagccaggaattcgggattttccgcttttacaccttcttc

SEQ ID NO: 215559 - DNA, 277 bp, Homo sapiens
taattttatatctatcatataatgtgcatacatatacctataaatgcttatatataatctataatagactaactactaatgagtctatatttaaattttcggaaatgtgcaaactagacattttacactgaaataaactattctatattgcttttaaattgttttattaattttaactttttgaattatagaactttaatttttgcctttgactaattctctctctaatctttttactttctaaattaatgaatttaaaagcatattccactgcaga

SEQ ID NO: 215560 - DNA, 574 bp, Homo sapiens
cagggatccccaccacccactgtctcctgcacttcgtctctagatggctctgctggaggaaactggaacccacgagcccctcaccacgcctccagtcttcctgcttgcttctctggccaggcccatctgcagctgcccactcagatatctggcaggaaccccgtttctgccaccttcagtcctatctctaagctcttgcccaggctcttgcccaggtccactcctttgcttccttagctaaatgaggctccgtacccaacactggcctcctttcaacttaatcctacatgtattcagggagcccctgctatctgtgccagccaggaactggcgttcaaagctgaagggactgtggctcctgctctcaaagtagttaccttggaagtgagaggcagggggaaggcccgtgggtctccgctgcagggctagaaactctctctctttctctgtctctctcgttctcttgagagagggtcttgctctgtctcccagactacagtacagtggcacgatcatagcacgatcatagctcattgtaacctggaactcctggtctcaagggatcctcctgcct

SEQ ID NO: 215561 - DNA, 6499 bp, Homo sapiens
  misc_feature (2)..(2): n is a, c, g, or t
  misc_feature (4)..(5): n is a, c, g, or t
  misc_feature (10)..(11): n is a, c, g, or t
  misc_feature (2892)..(2892): n is a, c, g, or t
  misc_feature (5467)..(5468): n is a, c, g, or t
gngnntccanngccgggcagtgggcaggtatggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagtttccagaatacagatcacagagggctggagggatgattagctcgaaaatctagacctgtccaaggggcttctccctttccttgagctctctggacactgcagaggacccatgnccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtccactctcacagtcggccactggatttccctcactggctctcaggagtgtgaccagagtagactcggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccattttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaagctgacttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcatgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagcnntttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgttaaaaaaaaccacacaaaaaaaaag

SEQ ID NO: 215562 - DNA, 3338 bp, Homo sapiens
  misc_feature (2)..(2): n is a, c, g, or t
  misc_feature (4)..(5): n is a, c, g, or t
  misc_feature (10)..(11): n is a, c, g, or t
  misc_feature (3236)..(3236): n is a, c, g, or t
  misc_feature (3326)..(3326): n is a, c, g, or t
gngnntccanngccgggcagtgggcaggtatggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaaggtgagtccacgggaagccctcaaggtgaaagctggtaccagagggctccaggggggcaggtgtagagttgagaaaacaaagcaattcatgcttcttgtggtctggactgaacttccagaacaaaagccaagggcaaaacattcatgtttcttggtgcccgcttgactgtggagttttggcttcatgtgaaaggtgattcttagaatcctgagctgtggtggcttcagtcctgcccctgcacctgacctggggagggaccctgagcaagtccctcttgagtctgtttcctcatttgtacagaggctatgatgagcagtagtaccagccccatcaggttgttgtgaagagcaaggaagtgcattagtagaagccacctggcctgcgggaggctgtgtacacttggcccctcctcgtacttcttctgtgtggctgacagtctcagtttgccagtcttgcantcaggtcagaaagggatgagtgaagaagctggctgacatgctgtattccacgaggcattgagaaaactatggactgtgctgctgccttancagggaagggaa

SEQ ID NO: 215563 - DNA, 492 bp, Homo sapiens
cagccatctttttaaacaaaaattattttgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 215564 - DNA, 404 bp, Homo sapiens
actgattttaaaaactaataacttaaaactgccacacgcaaaaaagaaaaccaaagtggtccacaaaacattctcctttccttctgaaggttttacgatgcattgttatcattaaccagtcttttactactaaacttaaatggccaattgaaacaaacagttctgagaccgttcttccaccactgattaagagtggggtggcaggtattagggataatattcatttagccttctgagctttctgggcagacttggtgaccttgccagctccagcagccttcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 215565 - DNA, 4172 bp, Homo sapiens
  misc_feature (2)..(2): n is a, c, g, or t
  misc_feature (4)..(5): n is a, c, g, or t
  misc_feature (10)..(11): n is a, c, g, or t
  misc_feature (2892)..(2892): n is a, c, g, or t
gngnntccanngccgggcagtgggcaggtatggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagtttccagaatacagatcacagagggctggagggatgattagctcgaaaatctagacctgtccaaggggcttctccctttccttgagctctctggacactgcagaggacccatgnccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 215566 - DNA, 4411 bp, Homo sapiens
  misc_feature (2)..(2): n is a, c, g, or t
  misc_feature (4)..(5): n is a, c, g, or t
  misc_feature (10)..(11): n is a, c, g, or t
  misc_feature (2892)..(2892): n is a, c, g, or t
gngnntccanngccgggcagtgggcaggtatggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagtttccagaatacagatcacagagggctggagggatgattagctcgaaaatctagacctgtccaaggggcttctccctttccttgagctctctggacactgcagaggacccatgnccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtccactctcacagtcggccactggatttccctcactggctctcaggagtgtgaccagagtagactcggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccattttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctcttcaagctcggattttgacatgaataccacgtctgatggactcttctttcgtggatacatctggggctgcttccggctctttttcc

SEQ ID NO: 215567 - DNA, 2612 bp, Homo sapiens
  misc_feature (2)..(2): n is a, c, g, or t
  misc_feature (4)..(5): n is a, c, g, or t
  misc_feature (10)..(11): n is a, c, g, or t
gngnntccanngccgggcagtgggcaggtatggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccgctccaatgttggagcggccg

SEQ ID NO: 215568 - DNA, 295 bp, Homo sapiens
gtgctcacggctcctgctgccaccagtgtaaggtaagtggcccttttctccacgccttgggccctggcctgacagtgggaccacaggactgctctgctggggtggatggctggggatttgcctccatcctggggctgtgatggcaacagagtttcagaaacacagagcggaaaaggtgccttgaataaaatttactattcctatactgggcctcactgaattcagatcatcccagaggagggtggcgcttctttggaaatggtacttttttttttcttttttaaagaagtatcca

SEQ ID NO: 215569 - DNA, 401 bp, Homo sapiens
ctacacagaaacccattatacttcaagtggtaaccctcaaaccaccacacggaaattggaggtgagttcaggtcaacaaatgtctatccagcagctgtcctctcccagccctactcctaggacctcaggagatgcctgatggagttggtctctcctctgaagggagtgtttcccccaagcgaagaccaagggagcaaacgagaagcaaaacatgtatttgatgttcataggtgctcctcctcctttgctgactacaatggctaaagaaacatagactattttagggtaattgcatctaattacaattgatgcaaattactgtgaaatatacatgttctttgctttatgttaattacccacatgttaacaaaagttttagtaaaaggagtgacttactcata

SEQ ID NO: 215570 - DNA, 6476 bp, Homo sapiens
  misc_feature (2)..(2): n is a, c, g, or t
  misc_feature (4)..(5): n is a, c, g, or t
  misc_feature (10)..(11): n is a, c, g, or t
  misc_feature (2892)..(2892): n is a, c, g, or t
  misc_feature (5467)..(5468): n is a, c, g, or t
gngnntccanngccgggcagtgggcaggtatggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagtttccagaatacagatcacagagggctggagggatgattagctcgaaaatctagacctgtccaaggggcttctccctttccttgagctctctggacactgcagaggacccatgnccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtccactctcacagtcggccactggatttccctcactggctctcaggagtgtgaccagagtagactcggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccattttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaagctgacttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcatgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagcnntttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 215571 - DNA, 5510 bp, Homo sapiens
  misc_feature (2)..(2): n is a, c, g, or t
  misc_feature (4)..(5): n is a, c, g, or t
  misc_feature (10)..(11): n is a, c, g, or t
  misc_feature (2892)..(2892): n is a, c, g, or t
gngnntccanngccgggcagtgggcaggtatggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagtttccagaatacagatcacagagggctggagggatgattagctcgaaaatctagacctgtccaaggggcttctccctttccttgagctctctggacactgcagaggacccatgnccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtccactctcacagtcggccactggatttccctcactggctctcaggagtgtgaccagagtagactcggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccattttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaagctgacttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcatgattgcagaaggggaaagggaatattgcaaaagggagaggaaggggccttatgggaatagtgaaaaggctcagaccgaccgatggcaagatctgcgtctgattggtgtacctgaaagtgacggggagaatggaaccaagttggaaaacactctgcaggatattatctacgagaacttccccaatctagcaaggtaggccaacattcagattcaggaaatacagagaggggcggagcag

SEQ ID NO: 215572 - DNA, 1630 bp, Homo sapiens
  misc_feature (2)..(2): n is a, c, g, or t
  misc_feature (4)..(5): n is a, c, g, or t
  misc_feature (10)..(11): n is a, c, g, or t
gngnntccanngccgggcagtgggcaggtatggctgagggcgtgtgagcgccgagcgctaagggccgccgccaccatgccagggggcgcaggcgccgccaggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataaggtgagaccaggtgtgtactttgtgggaaaggtgccaggtgccagcacttccaagggcactggagctgccttctgctggattggctgccccagccatcttctgaaagggaatgagcagtgccatagaggcccagggcggtcatgacagagccctgaactacgtacccttaggcaagtaactcattttctttgtgttgcatttttttttcttttgttctgttttcagcttataaatagaaaggctgtcgtaaatcaatgtgtggtttttttttgttatttttattttcctggtggaattttaaaaaatgaaatcttatgccaatatctactataaaagttagatgaaaacagactgctctaagtgggagctggggtgaggacccagaacactgtccttctgaccccttcctcttacccctgcagtggctcccgagcagcttggggcatggaagagcccagtttaagaatcctttaaggttctttaaggttccttccagatacaaagcccagggattctctgacttaggagggaattgaggtaggtcagggtgggaaagacacacagccttaaaagttgagaagtgggctgtttgagaagtgggttgcttgagaagcggattgtctgagaagtgggttgcttggggctaatctataaagtctccatctgtaaagttatcctaaaattatgtcttgtctcttaggaaggatgtgcagtggttaactttcctaggtcaggaccttttacaagatgctcttcggaaatacctacatttttgaattttactagaacgggctggtctgggacttggaagtacatt

SEQ ID NO: 215573 - DNA, 423 bp, Homo sapiens
gttcccttcttcgtagaacaagtgtttttttaatttccacaaaaatctccatcactctctcatttgcttctaacgactgaaacctctgttgctcccagaagacaagatttaattcatttatccgtttaaagtaagagtctaccagccaggagtggtggctcacatctataattccagcactctgagaggccgaggcgagtggatcacatgaggttggaagtttgagaccagcctgaccaatatggaggtcttatctctactaaaaacacaaaattagccgggcatagtggtgcatgcctgtaatcccagctactcgggaggctgaggcaggagaatcgcttgaacccgggaggcagaggttgcggtgagccgagatcacgccattgcactccagcctgggcaacaagaacgaaactccaactc

SEQ ID NO: 215574 - DNA, 607 bp, Homo sapiens
ccatgtagcttcatgagtacatataaagaaacaaaaaagtacttcaaagtaaaagaatcttcatctgggttggttccaagtctttgctattgtgaatagtgctgcaataaacatacatgtgcatgtatcttcatagtagcatgatttataactcgtcatttacattaggtatttctcctaatgctatccctccccctgccccccaccccatgacaggcccgagtgtgtgatgttccctgccctgtgtccaagtgttctcactgttcaattcccatctgtgagtaagaacatgcagtgtttggttttctgtccttgcaacagtttgctcagaatgatggtttccagcttcatccatgtccctgcaaaggacatgaactcatccttttttatggctgcatagtattggtacatgtatacatatgcaacaaacctgcacgttgtgcacatgtaccctagaacttaaagtataattaaaaaaaaaaaaaaaaagaatcttcatcttgaacaccgtctttttaaactataccttaccgctattgttcaatccattcgtcttagggaatgaaagaaaagtgtatttttttcttactctttaaatacctttcaa

SEQ ID NO: 215575 - DNA, 358 bp, Homo sapiens
gatgtaaggtagaggggtgctagaaatctttctggaaaataaatgtgacactgataatgaaggccctctctcacaaactgagaagttttaacattatccccaggtgacaggaattattatagagctttcagtaggtgattaatcccatttgtggaatgcagagtggaacttaggaatgcaaggttggagatgaggctatgtattagcaagctgtaaagtgcttttagaatttaaaatggatagcaggcccacgggtaatgttggataaatgttcattacagttaacaccagtctatccttctgcttttttcactcagtgaccatcaatggtagtaattttcaaaagagattcagaaat

SEQ ID NO: 215576 - DNA, 275 bp, Homo sapiens
tagtaagtgaccaaatgagaattcaatccctggctgtctggctccagtaacactacacaaatggtgcttgccacttaatgagcacttggtcaatattctctcttattattagatgggatctctgactgggaggggagaagggggagaggaaggggctctggagcctgggaggaggcttaaggagacctcggggagagggctgggggcagctaggggcagagccgtgttcctttttgtatactatgtcaccacagtaaaatcacttcctctatcaa

SEQ ID NO: 215577 - DNA, 367 bp, Homo sapiens
ggcatgctccactatgcctggctatttttttccccctggagacaggatcttgttgtgttgcacaggctggtttcaaactcttggcctcaaagctagcctcccaccttggtctctgaaagtgctagaattaaatagaattaaaggtgtgaccaactgcacccagcttatttatgatgatgatgatgatgatgatgatgatgatgatgatgatgtttgggagatggagtctctgtcgcccaggctggagtgcaatggcacgatctcagctgactgcaacctctggctcactgcaacctccacctcctgggttcaactgatttttgtgccttagcctcctgagtagctgggattacaggcacccgccatc

SEQ ID NO: 215578 - DNA, 375 bp, Homo sapiens
gctaaactgtggtatatccgtaacatggaatacaggttgagcataccaaaagtccaaaatgcaaaatgctctgaagttcaaaacttttagtgctaacatgacacaagtggaaaattccatacatagtactccctgaagtagctcccctatcatacacactatgccccagccaggatggaaacagacagttccccataaggctcctgtatcacaagagatttattttcaaacccattctttctttactgaaggtgtaatccttgtggagatttagagtttatgccagggtctcaaattcagcagcctacactgtggcagatcctcctcttacagagctgttattcccaaagctctagttcctggaggcacatacct

SEQ ID NO: 215579 - DNA, 487 bp, Homo sapiens
ggcatgcaactcaattggttatcagagaaacgaactttttaaaccagaaatgttgtatcactagacagtcagcagattggctaaaaccaacgagacagataaggccagagttgatgaggaggtgggatggggcgtgatgggacgcttgtccctcatggtggctgtgacctcacctcttaattttggaaaactttggcaatatcttctaaagcggagcaaacccatggcttgtgacccagcagctctgctctgaggcgtgaacccacagccaggagtgtcgccggagccgtgttcatcaggcctgtgtgccctgcggaggtggactgggtgaacacactgccggctacttgcccaggggagcagcatggaatgagctgcgtggagacacccgtgctccgcctgggcgagccgacacacacatgctgggtggaagaagcgcagtgggtcagcacatgtgcaaggccctcgtaagttgccgccaatcgaa

SEQ ID NO: 215580 - DNA, 256 bp, Homo sapiens
gtctcccctcttctcaggtgactggggtagctctgtctgccactaaccacatgacagtcatttatattagcatacagagccatttatttcctcttgtctcaacctgtccattccagaatcagctctgagcctttcctctgcataacgaaaaagcccagtgtttttcccaaaacaaaaagcagtcttttcccttaggtggattgtcccgcttcctcttgctaaacaataaacagctgaagctttggaattgctgtgt

SEQ ID NO: 215581 - DNA, 437 bp, Homo sapiens
ggatggcaccagggcacagcccagcctccctccggctccctaagcagttccgagtggacacgagcgtttcattcactaagtcactcgagcttgagagagacgcatgaggggctgcactctggtgagcttcgaatctccttttgcacacctggaaggttctcgtgggtgttctttgtcctcggatccagagtgtatctgatgccacacgccgcacacctgatgccacacacctgacgccacacacctgacaccacacgccacacactgcgcacctgacgccccacatggcacacctgatgcgcacacggaacacctgccacatgccgcacacctgatgccacacgctgcacacctgacgccacacacctgacgccccacacggcacacctgacaccacacacctgaccccacacacggcacacctgatgccacatgct

SEQ ID NO: 215582 - DNA, 571 bp, Homo sapiens
tcttttctttgtgaagggcaggccccctggaatgggttcgccccgagagtctccgtcgaactagttcgacggagatctccaagattataattaagtcacttctgctaaaatttcactcaagaaatgaggaaaaaataataatatatcccccctgagataaagttataaaccaaacaaatttattaaaagaaacaaaaactatcgtaaaatttgaatggggcttaagaaatcagcacatattcctattaatataccatatgattatgctctattttagtttatctcaaataacattaaaacacttaagagccaacctacatttttcttttaaagtattctttttcagaaacctggccaaattgtgtcacttgagatatgcaaacatacctgccaaaaacagaaaaattccaggaagagcctttgaaagaaaataattcattaggaagttgaagtagaaatctaaagagtaactaaattatagagtttgaaaattttcagaaattgagtgcctaccatgtctaatctaacgtctctcaagatacatatatatatgtatctacatatgtattat

SEQ ID NO: 215583 - DNA, 1043 bp, Homo sapiens
tcggcaagcagtagggaaccattatcactcctttgtcaggtatcagccagtagataaatacatattttgaagaaaggatttacatgctagttcctgctcaaaaaaaaaaaaaaaaaaaaaacttcaaggaatatgaatcatgcctggaaaggaaataatttagacatatataaataaggtggtctgaggtcaaagagttaattaaacttttaggaactgctatttccattagagaaatattcttagataaagccagatctgtgggaaacaaagctagaattgccagtaccattcaatatatttattttgtaaccaataaatcaataaaaaagtttaaagagtatctgtcatgcatataataattaggttgaactcagaataaagaaaaaattaagagatgtggttcctgacctcatgaaacttatattctatttttaacttgaaaattaccaaagttgtcccttttcttttttaacctacagtatatggctttctacataagtgattttattaagtccaggacccaattagttgtaagcaacatgcatctccaagattataattaagtcacttctgctaaaatttcactcaagaaatgaggaaaaaataataatatatcccccctgagataaagttataaaccaaacaaatttattaaaagaaacaaaaactatcgtaaaatttgaatggggcttaagaaatcagcacatattcctattaatataccatatgattatgctctattttagtttatctcaaataacattaaaacacttaagagccaacctacatttttcttttaaagtattctttttcagaaacctggccaaattgtgtcacttgagatatgcaaacatacctgccaaaaacagaaaaattccaggaagagcctttgaaagaaaataattcattaggaagttgaagtagaaatctaaagagtaactaaattatagagtttgaaaattttcagaaattgagtgcctaccatgtctaatctaacgtctctcaagatacatatatatatgtatctacatatgtattat

SEQ ID NO: 215584 - DNA, 479 bp, Homo sapiens
tgagacggagtcactagtcttcttttggaatcacatcaggaaagggaagttgttagtgcttatgccaggtagctggaagacatctttgtgatatttatgaagatcagccctgttgggcaatcgttgcctctgccagaatgacttacccatttatctaataaagggaaacatctaaattcttgaacatgtaataattcacttgataaaattcaggtttttataaacaaatcatattaaaaccccaaaagttaattaacaggtgataaaccttgcttttacttccttgtcccatcacattcattcatagtcataatacactgacaattattgagtgcctttgatgtgccaaaagcacttgctaaatgctttgtttggaaagggatgtttgttaattggggtggtacctcccaaataatgaaacatacacacttttgttttattgaggatagggttttatcattccacagctgttccttgag

SEQ ID NO: 215585 - DNA, 175 bp, Homo sapiens
ggatccaccattggggagcattaactcattctgagtccagaggaggtcctgtctctgagtgctgtctcagtgcagagggagaggaaggagtaggcagatagcaggaagcagagctctgagtaatatcgcgctgctctggaacatctgtttctcctcacctgtgtagaacagtagc

SEQ ID NO: 215586 - DNA, 334 bp, Homo sapiens
cggctgcagcctcggaatagccggtcacaggccactgcgctgctgtcggtgaaaggcagcccgggacctgaggccgaacgcaagctcaggccgcagctaccaagggaacctgcctaagcgggcggcacagaagggagcgccggggacgctctggttttcagatcccctttcggaaggtgagattgtttttcataacaggcaaaggaagataagccccgcgcccggcgaaaccctggccctccctcgctgctgcctctggccctgtgtgcagctgaacgcagctcttatttaaatcatgttgaggaattaatactggtgcactgacaggtttttt

SEQ ID NO: 215587 - DNA, 535 bp, Homo sapiens
agaagtcataatctaggtctttttagtagacaaagctaggaaatgtttgtttttttgagaaaatacattgtgagttcattccgatatttacattcaaattaaaagctttaaggttttattatgtatcttcttttatatctgaatcccttttctcttatgctgaaaaactgtaattacattaacgtaactacttgtttgctttactctataatattttcagaataacattacaaatattaacattatgattactgaaaacagtacatgattttttttgcaatttttttttgcccttagaatcattacagtgttttatagtcatttggaataatttttctctgttaggctatgttgctaactcaaaacaaagttagatgcatttgtttcactgtgcttttactaagcttgtctttttggaaaatttcatttagttttgctggcagatggttccaaagtggaaaaaatataagatctatttagatgagtgtagcttttaaccttgtcttttcctacccccagctaaaaaaaaaaaatt

SEQ ID NO: 215588 - DNA, 518 bp, Homo sapiens
gaattcatactggagagaagccttatgaatgcagtgactgtgggaaatctttcccttctaagtcacaactccagatgcataagagaattcatacaggagagaaaccctatatatgcactgaatgtgggaaggctttcaccaacaggtcaaatctcaatactcaccagaagtctcatactggagaaaagtcttatatatgtgctgaatgtgggaaggccttcaccgacaggtcaaatttcaataaacaccagaccattcacactggagagaaaccctatgtttgtgctgattgtgggagggccttcatccagaagtcagagttgattacacatcagagaattcatactacagagaagccttataaatgtcctgactgtgagaaatccttctccaagaaaccacatctcaaagtacatcaacgaattcacacaggggagaaaccatatatatgtgcagaatgtgggaaagccttcactgataggtcaaatttcaataaacatcagacaattcatactgga

SEQ ID NO: 215589 - DNA, 816 bp, Homo sapiens
tgcagtcaatctcctacctctttggtcactgcaatgaactctttataatgaccagtttactttatgttcctataattttgtctctcatataaatagaatcacatgtcttttgtgtccagcttcttttacttagtataatgtgtctgagatggacccatgtcgtcacataatatcaatagttcatactttttgctgctgagtagcattccattgtatagatatatcacaatttgtttattcattgaccaactgatcaactggcttatttccactgtaattctagttttaaagtatactgatttgacagaaaacaagaacctgccaatgttagtgctgaggttaaagagatgattagcaaaaacagaaattgggaccagaaatagaatatacattctagacaaagatatgcctttctttaatatattctttaagcagcatctattaattcaacaaataattgaacatcaagtcccaggcattatactcgctatcagtaatatgaaaatctaagatggggtcccttgtagtctagttcaggggccagaaaactagatacagctcatgggccaaatcctgtcagctgcctatttttctaagtaaggttttattggaacacagccatgctcattcatctatgtactgtctatggctgtttttgcactaaaatggccgaaccaaatagtctcaacagactatacggcccacagggcctaaaatatttcctatctagtcttttatttttaaaaagtttggctgggcacagtcactcatgcctgcaatcccaatgctttgggaagacgaggccgggagatcact

SEQ ID NO: 215590 - DNA, 677 bp, Homo sapiens
tacatttagaaatgcactgggaatgccagtgctttgggaggccaaggcaggcggatcacctgaggtcaggagttcaagaccagcctgtccaacatggtgaaaccccatctctactaaaaatattaaaaattagctgggcgtggtggtgggcacctataatcccagctactagggaggctgaggcaggagaatcacttgaacccaggaggcggaggttgcagtaagccgaaatggcaccattgcactccagcctgggcgagaaaagcgaaactctgccaaaaaaaaaaatggagccattggtttggaagagattacttggcgagaaggtacagagtgagaccagtagagtcctagcatactcccctgaggaactagtaaatgttgggggagaaatttcaattttccttttctaaataaaatcccaaattctctccattattctatgctgatttggtcgataaagaggctaagagaggaggatggtgcgtagtatttaagtggctcaactaaaatgctgcctttggtaatgcattctgtgtaatggtatttttaaggttttcatgtgatactgtttcatatgcatttctgagtatggatgtaaactattttaatgaaacagatgcattcaggcccttgcatattcttttttcttgttgaagaggaaggttgtgggactt

SEQ ID NO: 215591 - DNA, 155 bp, Homo sapiens
cccacccaacaaaaggagagatggcttttacagcctttagattaaagtttatgtactagataacaatctttaaaatctgacatcttttgaagcataaattaagtttgaaatttgagtgtggacccatttggagtttgtgtccagttaggcatact

SEQ ID NO: 215592 - DNA, 298 bp, Homo sapiens
ttacgggcactgattctgtatctaggctgcctgtgttcaaatatagactctgccatttattagctgtgtcaccttgggcaagccatttaacttctctgccttgtttcatcattagtaaaatggagagatgtcaatttatgtatcttaaatgactggaaggattaaacgaactaatatggtaagtgtcctgtgaatggtggtcaccttatcaacttcagtaacacatctttctctgtgtctgttttgctctggctacaatggattttttttgtttgtttcatttttcattgagaaagac

SEQ ID NO: 215593 - DNA, 147 bp, Homo sapiens
gccactcaaaccccttttaacccaggtgccagaattccttgctcacaaagctctgactctacagatatgtgaaaatattcatggagaattttctcctggactcttgttttaactttttttagggggaagatcaggattggctgacta

SEQ ID NO: 215594 - DNA, 311 bp, Homo sapiens
cgactcttgaggatccacgaattcatcagccagcagtgtcagcatcaccccagaacttgttagaaatgcacattctgaatcagaagctcaaggtgggcccagcaatgtgtgttttaacaagcccacctggtgattctgatgcatgctcaaatttgagaatttgagtccccaactggtcatttaggttgtttcagtcttttgctattacaaaccatgctgaaattaataacattatacatttttatttcacacttgtctgtgtatttgtgggataaatttctcaaaattggtgggtcgaaggctatgcacac

SEQ ID NO: 215595 - DNA, 532 bp, Homo sapiens
gctggtcctgaactcctgacctcaggtgatccacccgccttggcctcccaaagtgctgggattacaggcgtgagccaccacgcctggccagtacactcttccttgcaccttgcttttttcacctaatgtgtgttgcagatccaatcatgtcagtacatagggggtgggtgtgttctttaacagctgtatggtatcccacttgtactccagtttgcttagaatgctagttctctagtatctggtccctgggccagcagtgtcagcatcaccccagaacttgttagaaatgcacattctgaatcagaagctcaaggtgggcccagcaatgtgtgttttaacaagcccacctggtgattctgatgcatgctcaaatttgagaatttgagtccccaactggtcatttaggttgtttcagtcttttgctattacaaaccatgctgaaattaataacattatacatttttatttcacacttgtctgtgtatttgtgggataaatttctcaaaattggtgggtcgaaggctatgcacac

SEQ ID NO: 215596 - DNA, 481 bp, Homo sapiens
ctgtaggactctgatgttgagatctcagaaataagacaagtaactgctttgtattacacctgcgtaaaggacaggcacactgatcaagggtttgactcttttcaccgacaataatctggtgcccaacattgggcctcggagaagactcaggaccctgaaggagttgcccaaaactggagctaaggtaccagcaggagcccattgaagcctcaccgaattcgagcttctccttcggtggaactgattatgaaaagagaaaaggagaatggctatggcctcaaaccacttggaaccctgattttcctaaacttggcctctaatatccacccccatggaacatagcatctgaatgcaacagcaagacagccgtctacaaaccaagaagagtgccctcgccagaaaatggatttgctggcactttgatattggaattcccagcccccaggactgtgagaaataaatttctgtcatttaagccatc

SEQ ID NO: 215597 - DNA, 454 bp, Homo sapiens
agaatcaggtagatctccatatctcttctgtataactgactcatcaaacaatcatgtcatgttaatttctacttcctatctttccatttgtcccttcttctccactttctatgttataggctgaattgtgtccccttacaattcatatgttgaaatcttgtcccctggtacttcatagaataatactttatgtggagatagggccttttaaaagtaattaaagtaaaatgaggctgttgcgtgaagcccaaatccaatatgaccggtgttcttataagaagggggagagacatctagaatgtgtatgtacaaagaagaggccatgtgaggatgcaatgagaaggcagtggtctgcaagccaacaggagaggcctcaggagaatccagtgttgtcaaccctttaatcttgagcttccagcttccagatctgtgagaaaataaatttctgttgttt

SEQ ID NO: 215598 - DNA, 292 bp, Homo sapiens
gggtcaagaggggagtgaattcaacacttggaggaaagacttgatttgagctctgattagatgtgaaatttggtttagctgaaaatggagagatggaggggcaggtcctctcatgcgagaaagagggaaagagtgaatggagttgggcgtgcaaggatgtgggcataatagaatgaaagtatgaagaaatgagcgatgagaaactcctaattatgcatggcatttatcaagtacctctcttcttagaaagctcaaatttctacatttttggttcccttggagtagaaaacaa

SEQ ID NO: 215599 - DNA, 443 bp, Homo sapiens
ctctgtagtccttcatgctcttgctccttggctccctctttcttgaatctccactcttcccatcttgataaaccattacctctgagtctagtggtttcttaactcacttgtacattagaatcatcagggaagctttaaaaaaagaaactgatgctgactgggtgataatgatgtatcagtgtaggtttatcgattgtagcaaacattattgtggcatgggatgtcaatatgagtaagggaggttgtgcatatatggggacaggggctatatgggaactctctgtactttctgctcaattttgctgagaacctaaaatactctaaaaaagaaggtggtttttttgtttgtttgtttgtcttaatggtcaaatggtcctgggatcagaatacgtgctaagcatggcaaaaaagatgatcaacatcatttagatagtgctattctt

SEQ ID NO: 215600 - DNA, 377 bp, Homo sapiens
ttttttatggctgcataatattccatggtgtatatgtgccacattttctttatccagtctatcattgatagacatttgggtttgttccaagtctttgctattgtgaacagtgctacaataaacatacatgtgcatgtgtctttatagtagaatgatttataatcctttgggtatataccctgcaatcccattactaggtagtatggcatttctaaccaccctttccttccatgagcttaggcctgggagttgcagtgagtgggagccttaaatctaccaagccgcaaatttctgtgttcctgaggcctctcaaggcatcaacatcttgaatagaaaataagtctatccttaaagatacagtacatttaaagattaaa

SEQ ID NO: 215601 - DNA, 177 bp, Homo sapiens
gttgaactcttaaaattctggaatgtttattttattttattcattgtcttgagaggagcaaaaggaagcgagagggcatagctttgaagaactggcaatttggcaacttctctccccttgccacccctcccccactatcttagctatttgatctgattaaacagctttggaatggta

SEQ ID NO: 215602 - DNA, 300 bp, Homo sapiens
atagtggggattacatttcaacatgggatttgggtgaggataacatccaaactatcttgcccttcttttaccatcaattcttgcaggcagcctcctctgtcctcccattcactattactcttttcagtgtgaccctgtgcaagtaactcactatcacctgacctcaatttcctcacttcaaagggctgttgtgaagaataaacaggttcatatatgtaaggtgcttaaaacaatactaaataaaggtgctggttgtgatactggtttatatcattcatgttgaatgtatttcataagaaa

SEQ ID NO: 215603 - DNA, 513 bp, Homo sapiens
gttggaagtaggtgtagcatccatccaactgaaccgaggcagggaggggatatgaggcttagaatgctccttaggtagacattcagccaattcttctgtttttatctccactttcacacccactttcagaagtactgccaattctttggcatttggggtcttctccaagggttgcttctcagcttttctcattacaagttcaggaatccattttctcagatctaggttggttaactcacatccatcagctcttcaacttgcaaaattttgttactttgtttcctgtctaattctctttttctctaaagttttatgccttaaatcagtttactctccattctaatgggctatggggaggaagtgaaaaatctgtcaactttcctgaaaagtctgtctctccactctttgtcctaaatatttcttcttatacatacacattcctattctgagattgaagatctgctcatttgctgattcagttttagcgatctattatcattaattcggattctc

SEQ ID NO: 215604 - DNA, 367 bp, Homo sapiens
gacacgtaggttgtttgggggctactatgaatatggttgctgcaagcattcatgtgcgtgtcttttggtggcctgggcactcatttctgctgcatgtaaacccaacggtggaagtgctggtctaagggatatgtgtgccaaacttcagtagagattgctgcatagttttcaacatggctgatcccattttacaatcccaccagcagtgtttgagagttgtgattactctgcatcctcgccaacacttgatattatctgtcttttcattttagccaccctgatggtccagacatcactgattctgttgtgaaccctggtggggaaccagtgctccccaatgggtaggaggacgtgagatgtggggagc

SEQ ID NO: 215605 - DNA, 246 bp, Homo sapiens
tgggaggagtgcacaaggcgaggagtttgagactagcctttgcaacatagctagactccatttctacaaaaaatttttaaaacaaacagggtgtggtagcatgcatctgtagtcccagctacctgggaggcagaggcaggagaatcgcttgagctcaggagtataggttgcaatgagctatgattgtgccactgtactgtggcctgggtgacagagtaaaactttgtctctaaaaaacagaaatat

SEQ ID NO: 215606 - DNA, 539 bp, Homo sapiens
cacatgggtttgcttgcagaatttatcacttaattttcagaattcttaaagtcatagaaaaataggaaaaaggaaattaacttagaatagttggcttcttaatcagatcatcagttgatcagaatttgatcagatttgattaacagcaagtttttttcctcatgtgtgttatagaaatcacatatttctgtacttgttcattgataccaactgtcaggtttttctgttgtatgtttgtatcacattcttatggtagatatttgtgataataaatttgcttgccttacacatgaaagatggctagattttagtcaaagaataatttcttgcattttcagtttctcagttgaatggctctagttaattataaccattactgtttctcccacttatacctatttatcattcacaaacatgtttagtctttttcaaaagtccagatagtatgaaaatggccgtttcgttgaatcctcttacattattaacaaaagtttgtcccactgaagatagctgaatggtaataagtagaaaaagtttta

SEQ ID NO: 215607 - DNA, 508 bp, Homo sapiens
tagatcttggcgtcattatagcaaagacaagtaaggtacatcaccaaatgttatggagctgtggaattggggatagtttctgtgtatatcacaggggctttctcctctgatgcttatgtgtttgttaccatcttctctctatagagcatgaaattaattcaagaccagcctgggcaacataacaagatgctgtctctactatatatatacagtatatagtatatacaccatatatatagagtagttatatatatcaatatatatgtataacatatatatatagtatatacatatgtatctagatatattttatatatgcatgtgtatatatgtggtggctgtggttggcagacatttgtagccctagctactagggaggctgaggcaggaggatcccttgcactcaggagttggaggctgcagtgaaccatcatgaccgtgccactgcacttcagccagggcaaaaaaaaaaaaaagtaaaatggaaagttcagtaaaaagaaaagaa

SEQ ID NO: 215608 - DNA, 109 bp, Homo sapiens
tactttgttctgagcccttctcaggcagaggaggtcaggcaggtacacgtgcctttgggaagaaggtggtggaaaaatatggaataatgagcccttctgtcgtcttctc

SEQ ID NO: 215609 - DNA, 407 bp, Homo sapiens
gccactgcactccagcctggatgacagagtaagacctcatctcaaacttaaaaaaaagagtatagcatatacactcatacagcacgtgatacctgataataataaacgactgttactagtttatgtatttgctatactataccttgtattgttattttaaattgtactccttctacttattaaaaaaaaaaaggtaactgtaaaacagcctcaggcaggtccttcagtagggattcgagaaggcattattattatagaagatgaaagctccatgcgtgttattgcccttgaagaccttccagtgcaacaagatgtgggggtagaacagagtgatattaatgatcctgaccctgtgtaggcctaggctaatgtgtgtgtttgtgtcttcatttttaacaaaaaatact

SEQ ID NO: 215610 - DNA, 775 bp, Homo sapiens
catcctttttaaaaatctcattcctttaatggagtatctttagaagaaaaaagaaagctttacatgtactatttgcatggaatcagcttataacaaagcaggatgaacagggtccacttagttgactgttgtttttgcaggctttttgaagtagaaatacaatttttttgtttttactcagaattcatttggcattaaaggctccccataatgtgatttcattagttgtgtactttaattcagatgttgtacggacttcggagtcagacaaaaatcccattttaaacatttaaagagccatatgtacttggtcaaatctaccatctcttttgtgttttgatttcttcatcgcaaagtggagagtagtaagtaccatccactgccagacactctaatcactactttctctctctctttccatatagatatatatgggaatatatgtatagaatgtacatatatttttatatattctctcatatatatatatttccttgatgtgagtgggtatataagctctcatttaatccttgcaacaaccctgtgaaaggtagatggtacctgttttacacatgaggagaaaggatcaatgatataagtaacaagctcatgttcatacagtaactgtatttactaagtacagttctagagacatgggaagcacttcataagtaaaacagcagcaatggtaagtttaaaaaaaatcagataatagaaatgttaaaacaagaatggaatttattaagtgctaaaaattttacatttttaaacttca

SEQ ID NO: 215611 - DNA, 616 bp, Homo sapiens
catgagattatacaagtctgacaattcgatgttcacatcccatgtgaattcaagaagagtgatgttgatgacaaaagaatgaaaatgattcaacagtgtcatcagctctgctagagtaacagtgcaacacagcttagaatttccacatccgctatgggaaatggcatcgttctcgacagcactgggactgaatctctgtgaagcaggggtttcgtctgtttcactaacacttgtccccaagtgcatggctgcctgcctggcacacagaagttgtcccatcaatgtttgtggaatacatagatggaaggtatcccactgagctgcaaagtagtgtcttccttctaaatcagaaccactcctttataacaaatcttagaatggactgcggctgaggctccacgactctagcagacgattccctttactttagcatttcaaaattttctttggtgtctgttttcaatgccaatctaattgcttactgtctcttaagtcaatactgttttctcttcatctcttcttcaaaaaaattttacattgctggtcctttccaataaatgcctttccaatgaccttcaattactgttttctgaaataaatatctgtaattaatgta

SEQ ID NO: 215612 - DNA, 430 bp, Homo sapiens
gcattcaaaggtgtttttttaaaaacaatttggaaggaagagaatgaagatatacaaaacagaaaacattgtgatgtggtagcaaatgtaaatttattatagacttttatacatttaaggaggtttcagtttgtgattcacaatagtggggaacttctcaaagcctcttctaagatacaagaagaagccataattagagcagaaaagagattgaatcaatactagtctgatttactattccatgttatcattagggaaatgatataaagaggagacatacagtaatgggcttttccccctgtgttgtaaatcagtccttctttaatcctttgattcctcttccaggcactttaaaccaggagagcatttactctgttaaatcattatgtttaacatggcatccttctatttgagcatctgctaaaaaaaa

SEQ ID NO: 215613 - DNA, 484 bp, Homo sapiens
acgccattctcctgcctcagcctcccaagtagctgggactaccaggtgcccgccactatgcctggctaatttttttgtatttttagtagagatggggtttcaccatgttatccaggatggtctcaatctcctgacctcgtgatctgcccgtctcggcctcccaaagtgctgggattacaggcatgagccaccgtgcccggccaatctatattcttatatatagtttctgttgctcctcattctttactgcacttctaagattctatttgggatcattttccttctgcctaaataatgccatttagtatttcttttagtgcaagtctgctggcgatatattttctcatatttttcttgtctgaaaacatctttagttcaccttcatttttgaagggtattcctttctacactttcattccactgtcatctgctttccattgcttttgttcagaagtcagctgtcaaccatgctgttgctccactg

SEQ ID NO: 215614 - DNA, 601 bp, Homo sapiens
cgcggtggctcatgcctgtaatcccagcactttgggaggccgaggcaggcgaatcacgaggtcaggagatcaagaccatcctagctaacacggtgaaaccccgtctctactaaaaatagaaaaaattagccgggcgtggtggcgggcgcctgtagtctcagctacttggcaggctgaggcaggagaacggtgtgaacccgagaggtggagcttgcagtgcgccgagatcgcaccactgcactgcagcctgggcgacagagcaagactccatctcaaaaaaacaagaaaaaaaagaaaatagctgaaggtctagaaagagaaatccacgtgtctccaaggaaacctgcagagctggctgaagtgctgatgctgcaacaatccccactgtttgctgcaagctcactccttactgcttcagtcatcactgatgtaagacacaatttaaaatttgacaaactccatgaaaggttacctgcattcaaatttttttattaacctcagaatttcaaggctacctatacatttctatcagtatttccctatagaagtatttttggtaacactatcttttttttcctcagacctctcaaaaacagtgttt

SEQ ID NO: 215615 - DNA, 799 bp, Homo sapiens
ttgttaatacataccccacatttaaccaagaaaagccacagaggaaggtactgcttcataaaaccaatgtcccttgagcatgtcccttaatatgccacagacactatgccaagcccatcacaggcattgtctcctgtcctcaccccaccctatgggtagggcctgttagccccattttacagaggaggaggagcgctcccagagtcactgcccgcaggtaagtgggagaggctgtgcctccagcactgtcaaggacgggggcactggaccccatttctgatgaaccgaatcttcgtctgagtgggccttggtagcgcagtctcacaacctttctcaactttctcactaaagctgctcaagcaacagaggacagagacactgagggatgtggacacagtccaaggtggcagccttaggtggagagttctctggagttttaccaaaaccaaaagttttatttcataatatatgctttttgttgtcttactgggtaaaatacaacataaaatataccatcctaaccatttttgagtgtgcatttggtgacattaagttccttcacagtgatgtgtagctatcacacgcccatctccagagctccttcctcaccacaaaacagctccccgccccagcctccagcacccccattccagctctgtctctgtgaatttgactactccaggaacctcacaaggagtggaacgacccactattcattcttctgtgactggcttatttcacttagcgtgaagtccttgaggttcatgcatgttgttgtagacgtgttttaatgttaaaa

SEQ ID NO: 215616 - DNA, 393 bp, Homo sapiens
taatgaataaatttcaatgagatctttatttagtttgctttacttagagacatttttatgaaggaagcttttaaaaatactgtttattcttttttgctgaaatatatatgtgtatatttatatatgtacatgagacgtacatttaatgtttaacaaatagtcataaaatgaacaatgtgactactaccaaggtcaaagagtggagcctgcctcccatgctcctcccgggagactctttagtcagtctgtcctaagggaacgaaagcacaattaacttcttaaacactctcaggggagagacttgttttgaatgaatattttgttttgaagtattagaagagtgttgaaaagataaattcaattttttttttctagaggacagagaaggggggt

SEQ ID NO: 215617 - DNA, 760 bp, Homo sapiens
ggcgtgagccactgcgccctgcgatttgcagttagaagttagtgtgtgaagaaatggtgcagaattatggcatgacttttacccatgttttgaatattagagcctcctaaacatgtctagcacattaaactgtagtctagtacaatatgttagtcattttatttatttatttatttatttatttatttatttatttatttactatagaaggagtttcattcttgtcacccaggctggagtgcaacggcacaattacggctcactgcaacctccgcctcccaggttcaagcgattctcttgcttcagcctcccaagtagcggggcttacagtttgtgcgtcaccatgcctggctcatttttgttttggttttttttcagtagagacaggttttcaccaggttggccaggctggtctcacctgacctcaggtgatccacctggctcagcctcccaaagtgctgggatcacaggagtgagccaccgcgcccagccatgtcggttgttataaaaaggtctttctcttgccaggtgctgcagctcacacctgtgatctcagcattttgagaggctgaggtgagaggatcccttgagcctaggagtctgagaccagcctgggaaacataaggagatcccatctcttcaaaaataaaatttaaaaattagccaggtgtgtgcctgtgatcccagctacttggtaggttcaggtgggagtgtgcaggagagggatctcgatccagacccaaagagagggttcttggat

SEQ ID NO: 215618 - DNA, 418 bp, Homo sapiens
ttcgtctgaataatgtggattacctctctccagagggtggtgtgagataggaggatatgttaagcatttaaagattcctgacgtggagtcagcattcagtgtttgctactactgttctcccggaaaggagaggaaatggaacttggacatgaagaagctgggaaatacacacagcaaccttttgaccatgacttccagccccggccctttccatcagctctcctctccatctgtgtgtgtctaattttttttttaaatttgtatttttttgagacagggtctctctctgtctcccaggctggaatgcagtggcgtgatcttggctcattgcagccttgacttcccagactcaagcgattttctcgcctccacctcctgaatagctgggactacaggcgtgcatcaccatgcccggcta

SEQ ID NO: 215619 - DNA, 366 bp, Homo sapiens
cccacttttgagagcttccttgggattatggtgaccttaacaaagcttgtagcctataggtgactctgtccactaacattcagaagaaaaaatctgagcagtgaatgatccagggacaagactgttctttcaccaagtataactcaagcatacacaagctagcagcaagggttcagagattcccaagctattggaaaattataacttttagttccttaaaatgtgtgttagaagccaccagtcatcaaacaaaatatgtttcctttttcatccatgataacaagattgtagcagggtatgtgaatagaccacatttcccagcccccttgaagttggatgtggctgtatggcttagttctctccaaa

SEQ ID NO: 215620 - DNA, 762 bp, Homo sapiens
tgctacaaatacatggaaattaaatattctgctcctgaatgatatctgggttaacaatgaaaccaagatggaaattttaaaattctttgaaatgaatgataataatgagacaagttatcaaaacctttgggatacagcaaaagcagtgctgagggaaagcttatagcactaaatgcctacatcagaatttcagagcacaaattgacaacctaatgtcacacctcaaggaactggagaaacaggaacaaaaagctagaagaagaagtaacaaagatcagagcagaactaaatgaaattcaaacacacacaaaaaaatacaaaagatcagtgaaatatgctgtcgcttcgaaaaaataaaattgatagaccatgagctagattaatcaagaagagagaaggcccaaataagctcaattagaaatgaaactggtgacattgcacttgacaccacagaaatacaaaagatcattccagactactattaacacctttatgtgcacaaactagaaaagccagaggaaatggtcaaattcctggaaacgtacaaccttcctagattaaatcaggaagaaataaaaccttgaacagaccaataacaagcagtgagattaaatcagtaattaaaaaattgccagccaggcatggtggctcatgcctgtaatcccagcatgttgggaggccgaggcgggcggctcatgaggtcaggacatcgagaccatcctggctaacatggtgaaacctggtctctactaaaaaaaaaaa

SEQ ID NO: 215621 - DNA, 281 bp, Homo sapiens
ctaacaatagttgattagttagaccttttctgggttttgtattgattatcttggtgtgcatttaattatttttctgaattcttcatggataatgacatagtaattgtgattcttttaataccagttaagcagtatttggcaacttaaacttcctgggagcctaactttgctatgttaagtgagtcaggtgtgctttttatttcccttgtttctcattttgccctgtcagtggatggtagatgctttgtatatcttaaatcccttaaaggatcttaaagaca

SEQ ID NO: 215622 - DNA, 651 bp, Homo sapiens
ccagtatcatttgtcagaattaccattcattcccaattgaattgtcttggatccttgttaaaaaccaatttactgtaaatgtgaaggtttatttccagactctttattctgttgatctacctatgccagtaccaccacatcttaattaatgtagctttgtagtaagttctgaaatcaggaagtgtgaggcctccaatttgttctttttagattgttggctattctggactccttgaattgccatatgaattttaagtatgcccattttgcaaaaatgtcagctgggattttgacagggattggacatccaactcacttataatcaaatgaatcttctcatttcccagccaaaattctgttgtgccagtaggagacagatgtccaaatccttctttatattgaatccagtttttcttgaaatctacactgccatcaagtctcttctgaaacacagtccatccatttccagacccatcgatttcacagtagactaagaattgctggttagctttcagaggtttaataaagtaaagcccgctctgtttagctcccttattggcaatgtcttgacaatctttcccagtgatatcatggatttgcaccgtgtctttgcaaggttcctggcactgtgcttcaagctgggctaccttc

SEQ ID NO: 215623 - DNA, 187 bp, Homo sapiens
gcagagtgtggttagcttcttaggaggctggaagccagtggaatcctatagagaagtatatattctttttaaccacatttgtatacttcctaccttctgccgtgttataaatggataatctggttatgatagccctaatcctttcctttctgaagaaaaagcaagctatccccttctgcattttgcc

SEQ ID NO: 215624 - DNA, 338 bp, Homo sapiens
tctttaggctctagcctgattttctggctcataaggccaaagggagctggaaaagtccccacggcaggactcatggtggagagagaatgatctagaggattcaggcctctgcatactgtgtctgggtccctccttaaagaatgataaagacaagtaaagagcttgaagcagcctggagtccagccagaaacctttaactgagctttaaaggagatggtcacaacacttttcagaatactggcaaaggcctcctgtggccaggtttgtcctgggatgagcaaaatttaatgttaacctgctgtatctttgcttttaatatatctgcttgcccatcacaa

SEQ ID NO: 215625 - DNA, 782 bp, Homo sapiens
ggaaaaattaattacatattaaatgcagctctgttcttgcctaatccatcgtaaaagcaagtcccaaagagtcaaactttgtccgagtcccttagccacatgttataacaaatctccagattatttatggaaatacaaaaatatccaacagccaacaagataaagttaacagtatcttacatgcagttcaaattactgagtctgcaaagaagcaggaaaatacaaaccatattgagaaaaattaatcacttgaaattggccttcaaatgatactgatgatgatagtcattaaaacagttatgactgttggagaagctaacaaaaagattgaacatgttaaatagagatactgtctgattaaaattacgtgtcaaagacatactacattaatggcatgttagactttgtcaaagaaaagataagtgtacatgaagatacagcaatagaaactatccaaaatgaagcacagaagaaaatagaatttggagacaataactgaaaaagtatttgaagaaataatggctattttccaaaatagatataaactataaaccaataagcacaataagcataagaaagatgaataaaactctgctaaaacacatcataatcaaatcacttaaagataacttttttttttttttttgagacaaagtctcgctcttttgccaggctagagtgcagtggcacaatcttggctcactgtaaccttcgcctcccaggttcaagcgattctcctgcttcagcctcccgagtagctgggattacaggtgcatgccacc

SEQ ID NO: 215626 - DNA, 595 bp, Homo sapiens
gcaatggcgcacaatcttcgctcaccgcaccctccgcctcctcagcctcccgagtgctgggattacaggtgtgagccaccacgccccgccaacatttgctttaagagacttaaagtacttgaggagtctaggtttgaacatacctgaaaaattgctgacaagagttaaataacagttcaggaaaattacagctctttgaaacactagaggaaaggaaattctggataatagcctattttgttttattaaaaatgtgtaaactttttttctttttgcctcttgacatagttacatattttcccctgtatttgttaaaggaaaaataagttgggggagaggtcctgctgtgttcttttttttttttttttaactaaaaaagtttttttagagacaggatcttgtttcgttgctcaggctggagggcagttacacactcatagctcactgcagccttgaagcttctggcttcaagcgatcctcctgcttacgcctcctgaagtactgttattacagacatgatcccgcatgcccagccccactgtgttcttaaactggatgtactgagtaaaaatgaaccttgttttgaaaaaaaaaa

SEQ ID NO: 215627 - DNA, 89 bp, Homo sapiens
cgttttcacgagtaggtgttgaattttggccaaatgttttttctgcatctattaatatggtcacctacctccccttctgtcgtcttctc

SEQ ID NO: 215628 - DNA, 517 bp, Homo sapiens
ggcagcttttaaactatactagtgcttgggcctcacctcaggctaataaaatcggtatctctgagggctgtggctgtactagaatgccagacagaccatcatcctgatggctttgtgactgaaagaacagcaccctaggaaacgggcgttatttgttgtaactttagttctgctgcgtatgaaccatgcaaccgtagacaagttccttacttaatagagtggaatggttaataatatgattcccagaatccagtaagcccggtgtgcatcctggctctgccacttacaagctgcgtgaccttgggcacgtgatttaacctcttccaaactgtgagcgttaataacattatctactcattaaagttttgaaaggattcaatgggataatgtatgtaaagtactacagtgactgagtaaatactaaatgttaaaaatgtcttaacaattgttgctcatttactttattttcacatggaagtgagaataataataaaacctacctcatagggtggttcca

SEQ ID NO: 215629 - DNA, 331 bp, Homo sapiens
agactaacagattatcagagcggggtcttttccaccatgttttgcagccttatcagcagaaaactgtactaaagtaacaccacagatttattactttactaccttctgttatctctttttctctaattgtctaataagagaatcgtctaattctcttattctctagtaagtcatattacccctacctgatttttttaatgtggaaaacacttgtattattatagaatttaaaatgtaaaattaatttctgctcattgtcaacaaacaaaaaacttcaaaaatatagagaagaaaaattacccaggtaaattaaaaatcacccaaaattaag

SEQ ID NO: 215630 - DNA, 434 bp, Homo sapiens
taaaatgagtgggaattgcttggcaaatttgtgtttgtttttatctttatatttgcacatactgaataaagataattttaatcctggggaagaggtagaaaaaatctcatgattttagttttctctgttagtattgcacgacataagcaccagagagatgacttttttcctcctttggttcatttgtattttacttgtcctattccaaaagaacagtattgaaatgagacacaggtatcaataaggaaaatttccagagccagaagaaggaaggaactgtcagggaacaattagtgtgacgggaaactatgttatgcttcctcagaaagtatgacaaatatgttacatttacttgagtttctggaaactgcacatgagggatatagcattaatttcctttgtcttgttggtattctgttttaccattcatgaag

SEQ ID NO: 215631 - DNA, 568 bp, Homo sapiens
atatggtaaaagcaaaacagaagttaaaatcagccctgtgtcaaatctgcatagttttaggcttcagggagtgtctctgtatgttgaggcaggaagtttagtagaattccaaggaagtaagagaggaacaaacatttgtagattttgccttctatgggggaactcattcaatcatcaggagaactcttcaataggttttatttgctccggtttacctagatgaaaaattgagacccagaatccatgcttttctttcctggttacacattagaatcaccaatgtgacattaaaacacacacaacacacacacacacacacacacacacacacacactgcacacccattaggatggctgctatcaaaaaagaaaaaacaaaaaaatcaggggccaggcacgctggttcacacctgtaatcccagccctttgggatcacctgaggtcaggagtttgacagcagcctggccaacatggtgaaatctcatctgtaccaaaaaataaaataaaataaaacaaaaaacaacacacacacacacacactgcacacccattaggatggctgctatca

SEQ ID NO: 215632 - DNA, 395 bp, Homo sapiens
ttaggaaatgaccttcagaggagttgagaaacttgctcaaagctgcacagcatagtaagtggcagaagctgactttggggtctctctccatctctctcctgctcttccaatgccacaatgtctcttaccttgaaaaacactgacaataatccaaagaaaggggaaaaactgacctttggcttcaagtttcattcattcactcaaccaatataacaagcactgttctgagtgctaggcgcatacgggtgaacaaacccaagatcgctgccctagggcacttactattcaacagggagaagacagccaataccaataacaaaactaagtaattaaattacaaattcattcgaaggtgagagatgctgggtgggggaagtaatgggtaagaagatcag

SEQ ID NO: 215633 - DNA, 692 bp, Homo sapiens
atatcatttcagctctctgctgcttagaaagtaatgcacagataagaagccaaggaatgcaaatttattttggcattcattaggcttgaaatgtaaataaaaaatgacgtattcatttaagggttgatcaaataaaacaagcaatttttaatgaatgaagttttatagaagtaatttcaatccaaaagaattaagcttttaaataagacatatttattgtgctaaaaaacttgtattttcatcttcctaatacactaaaatggcacacagaataatagtgtagcacacaatacaaactgatatgtgcaatcaataattctaaaaattgttgttttaagtctttctttggaagtccttaaatgcaaaagaagaaatttttaattttgtttaatttttaaaaacatttttcagggttttctaatcctggtttaaatagtttatgctgaaatcccagttaatctggcttattcactcaaaagaaaggaattgtttaaatcaactataattaagctgatggttgcatttcaggctttgaattccgatcaagtttcaaattggttattattttggaggttgtgctttcatgttcctaggtatttctttgtttgactgtgaaaatatttaagtgtgaaaaacctagagagagagctttcttttaagtcactaaaatcggattcttttgatgttagaaa

SEQ ID NO: 215634 - DNA, 482 bp, Homo sapiens
cgatcaactcatgcctaatcttgttttatctatacccttcctatgtctgtatttttctaatttgaaatatatatgtatatatttccctctcctttcccagtagaagccttttggcttttgtacctacaagccaatagtttgtgggaaatttgcttcctcagaacttctgggatagggggacttggtaatagtcattagaagataaaactggccagatgtggtggctcacccctgtaatcccagtacttggggagggctaggtgggatgatcacttgagcttgggagttggagaacagcgtgggcaacatagcaaaatcccgttctctacaaaaataaaaacagccaggcgtggaggcccgcatctatagtccaggaggctgaggtaggaggattgcttgagcctgggaggtggagattatagtgagtcggtaatcgtgccactgcatttcagtctggaggacagagtgagaccctgtgtaaa

SEQ ID NO: 215635 - DNA, 425 bp, Homo sapiens
caaactattggcttgtaggtacaaaagccgaaaggcttctactgggaaaggagagggaaatatatacatatatatttcaactattattacatttgcttcctcagaacttctgggatagggggacttggtaatagtcattagaagataaaactggccagatgtggtggctcacccctgtaatcccagtacttggggagggctaggtgggatgatcacttgagcttgggagttggagaacagcgtgggcaacatagcaaaatcccgttctctacaaaaataaaaacagccaggcgtggaggcccgcatctatagtccaggaggctgaggtaggaggattgcttgagcctgggaggtggagattatagtgagtcggtaatcgtgccactgcatttcagtctggaggacagagtgagaccctgtgtaaa

SEQ ID NO: 215636 - DNA, 611 bp, Homo sapiens
caggaagcatatgtactttgacttatacttgcttgtctccttttctttggaattctaatctcactaaggtcagcttttctgataatttatttaaaaccaacaaaatactatttttaaaagaaaacactaggccgggcatggtgactcacgcctgtaatcccagcacttttggaggccgaggcgagtagatcacctgaggtcaggagatcgagaccagcctggccaacatggtgaaaccccgtctctattaaaaatacaaaaattagctggacatggtggcacacgcctgaggtcccagctactcgggaggctgaggcaggggaatcgcttgaacccaggaggcggtggttgcagtgagccgagatcgtgccattgcactccagcctgggcgacaagagtgaaactctgtggcaaaaatgttgaaggtaaattctcttctaataagtaatagttaaaagagtacattgaattacacaattcctggcacagttgagtatagtagtagtaaatgccagatggcttttcctataagctacatgactttgagaaatttacctctattattgctagtaaaatggataatataatagtacctgcctcatagggtgcta

SEQ ID NO: 215637 - DNA, 257 bp, Homo sapiens
tcaattggtgatgcctgccatgggctttggaagaaaggtggggagaatggcggcattatctgggggggtgggcgtggctggagagaagagggttgccatcctatataacagcagcttctaaatagcctctaaaatagaatctttgggcggggcgcggtggctcacgcctgtaaccccagcactgtgggaggccgaggcaggcggatcacgaggtcaggagaccaacctggctaacacggtgaaaccccatctctact

SEQ ID NO: 215638 - DNA, 200 bp, Homo sapiens
ttgcttttgtaggaatccaaagctaatctgtccctgatccggattgcacgcacctgtgccttttggggcctttctgcattagttcttccttctcttctaacctcaaaaatgtgttttctctgttggctctttccctttaacatagaagtatactcacgcttttgttgaatcttgaaataaaaggcttcctttaccacata

SEQ ID NO: 215639 - DNA, 415 bp, Homo sapiens
agagggattttcataattatatttatacttctctgaggtctttggtgtctggggttgtagattgtgtccatctgtacttaacccatgcacacagagtgttgtttagtgaatctgacttgaaactccatgcaaagtcacagtcttggctgggtgcggtggctcacgcccttaatcccagcactttgggaggtcaggaggtcaggagttcgagactagcctggccaagttggtgaaaccccatctctactaaaaaaatacaaaaattagccgggtgcagtggcaggtgcctgtaatcccagctactcgggaggctaaggcaggagaagcgcttgaacccgggaggcggagtttgcagtgagccaagattgcgcgtctgcactctagcctggggggacagagcgagactccatctcaa

SEQ ID NO: 215640 - DNA, 465 bp, Homo sapiens
tgcaggaatgcagttaatctttgaactggccgacctaggaaaacaaaatggatggcctcgtttctattctctactccttttccacacacaaaaaaaatttagatgacagtcttatcgtaaaacaggcttatacttttattgtatttctaaatcgactttcagatatattttttgtcccacaggaaaagttgctgccaatattagcctttttaaattttaaagagtatatgtactagataaattttttgatgcagaatgaagacaagttctcactgaaggacagactgtagaatgtgatctgaatctagtaaaactggctattttatggtgaaccagtttaacccattcctggtgatggtaatagtgctagctatcattttagtgagcacctactatgaaccagatacaatgctaggtgttttatttatgttaattccatctcatgacaaccttcagtgacgtcaa

SEQ ID NO: 215641 - DNA, 574 bp, Homo sapiens
tgcttcctaataccaaggaagaagacagatttagtgttttgaaattgagggttgttgaacagacattggtaaacaatgtatccagcctgaaagtcttttcattcctggaggagaggtttccaacttctgtttgaacagggataatatggtacttttcaaagctcaaccataaaaactgtacactccatgacttgatatattaccctatgtaattgtccaacttctaataataagtttaaaaccttctatgttacttttggaattgtgttacgctcactcttcttggggattactggaattaacaggttgttttatgaaaatattattttactgtcaaaataatcaatttgaaaaaggtgtttttttttttttttttatggagtttttgctcttgtcacccaggctggagtgcaatggcatgatctcagctcactgcagcctctacctcccgggttcaagcaatcctcctgcttcagcctcccgagtacctgggattacgggtgcatgccaccacacccaggtaatttttgtacttttagtagagatggggtttcaccatgtcagccaggctggt

SEQ ID NO: 215642 - DNA, 119 bp, Homo sapiens
attattagatctcaaggaaatataagttaaaaccaaaactagttattaattcacacctcctagaatggctaaaattcaacagaataacaccagatttaggcaaggatgggaaggaacta

SEQ ID NO: 215643 - DNA, 178 bp, Homo sapiens
agcctgggcaacatagtgagaccccttctctaaaaataaaattaaatgtttaaaaatctggaaactaattctggagaggactggagtctgagattctgaaggtttattttggatacattgtacctcaattttatgatcacgaaaatgcaagtctctgcatgtctgacccccaggaagg

SEQ ID NO: 215644 - DNA, 314 bp, Homo sapiens
aacttagcagctaaagccacacacatttattctctttgaattctgtaggtcagaggtcccttatgggtctcactggccgagatcaaggtgtctattcctttctggaggcttgaagggagaatcggtctccttgccttttctagcttctagaggctgcccgtgttcctaggctcatgcctgtaatcccagcactctcagaggctgagatggaaggattgcttgagcccaggagtttgagaccagcctgagcaacaaagcaagactcctgcctctacaaagaaaaaaaaaaaagagagaaagagaaggagagaatg

SEQ ID NO: 215645 - DNA, 520 bp, Homo sapiens
taaaaacctgaatccaagctgatggcctcttgccatcttgaaaggagagactgcttgagaaacaagaaagaaaagcagggccacgacacaggagacaaaacctggcccacacagctggggcccctggatcagccatgcctaaccaggtagtgacttgacacaataaatgatcttttctagatttaagctaccttgagtttggttactgtcacttgcaacataacgctgacacaatgttctgcgggttaatgagaggctgctggttgctactaggtcccacttcctaccctggctaccatttcgggtctgactgtggcttgttgatggcacctgggaggctgagctaagtccccaagccctccattcatgcaaacacaccatccctctctcattgtgggccccggactacattctctcgcctgccacctcccaccttttcttttcttttcgttgcgttttttttcgttttttttttttttttttttttttttttttggggggaaagtctataaggaaggag

SEQ ID NO: 215646 - DNA, 1663 bp, Homo sapiens
  misc_feature (887)..(887): n is a, c, g, or t
tctctctgtagaatgagaataagcccaagtctacagtaactgtagctaccattaacagcccagaaaggtcacggagaacttgagtaccaattttctcactggagtaaactgacccgtatgtgctagtggatcaagaagaacaaataaaagcttgcaaccccagtttctttgtccctctgcagcagagcatcacaacctaaactgatgcacattcttatttttttctgcgttaccaccctaagtgcatttgaatgtttccagcaagttactgcattcctaccacccctgaaagcattttccaaaaacatgttttagtttaagttgactggtggtttggcaaacaaaaggctggaatatggcacgatgactcaaatttaaattcaatgccttaaattaagggcatgctgttgccaagcccctgctgggccttgatgtgcatcagcatcctggccccttcacacaggttcctctgccacagtgaccttggattcacttaaggctgtacatgcagtggccttcctctgatggagggtggcctcggccacctgggctttaaactggtgctatctgggatggagaaaaggccaaccactgcagcagcaataaagccaaaagagcagagccacgggcccatttgaaaatgatgcacagagccgggcgtggtggctcacacctgtaatccgagcactctgggaggccacggcaggcggatcgcctgaggtcaggagttcgagaacagcctggtcaagatggtgaaaccccgtctctactaaaaatacaaaaattagctgggttgatggcacactgctatagtcccagctactctggaggctgaggcatgagaatcacttgaacccgggagccaagatcgtgccaccatcctgcancctgggtaacagagggagactctgtctcaaaaaaagataaaaagaaaaaggaaaagaaatgatgcacagaagtgattgtgaccccacccttctgaaacttcatagccaactgcctctaccacatcttggtactggggtcattaactttgagggtacagggtgggcccttcaatggctggttaaactgttagtgatttcacaggaggaaatctgtatctcttggaatttctggccttgttagtcattattattagcattcagacaggcagatcctgcggtgtctaggtgcccacggaagtgggggacactcacagacggggggacatggccacagaattggagggggctgtgcagaaaaaggaggccacctgaaaaagtgggagatgcccacaccaccctagatgtagtagggtatttgaagaagtaggagggtacccacagaaattagggttcccatggaaatgggggaagactaagactagagcatagactcctaatagtataaaataacttaagcatgcactctcaatttatgcatattcataaattcacttataactcatatacctctaaaagatgccagtaatgatgtctaccctgcagtgttgctgtgagaatgaaattgaatttcaacctggtaaatgctgtagaaccgcgcctggtatgtggtaacattcaaggagtgtaatggttgttgctgttactgtcatcatcaactttagggaccttattgtggacattagaaaatacacaaaatcagagattaaagatgatat

SEQ ID NO: 215647 - DNA, 1758 bp, Homo sapiens
  misc_feature (887)..(887): n is a, c, g, or t
tctctctgtagaatgagaataagcccaagtctacagtaactgtagctaccattaacagcccagaaaggtcacggagaacttgagtaccaattttctcactggagtaaactgacccgtatgtgctagtggatcaagaagaacaaataaaagcttgcaaccccagtttctttgtccctctgcagcagagcatcacaacctaaactgatgcacattcttatttttttctgcgttaccaccctaagtgcatttgaatgtttccagcaagttactgcattcctaccacccctgaaagcattttccaaaaacatgttttagtttaagttgactggtggtttggcaaacaaaaggctggaatatggcacgatgactcaaatttaaattcaatgccttaaattaagggcatgctgttgccaagcccctgctgggccttgatgtgcatcagcatcctggccccttcacacaggttcctctgccacagtgaccttggattcacttaaggctgtacatgcagtggccttcctctgatggagggtggcctcggccacctgggctttaaactggtgctatctgggatggagaaaaggccaaccactgcagcagcaataaagccaaaagagcagagccacgggcccatttgaaaatgatgcacagagccgggcgtggtggctcacacctgtaatccgagcactctgggaggccacggcaggcggatcgcctgaggtcaggagttcgagaacagcctggtcaagatggtgaaaccccgtctctactaaaaatacaaaaattagctgggttgatggcacactgctatagtcccagctactctggaggctgaggcatgagaatcacttgaacccgggagccaagatcgtgccaccatcctgcancctgggtaacagagggagactctgtctcaaaaaaagataaaaagaaaaaggaaaagaaatgatgcacagaagtgattgtgaccccacccttctgaaacttcatagccaactgcctctaccacatcttggtactggggtcattaactttgagggtacagggtgggcccttcaatggctggttaaactgttagtgatttcacaggaggaaatctgtatctcttggaatttctggccttgttagtcattattattagcattcagacaggcagatcctgcggtgtctaggtgcccacggaagtgggggacactcacagacggggggacatggccacagaattggagggggctgtgcagaaaaaggaggccacctgaaaaagtgggagatgcccacaccaccctagatgtagtagggtatttgaagaagtaggagggtacccacagaaattagggttcccatggaaatgggggaagactaagactagagcatagactcctaatagtataaaataacttaagcatgcactctcaatttatgcatattcataaattcacttataactcatatacctctaaaagatgccagtaatgatgtctaccctgcagtgttgctgtgagaatgaaattgaatttcaacctggtaaatgctgtagaaccgcgcctggtatgtggtaacattcaaggagtgtaatggttgttgctgttactgtcatcatcaactttagggaccttattgtggacattagaaaatacacaaaatcagagattaaagatgatataaaatactgagatttctgttttattatttttctacctgattttctttccagtaccacttcagagactgctggatcaatttctgtgcccatttcaa

SEQ ID NO: 215648 - DNA, 694 bp, Homo sapiens
  misc_feature (597)..(597): n is a, c, g, or t
  misc_feature (620)..(620): n is a, c, g, or t
atggtgacaagagaagctttactgtgtcagccatctggctgcccaaagcagaaagcagagctcccctgcagtactctcactcgcccttcttatcgcatcaggccccgctgactccgccccgcaacactctcactcgcccttcgtgtcccatcaggtcccgctgactccgccccgcaatactctcactcgcccttcgtgtcccatcaggtcccgctgactccgccccgcaacactctcacttgcccttcgtgtcccatcaggtcctgctgactccatctcctcagcgtctccaacatgtcccttccttgccacctcttgcctggattactacagcagcttctaacgagtctccctgcctttcagttctccgcaccgcttcaagtgttcagtctggatggtctgtcactcccagcgccaaaactgctggacggcttccctttgccttcaggacgaagtccgtgctgtctgacataacttataggaccttttagccagcctgggcaacatagcaagaccctgtctctaccagaaaatacaaaaatgagccaggcatagtggtgtgcacctgtagtcccagctacttgggaggctgaggtngggaggatcacctgagcccaggnaagtcaaggctgccagtgagccatgatcacaccactgcactccagcctgggccacagagtgagaccctgtctca

SEQ ID NO: 215649 - DNA, 590 bp, Homo sapiens
ataagattaatgtgtttagagctattaagattgtgaagagaaaggcaagaagtttagcctatcaataggaagcacaccagtgcctgaacctgacttgagttttgaaaaagctcatttcttaaaaacattcttagaaaattgggcttcacggaatagatatgtttggaaatcttggttcacatatgtataaggaatatccagtttctccctgttttcaagaatagccacttcacatcttttaggtggctctcaaatgtcggacaggagcagttgttagggtttttcaaatgtaagtcagaactgttgtttggagaaaactgaattttttcatttcgtaagattataatttctagaaatatctattaaaaggtggaaattacattaaagatagtaagtatattgtgagtatgtgaaatgaattttagaaatgatcacctctgtattattttaatagagtggaacaaaaatgttttaaatggttcttactttggaaatggatatcttaaaaattctgatattgccaccatttgttctacaaaactgaagcatattaagagctggagtttataaataaatctgttttaatcata

SEQ ID NO: 215650 - DNA, 890 bp, Homo sapiens
tcctgagtagctgggactacaggtgcctgccaccatgcccagctaattttttgtatttttagtagagatggggtttcaccgtgttagccaggatggtctcaatctcctgacctcgtgatccgcccgcttcagcctcccaaagtgctgggattacaggcgtgagccaccacgcccagctgaggcaagacttctgtaagtattcttcaagcagtagtacaagagttaaatatgtattcttcttttttaagctggtaaataaatttcctttttctacccattttaaagtgtgttggttatatgggtaaattgaaatgtatttcttttccttttttcttgcatagccattttaaaaaatattttttaaatatttaaagtataaaatatttttaaaattttttaaaaattttgtgggttacacagtagatgtgtgaaatgtatttgtaggtttaacttctgtgtagtttaattattttgttattaattggccattgataaatgagtctattttctttgctaatagagttgctgtcaatttgtaagtatgtaaagtttattatagagtatattctcacgtgaattattattttcatctgttgttctttacattgtcattatttttggctatttgcataggtaacattggtttaaggagagagacctgtgatcgaacagtgtcttgtgtctaatctgagaaagaaagcatccagtcttatcatcatgtatgatgttagctgagggtttttaaaataaattccttaaagcaggaaaaaaacaaacaaaaaaaaaaaattggggggcgcgccgcggccccggaaaaattttcaaacccttcgtgggggggggggccccatgggagggaactggccaaaggggtcccaaagaaacccggc

SEQ ID NO: 215651 - DNA, 428 bp, Homo sapiens
ctcatactcaatttagtcttctgcagttatctgcactattgataataacaaccttaaatctacaactaaactctgtagccagtagagaaacaagcagaaagttcattcaggcagcaggtcccaatacacacacacacacacacacacacacacacacactttcatacatatactcaatttagtcttctgcaattatctgcattactgataacaacaaccttaaatctacaactaaatgctttagccagtagagaaacaggcaggaagttcattcaggcagcaggtcccaacacaaccccatcccactccaggttgaaatcaaacagatgagtttctaagattccagaaagctcaaattccaaagaaatgctctagtggttactgtaataatacttcaagaaaaggagaggatgggctgggcacagtgg

SEQ ID NO: 215652 - DNA, 288 bp, Homo sapiens
gaggcagaggatgcatgagccgagattgccccatcaatcaaaattgacactccatctcaaaacaaaaacaaaaacaaaaaacaaataactactttctgaaactctggtagttaaatggctcttgtttgtttctttataataaggcacagtttttatggagcctgagcgttgttcttattccacaaaggacttttttttttttggcaaggggataaattactctgtcctaattaaaatttaattttgatgggaactcttttctctcccccagttttttgttgctaaggc

SEQ ID NO: 215653 - DNA, 361 bp, Homo sapiens
gctgccccaccttgagataatggggctgtgctgtcatacccctgtattagttggccagtggtcccccgagggtggcgatatacctcccagtgtctctgggtgaagcagctcctgtgagtgaaagatgattatctggagaaggccacatgtgtaaacctgtagcaccaactctcacagcagaagctgaggcctgggtgtaacctgacactgtaagcatgaccaaccatcttgatttgctcaggaccaagggattcctgggatgcatgggcaccaacagtgtctactacattgactgagggtcttgataaaagttttctcagtcgacgcggccgcgaatttagtagtagtagtaggcggccgc

SEQ ID NO: 215654 - DNA, 237 bp, Homo sapiens
agtgggaccaagcttttctgcctcacattagcagggatgattattcccctaaagtattctgtagtccctcatacaaacattccttggggttaccaaatgtgactcctggtggcagggatggtttaggttctagcttgcaatccactgtacctgtaaagtacaacaggtaaaacattacaattcaagagtctcaaagtagcaaatcataactcagagtattatcttgcctcgcagaca

SEQ ID NO: 215655 - DNA, 227 bp, Homo sapiens
taccaaaaaaccattatgccacacaggaccatatttggggcttttagtgtcccctgtccccaagatccttctattcaaaatgtgagctcatgcatggtttaaaatttgtgatggtgtgcagtggacacatggtggattgacatatttttttctttacttttgaatagttggattttttttttcaagacagagtctcactctgtcacccaggctggagtgcagtggcg

SEQ ID NO: 215656 - DNA, 590 bp, Homo sapiens
atggctggttctcttgggatcagtgatgacaccaggcagtcagagtaaggctgtgctctggcagggactgatgaggcctggaggagcagggatgtgcacgactcacaatatcttttttctttttcctttttggcatttaaaaagcatcagattacattgtgaataaatccatattggaaggttatttaagtcattaagcaccagtctgccaaccacataagctgtatagtagcctctagcaggctgcttaaaggaaagcggcctgaagattgatccaggatgccaggacttgcatcctaaaagtcaggctctttgtattcttctgcctttactactgagggaaaggagtaggggaaaccaaggtagagtttcacgaacctccactttccccctcacatcagctctcagcaccaaagaggcaagttaggaaacaacacaagtgtccatcaacagactaaatggatgaacagaatgtactatatccacatagccgagtttcagccctagagaggaaggcaattctgacacatgctacaacatggatgaaccttgaggacattatgctatggtgaaataaactcatcacaaac

SEQ ID NO: 215657 - DNA, 440 bp, Homo sapiens
atcaagtgtgttttggtagcagcaagatctggttttggattcccagcttcagtcttttactgtcagctcatctcactctatgaaacccagttcttcaattgtaagcaacagaaacatcggtcaaactggttttagcccaaaaatgaattgattggttcttaagtcatcaaggattttgtttattttgcttcaggtctggctggatccaggggctcaaaggatagccttagggctctttccccttttccactgtgctcctctccggcgtcactctgtcctgttatccacagtcttcctcctgatgggtgaggcagggagggcaggatgccaatcactccagacttacatgatccacttgggtatgccggggggctggggtaggggaagatgtcccttcccacttcagtttattcaatatagagaaatttcaggaaacattt

SEQ ID NO: 215658 - DNA, 219 bp, Homo sapiens
acgggcattgtgaaaggctggccattgatgtgaggaggaaagacaaggatgactggtttttagagtaggagaattagccgggtgcagtggctcatgcctgtaatccctgcactttaggaggctgaggtgagaggatttcttgaatccaggagttcgagaccagcctaacttaccaccctaactcattccaattacctgctatctgctctgccctgactc

SEQ ID NO: 215659 - DNA, 466 bp, Homo sapiens
ctgaggtgaagaagatattatatgatccatcaaggaatacaaattaaagaaagagaccctctataacaaattgacaagacaaggtgtgcagacatgacagatttagagggtgcctacaaagcttggccactttcttttgcataatttttttaatggatccataactacaggacttcaggacctacctggattggattgagaataaaacaagactgcacatattgacaaaatcaaagtaagctgcatatatttaatggaaaacatatttgtaaaatggtatacctccaaaaaaaaggtctgttaaacttatacaaagagatgtttaattaccaaatggtgcacttccaaatcaaaaagtccaaatgaattttttaaaaaactaggccttgatttgcatttctctaatgaccagtgatgatgagcatttttcgtatgttttctggccacataaatgtcttctcttgag

SEQ ID NO: 215660 - DNA, 421 bp, Homo sapiens
cagggctggagagccagcctgaaggccctgggacccttctatccacatagcaggagaaaagtcagctatgccaagaaaaggctggttgggtatccgagatcacatgccaagttttgcaggctgtacaagaagcatgaagccagtatccttcactcatggcagaaggagaaagggagccagcatttcacatggcaagagaagaggacagagaaggggagaggaaggaagcaccagaaaatttacagcttaaaacaagaaaacgtattatctcacatgatctgtagatcaggaatctggtcacagcttagatgggtcctctgtttaggatctcacaaggcttcagtcaaggtgtcatccaagttaggttttcatctgaaggctcatctgtgaaagaatctgcttccaagttcacccaggttgt

SEQ ID NO: 215661 - DNA, 422 bp, Homo sapiens
aacaggcaccagtctttacagagtgaaacccatggtgacacatttaggccctatctgattggtgactgaatggctgattccaagctacagcttgaagcctctgagaggcgtccccagagcactcccaagcctctcccgactctgagaacaaggggggtagggctgagaaactctgctgtactcagggtttcttttttatcctggaagctgctgcaatccacaggcgagggtggagagggagtgaccgagagcaggacaggaagccactccacaatgaacttgaccagagaggcagtgtagtggctaacactacccatccggaggccggactgcttggctcaagcctagctccgtcagttatcggctgcgcatttcgacaaagccacttaacctgtgagccacagtcctgtcctctgtaaaat

SEQ ID NO: 215662 - DNA, 757 bp, Homo sapiens
attggtacttgtttcggatcgccttcttgactttgtactattttcaggatggatcccaatttagaatcttcttgaagatactatatatttactaaacatattttgagcctgggtaatatagtgagaccttgtctcttctaaaaaataattaaccaggggtggtggtgtgcacccgtcatccagctactgtggaggctgaggtgagaggattccttgagcctgggaggttgaggctgcagtgagccctgatcttgcctgtactccatccagcctgagcaacagaacgagaccttgtctcaaaaaaaaaataattatgaaaataagtgttaaaagtaataaacatatattgcagtagaatcttcaaataagaaaactggtgccacattggattctatgatttcatggtgtgaaatgggataatttggggatgttataccagatttgaaaaatgaaaaaagaaggaatgggcatgcatggtggctcacgcctgtaatcccagcacttcgggaggcagaggcaggcagattacatgaggccaggagttcaagaccagcctggtcaacatggcaaaaccctgtatctgctaaaaatacaaaaactagccgggcatggtggtgtgtacctgtaatcccaggtacttggaaggctgaggtgggaggatggcttgaacccaggaggcgaaggttgcagtgagctaagattgggccactgcactccagcctgggtgacagaggcacaccctgtctcaaaaaaaaaa

SEQ ID NO: 215663 - DNA, 452 bp, Homo sapiens
attggtacttgtttcggatcgccttcttgactttgtactattttcaggatggatcccaatttagaatcttcttgaagatactatatatttactaaacatattttgagcctgggtaatatagtgagaccttgtctcttctaaaaaataattaaccaggggtggtggtgtgcacccgtcatccagctactgtggaggctgaggtgcccccaacccatcactccgtgagcagcatcggtgtttgcacactccctgcttcaggcttcacccattccccaaaggcttcatgggcccgctgcccccctgacctcagttttgcctctggtagggttgccttccatggccaggtaagtcctgacagtgcctctccctcctggggcgtcccacgaaagtattttgacatttctctttcttcagtgtatattgacttgttaataaagcactttgtagtgaca

SEQ ID NO: 215664 - DNA, 410 bp, Homo sapiens
tagctatccacagtgagaaattgatctctttctctaacagttgcatagtatatatttctgcatcttttttctcatctagaaaactaagaatcagagcaattacattagaattgcttataccttttagtaagttgaaaccaaaactaaggctcagatcctctgactgctaatgaaatccagagttcttcttccatatcacatctagtacagcacctagaatgtgttacgtggcattatcaagtttagttttaataagttaaatagcttgtgagggggtacaacagagcttcctttgagatattttctttgacagttcagccatttagggtccatagaattgtagaactggaagagaccttggagatcacctgttacagcccccacattttacagaggcactgagctcactg

SEQ ID NO: 215665 - DNA, 340 bp, Homo sapiens
tccgagacagagtttcagtctgtcgcccaggctggagtgcagtggtgtgatctcgactcactgcagcctctgcctcccaggttcaagcagttctcctgcctctgcctcccgactagctaggattacaggcgcctaccactacgcctggctaatattagtatctttagtagggatggggtttcaccaccttggccaggatggtctcaaactcctgacctcagttgaaccaccctccttggcctcccaaaatgctgggattacaggcatgagccaccgtgcctggacctaaactctttctttatggcaatccccctgtcttgataaatcggctttgcttagg

SEQ ID NO: 215666 - DNA, 407 bp, Homo sapiens
cttttctaggaaggcaagcagaaaagactttttttaaagctgtttttaaaaaatgggatggtgccagtcatcctttggagagccagcaaattatgaaggtgaatcgttcttttacttggctgaaaacatgttttaaaagatactgaataaggccgggggcagtggctcactcctgaggccgaggcgggcagatcacgaggtcaagagatcaagaccatcctgagcaacatggtgaaaccccatctctactaaaaatacaaaaattagctggtcgtggtggcgcagtagtcccagctactcgggaggctgaggcaggagaatcgcttgaacccaggaggcagaggttgcagtgagcccagatcacgccactgcactccagcctggcaacagatggagactccgtctca

SEQ ID NO: 215667 - DNA, 472 bp, Homo sapiens
atttgcatttccctagatactaaccatgctgagtgtcctgtcttgtgtttattaaccattcatatatttttagtgaaatgtgtatcaaatcttttgcccatttttaagttgacttatttgtttgtcttcttactattgggttgcatatgtttttgatataagtcctttatcagatatatgatttggaaatattttctaccaatctgtggtttgtttttcttaatggtgtcttttgaagtgcaaaaggtttgaattttgaagtacattttattgattttttcttctatatattgtgcttttggtatcatgtctaataaatctttaccaaacccacagttacaaagattttctcctgtcttctttttatactttttacagctttatggttttagctctaacaataaatgtgattttgaacatacataagactatttgtaacaaacacaaataaattgaattgttgggcacttgt

SEQ ID NO: 215668 - DNA, 772 bp, Homo sapiens
tatcaggaaaagaaacaccgaaataaactctgtttccatttattgcattctagcactggttctaccaaatatttgttggatgactttaggtaaagcatctagcctctctgtcttgattgccacacccacaatatgagataaatattattctgcatacttcctgggagagctgggaagataaaatcagatcattataccacataaagcaaagcaataacacttccatattttagcttcccacactgcctatctgtcctattttcatttattcatttatactttttaacaaacagttgctagtagtttgcttaatgtaagatatgggatgaatattttcatgatggcccctgcatctaagttatcatttagcagtacctgccttatctcttgtacagaatcagattagacagcataggaagaatgaaaaggtgaggtgggataataaggaatgttgtttgtggaaacataatggttgcttcaatttgagtgtaaactgtcctttttactgaagcaattgcaaccaagtgtgttagtttacaggtgcctacattgcttttttggcttaggtattgtttgggttttaatagacaaatcaactcaatcaaagaaaccaactcaatcaaagaaagatgggtctacatacaacaaaactgaacaaaatctgcaagaagagtgattcatacatgggctattgaggcaacatgaaatggacattaatcgactaagtaaaaaacagatttcttgaagaattaataaagaacttttgttttgg

SEQ ID NO: 215669 - DNA, 258 bp, Homo sapiens
ctcactgtagcctcgaaattctgggctgaaatgatcctcctgcctcagcctccaaagtagctgagactagaggacaaatcaactcaatcaaagaaaccaactcaatcaaagaaagatgggtctacatacaacaaaactgaacaaaatctgcaagaagagtgattcatacatgggctattgaggcaacatgaaatggacattaatcgactaagtaaaaaacagatttcttgaagaattaataaagaacttttgttttgg

SEQ ID NO: 215670 - DNA, 239 bp, Homo sapiens
tgaaagagaagaggatgacaggctggcaaatttattaggtgtgacaggagtatgtctcatcaagttaccgtggtgctggcctgtctccatgaaagatgccagaagccatcatctttgtggctgccctcctaaagtactagttagagagacagcctcttatctggccttatgggtctctgtgtgctgatgaggagccaccccagacccaagtgatgttgaaccccttctgtcgtcttctc

SEQ ID NO: 215671 - DNA, 671 bp, Homo sapiens
caccatggctcacacctgtaatcccagcatattgggatgccaaagcgggcagatcacttgaggccaggagttggagaccagcctgggcaatatgctgaaaccccttctctactaaaagtacaaaaattagccaggtggggaggtgcacgtgtgtagtcccagctactcgcaaggctgaggcagaatcgcttaaacccaggaggtcgaggttgcaatgagccagtgagctgagatggtaccactgcactccagcctgggtgacagtgagactgtctcaaaaaaaaaaaaaaaaaaatgccaaattcttctccctaaaacttacaaagcagattctaaggaaaatacagcaaaagcgaacctgcccccccagcaatgattgatcgactgattttacagtggagccccaggaactcaaccaaagtggagcaggcaggcagacctgggggctgttgttccaggggagcaggggtacagaaactgccccacaggctcggaggctcatgacctggtggggaggacgctctgacttcgtgccatttaccggggttgcttttggagctgagccaacctatgactcttcagaaattttaaaaccaaagaaaatgattaaaaactaaagcaggggctgggcatggtggctcacgcctgtaatcccagcactttgggaggcc

SEQ ID NO: 215672 - DNA, 166 bp, Homo sapiens
atctctgggaaaaaagcaaggtctaatattcaaagcttggcaaacatgaccaagactttttctctttcctttgaattattttagttccctaattttttgtcccatatgccacttaattctttttattttgtattaaaagttgtgctcttgtctcaaccttctttct

SEQ ID NO: 215673 - DNA, 130 bp, Homo sapiens
tcttcagccaccagatgggattcatttgttaagataaacaaatgaaaatacttaaatacttacctaataaacactaaaatttgctgacattctcttattcttttactttcttaatgaacttgctttcact

SEQ ID NO: 215674 - DNA, 447 bp, Homo sapiens
ccagagttagggggtactaaggtaaaaataagacatggtccctggccctcaagaacctcatgtactaatacgggaaaaacaaaaaagtaaatcagctattataatacagagatatggcctgaatgtttttggtatcatagagcaagagtgtctactaggatacacaaaacgcagagaagccctcttgaaagaggactcttggcctgagtcttaaaggaaactcaagagttagccactgaataaaagcaagttagcatgtaaaatagtacaactgtgatatatattaatactatattctttcattcaagaaatatgtcttggctgggcatagtggctcatgcttgtaatcccaggactttggaagggcgaggcagggggatgacttgaggtcaggggttcaagaccagcctgcacaacatggcgaaaccctgtctctactaaaaatac

SEQ ID NO: 215675 - DNA, 583 bp, Homo sapiens
aagccaccctcctgactcacccacaggaagctgccctggccctggagcctgccccgtgagcccctctgcttgctggttcaatggccctccagcagcagtggctgtggcagctgggttctcggcatcttcagacacggattcttgagcagcaggatggggctccatctccctgcgtgcagagcctgccacagatctccctcatccactggcttctgtgctgacttcggatgaagccagtggtgccgcctattgggaaggccccggcctggtgttgtttgtccctggctgcctcctgctctgacaccatcagcatcctgttgccaaggtcatggatcagtgcggtgctcttcagggtgtccggccagctggggtctctgtcctgtattccggcagaggccccaggagaaacagcaaatgcctttgtccattccatacaaatttcatataaatgtgagcagcttctgatcttccgtggcgtattcgtccagttgatggccaaccctgggtacctggacctccaggacctgctgcactgggctgcccctcggctgtgtgtgcactcgccacgtggccctccaggaat

SEQ ID NO: 215676 - DNA, 355 bp, Homo sapiens
ctaaaaatacaagagattatctgggcatagtggtgtgcacctgtaatcccagctactcggaggctgaggcaggagaatcacttgaacctgggaggtggaggttgcagtgagctgagatcttgccactgcactccagagtgggcaacagagtgagactccatctcaaaaaaataaataaataaaataaaaataaaaagagttgttgaagtcttgccttcctcttggagcatcccctcaagagctgtttcaatatctctttcctcacagatatcattagggtgcagcagagttctaaggtactgataaggcttcaaataaaaacctatctgacaaaagagtacagtcttgtgaagtg

SEQ ID NO: 215677 - DNA, 401 bp, Homo sapiens
cacaaatttcttcagggggtgaggaaaatggctgagaaaggtcatgccagaaagagtctatcttctgaattaacagggttccaagaatgacttctgtaaatgcttgacactctagaattggtgtgctgccagtcattaaggattcacaaatactaatgagagccttataaaaattgctatcatgtggtctcagaaaaacgcatggaaacaaaataagagtgatggaccaaattgttgagtgtgtggaatcaagccttgaaagatctgtgatcaaagtgtacaaataaaagtgcaaaaggcagaacactgagaacagagagggccatttagaattcaaagggtgtaactataagtctagaattttgattgggccttctcttgctcaagggtgtcagagagtt

SEQ ID NO: 215678 - DNA, 438 bp, Homo sapiens
agtcagcaagaccacaaacccactgggaagaacaaacaactccagacgtgccacctttaacagctgtaacactgactgcgaaggtctgtggcttcacttctgaagtcagcaagaccacgaacccaccagaaggaagaaactctggacacatctgaacatctgaacaaactccagacacaacatctttaagaactgtaacactcaccacgagggtccgcagcttcattcttgaaagtcagcgagaccaagaacccaccggaaggaaccaattccagacacaatattacctcagaaactccgcttgtgcctcttctcagtcaatcccataccccccgcccccagtgcacacacacatatcaaggcaattgttatggatttctgtcactataaattagatttgtctttcctaaagtttcaattaaatggaataatatacta

SEQ ID NO: 215679 - DNA, 335 bp, Homo sapiens
agaatcgcttgaaccatcaggcagaggttgcagtgagccgagatcgtgccattgcactccagcctgggcgacgagagagactccgtctcaaaaacaacaaaaacaaaaacgtgaaattcacacagtgagctccaacttcgtggtggtcaccagacggctgaatgggcccccttccgtgcagtgcagtatttaccaaattcctaagagcagggctggggcttagatgtgtcttaccgtgcccggcccagggctctgcacacagtaagtgctcaatacgtgcttgcacgtcagtgtgattcctaggtgagtgttccatagccccaaaaacacccaag

SEQ ID NO: 215680 - DNA, 175 bp, Homo sapiens
tccccttttcctgcaatgggtgatgcatgtagttactctctgccccatctcaccgagttgagtggttgagagcaaggacttgggagtctgacagcttgaattggactctgggttccaccactgacttgggcaagccagtgaacctctccataccccagtgtcttcatcattagaa

SEQ ID NO: 215681 - DNA, 215 bp, Homo sapiens
tagtgataggcactaatggacagtccctctggtgtggaataagagcctggcatgggagatgtagtaaacatcagagatgcactctatgttctcggctcttgtagcagccttgaactgagtttcattctagtctagactatgaggcttgaaattcctgatgttttatccacaggagccaaagctcaccaaatctagggttccttgaggagtggaga

SEQ ID NO: 215682 - DNA, 338 bp, Homo sapiens
cttatgtaactttccaggaatgctgaaagactttccgggctccgtgaggttgggaatgggggaaaggcagagggggctgaaggtgggggttagggcagactcgagggacaaggaaaaaatccactttttccatacatcactacattggctgtttgtgacaagaagttattgcaattaagatacaagccggatgtgtgggctaaaaaacctcagctgatatcacaagcatttattgataatgaaaacttggaggaagagatctggaaaattgttgtctttagtggtttcctatgcaagagaacaaaccatatggattaataaaaaagtgctctacctta

SEQ ID NO: 215683 - DNA, 351 bp, Homo sapiens
agttagaggatagaactagaacgcatctgaaatcctactttgctttagtgagacacaccacgagcaggcctcctattctatctgaggagggcatggtagttcggaagaggccggcaggagcacccagagcaactgagaggcaagtgcagggctatgagaaacagtaggaggacctgggattacttataggctggagaagcagcagccaggggatttaagtcttcgggtacagaaaaggatgaggggtgatcaattgcttctcacctccatggagggcaaggcattagtaacaggatttcagtgacaatacagggattctgccctagctatttggatcaacttcttgacaaa

SEQ ID NO: 215684 - DNA, 598 bp, Homo sapiens
acagcgtcttctgtaactttaagatttaacatttcagattattttccactggggctcccatcgatgctgagttctggctacttttttcccctgatgctgaaaggttcgattcttccatctatccatcaacaaatcacattgaatgacggtgctcagtgacccaggatgccactggagacaaaacacactatacatattttctggtctccctggaaaattagtgcaaacactttcatcactgcggagaagggaaatatgcgcggagctgtgaaaatctgctttgttttttgtttttctaagaggagatttccccctccttcaaacagtgaaatttatattgttctttgtctgcaaattaaccagttaagtagaattcctgtatgtctctttcactttctgcaagccaaggcccctctttctctccaccctgtattcatacatagtccaggatcaccccctgtccccctccaatgctgcttgaaatttcattccattttcgtcctgacttgttcaaagtaacatttaaaatattttaattcaaattcttatctcatccatcctgtttaagttccattttaaagaatcttcttttcttatg

SEQ ID NO: 215685 - DNA, 564 bp, Homo sapiens
gatgttaaatcagctaatcttgttttcacagaattgatttacattgctttaatgacttctaattaattcagtgttactctttcactctagaatatttaatgtattgtttcttaagtattataaaatgtatatatagcagactcaagccatatttctgtgatacagcacattcagaataacatgtaagaatttaaaaatgagaggaaagaaatgcagtgtggcacagtaagatttctcttttaaaatcaaacttttaaaaaaaatctggtttccttaatagtttcctttttaatttctcagtattctggcagttgtcagatcatggcgttattcctgtcggtgggccatggaacagggctgctatagcttttgcactttaagttatcaggctgttggccaacttctctttcttttaaaatagtgaagaacatagctacctgctgtgttcttttcttctgggctcatttctgttcactagttcaaatacaaacagtaggtatagtgaatgagatgcttttggtgactttatccttagagttaatcatgttgaagactcctacccaa

SEQ ID NO: 215686 - DNA, 305 bp, Homo sapiens
gagaggatgaagccagtgcatggactgcttagaggccagcagcttggaggctgtgttctgaggaggtgaaggtagaaatgaacacatattgaatgcctacaatgagtcaggctgtgctggggttttttggtttttgttttttgaatctgaggaaatggaaaatgaaagaagttccccctttaggtgctgggccccaacaggttcagggtactggatgaacagagagggcaaaagcagggcatgtccacactagagctgagaaggggcagagaggaggggtttctccaggggcagtgcactggaga

SEQ ID NO: 215687 - DNA, 409 bp, Homo sapiens
tacctactaatatgtaggtgctatatttggaacaagggctatagagataaatgaagcacggtccctaacttgaagcattcagtctagcagaaaaatcctaagaaattacgctataatactaaagtgctgaatcaggaagagataatgtgttaaggagtcaggaaagtgaccttttgagctcagcttaaaaggtatgtggagtttgacaagtatataaggttaagaaagaattttcaggcagaggaagcaggatgaagaaaggaactaagacattaaaaagagcatggagtgcttgggaaaggaataaatgcttagctggactgaggggcccagtgcagggaagaaaggagtgagtggcaaaaaattcagtctagccaggcatggtggctcatgcctgcaatcctagcac

SEQ ID NO: 215688 - DNA, 242 bp, Homo sapiens
catttctagtcacttcagttctggccaaactgttatcaactctagtttctgagggaccgccagcccaggattcctattggggtcacctttgtgcctccctatcttaagagcacacttgggcgggtcggggcgggacgtgctgggtgtaggtgactcaacaccggacagttttgcttccagaggctgacacgctcctgcgcggtagttgttaaagggttgggacacgaagatactcttcgcct

SEQ ID NO: 215689 - DNA, 440 bp, Homo sapiens
gtactgggatttcaggcatgagctatcacgcatggccttaagttgtacattttcaattggtgacttgcacggcatgtgaattatatctcaataaagctgctactttttaaaaactacagtctataacttcctaactactaaccaatatctgacatattattctacatcaccttataactccatataatgagaaaagcattgaattcagtgataaaaccagattactggcaatcctaaaaccgtagacaagcaacaagttctgagcttcaatttccttgtaggggaaaggggagtcctctctggtacaccatcttatttttatcccaataacagagttgcatcctagagtaaattgtgtttattctaaaatcagtttatgtctgttgtatttactataattacatagtttagttgcatattacatcaaaaatgagtgcaaa

SEQ ID NO: 215690 - DNA, 447 bp, Homo sapiens
ggaatttgcctaatgagaaccaggaaacctcatttgcccttgctggctacatcagtgagcctctaaactaaagtaggagggagaaaaaatacagtggtccctcagtatctatggggtattggttccaggacccccatagataaccaaatctgcagatgctgaagataaaatggtgtcgtatttgtatatcacctgcacatacccttccatatactttgtcatctctgtattacttatgatacctaatataatgcaaatgctatgtaaatagttgataacactgtattgttttttatttgtatctttttttttaatttttttttttatctatggttggttgaatccgttaatgcaaaacccacagatatggaggaccaactatacttgataaacctggaaggctgattgttttggagaaaagtaggtattaagatgaaagggagaatg

SEQ ID NO: 215691 - DNA, 453 bp, Homo sapiens
gaccagtcccccaggcatctatctgtctccctcagtacatagcattcctaatgcagactggtagaattgggtaattggaattatgtagagctggaattttgtctgttaggtgagatagcagggcaagggagttgagtatatgggcaggatggctgctgagtgattgaccatggaatctaagctggataagcagtaaagtgaagacaggtgaggatagggttaagggctgctgttttgcgattttgagctgcctgtacttacatgtttgtctcccacacaagttcataaactcttcaaaaaaggatctttttttattcatcattgttatctatagcatcagcataatatctaactcataatgagctctccataaattattgttgaattgaataatggcttaaaactctgttccttaaagctaatagctatactcacctgcaactttttctaggc

SEQ ID NO: 215692 - DNA, 527 bp, Homo sapiens
ccaaagggaaacctatatttatgtaactgtatactgaattctgacaaaataaaaaaagatacatcattacgaaaatgcgcattttcgtaatgaagtatagaggagtccctgattaacccctgaattgaaagaagttatatatgacgttattgggataactggagaaatttgaatatggactgggtatcagataattacattgtaccaatgttaagttatcagagtgtgataactgtattatggttcactagaataatctcattgttcttaggcaataaatgctgacagttttaggctcacaaaacaacttacacagtctcatgtttattacttcatgcctttgaacatgctattatatctacacagaacatctgtctcactttcttcaccaagctagctcttacccttccttcaaaacggagaactgagaatcctttcctgacccatgtggcataaactaggtgcccctctgtgtcccagtggtctgtaatacatataccaataaattctttacaatgttatattgt

SEQ ID NO: 215693 - DNA, 422 bp, Homo sapiens
tagaaaagattagcatttgaactggtagactgaataaagaagactgtcctcaccaatacagctggacattatccaatccactgagggcctgaacaaaatgcagaggaagggcaagtttgctctctgagctaatgcattcatcctctcttgcccttagacattggctctccaggttcttgggcctttgggtttggtctaaaactctaccatccactttcctgggcatccaacttgcagatggcacattgtgggacttctcagcctccagaatcacatgagccagttcctaataataaatatctttgggtgtatatatacatatatgtctgtgtatgtgtgtgtctatgtgtgtgtgtgtgtacaaaagcacacatacacacaaaaagatatacgtgtgtatatatacatatacacatatacac

SEQ ID NO: 215694 - DNA, 524 bp, Homo sapiens
tcctgggttcaagcgattctcctgcctcagcctcctaagtagctgagactaaaggcacatgccatcatgcccagctaatttttgtatttttagtagagacagggttttgccacattggccaggctggtcttgaacttctgacctcaggtgatctgcctgcctcggcctctcaaagtgcggggattacaggcatgagccactgcacctggcctaaacccctaattttagtaggtcagggaaatagatttgaaactgttctcctatctccttggctgtagcaacagactaaagccttcttcactgacaatacttattgtctcagtgattggctttctgtgctgggagtagtgggacttagaccaaagccctattttggtaacaatttcagtcatgtgagcccctgggtggagaatccagctatactgtacctgacttaaactgtgagataataaagatgtgtcgttttaatctaatttgtggtaatgtattacacagaaataaaataagtatagcctgaaactaat

SEQ ID NO: 215695 - DNA, 555 bp, Homo sapiens
gtgatactcaagtgatccacccaaagtacaggcatgagccaccgtacctggtcctggactaatagtattttatattgatccgtgtgcacattaaagtttgggaagtactgctgctggcatatgtataaaatgatacattggctgggtgtggcatgggatttctttttggggtgatgaaaatgttcagaaattagtgttgatagatgcacaattctgtgaatatacaaaaaaaccactgaattatgtcttttttttttttgagacagagtctcactctgtcacccaggctggagcgcggtggcccgattatgtctcacttcaggctcacttcagtgacatcctgggctcaagcgatcctcccaccttagccttccaagtagctgggactgcaggcacgcaccaccacacccagctactttttgtagagacggggtttcgccatgttgcctaggctggtctcgaattcctgggcttaggggatcttcccgcctcggcctcccagggtgttgggattacaggcatgagccactgtgcctggctgaattgtatacttac

SEQ ID NO: 215696 - DNA, 440 bp, Homo sapiens
ggtgctgcagggtttcacatggagttcacagttcgcatttcatcctgagtgcagggaaagccatgagagcgttttaggggagtgacatacttgggtttctagttgaacgatggcaatcactcatgttttctgaccagcacacgcttctgcccactacttcaccctcactgtcatcccctgtggtaggcactctgtcattatccccattttccagatgggaaaactgtagctaataaagatgaagtgcctcgcccaaggcgtcactgctagaagggatggagcccacgctctttccctctttgctgcagaatgttccctctgagccgtgttgagacaggcaagatgggaagaagtagaaggatttgagatagataacttggaaccacgaggctgcttgggtatgaggcagggggaagagaggcgacagggcagggcccagg

SEQ ID NO: 215697 - DNA, 366 bp, Homo sapiens
tgcagtatatcgagggattgtgaaaccatcaccacaatctaattttaagactttttccttctgccacaagaaaccctgtgccccttagtggtcacccactcttccctccacttgccctatccctaaataatctctcatctcctttctgtcagtataatttgcgtatcctgagcttttcacagaagtggaattttgcagtgtggagtcttgggcgtctggcttctcctgcccggcacagtgtcttctgggtttattgtcttgtggcacatgtcagtatcccatttcctctggtggctgaatagtatcccctgtgtgaatacgccacgtcttgtttcccccttcgtccatggatgcacagacacggag

SEQ ID NO: 215698 - DNA, 544 bp, Homo sapiens
gttagctgtgggtttgtcatatgtggcttttatttgtagtgaggtacatactttctatacataatgtattgtttttatcatgaagggatatttaattttgtcaaatgccttttcttcatctattgaaatgatcatacggtttttgtccttcattccattagtgttctgtgtcacatttattgattggcatatgttgagccattcttgcatccctgggatgagttccacttgatcatagtgaataatctttttaatgtgctattgaattctgtttgctagtattttgttgatgatttttgcatttgtgttcatcagggatattcttttttaattgtgtccttgcctggctttgctatcagggtaatgctatccttataaaatgagtttagaaatattgtctcctcttcagttgtgccgactagtttgaggaaaattggcattcattctttaaatgtttggtagaattcagcagtgaagccatcaagtcctgggcttttctttgatgcgagatttttattactgctttgatttcattactcactat

SEQ ID NO: 215699 - DNA, 700 bp, Homo sapiens
catgatttctcccagatcacagtggtagaatttctagtctattatcaattacagcctcgttttatataaacttgaggtgaaacctctagtatagtttcctttagtaaaacaacacatacttgatcattcaatttgtgactggttttttcagattaataacataggatagaaatgtaagttttatttttaaagtcaccattgtgatgaaaatgtgtacgtctgaaaaatgtgattatattatacttagttgttatatagtgtataatatatttagtggctgctgtaactaagatatttgcaataaatgtgtaaaccactgataattagaaatcatttgttaaaagtgatgtttaaatgcagagaaagcatttttaaattcaactcagattgataacaggtttccttcacacataagaattattttttatctgatatttttaaatcaggtacagcttatatttttacctagaatagcctagagaagaaagtatatgggaactctacttaatgcacgatttttctataaacctaaaaatattctaaaaattgtggtgttttttttcctagtcctttgcaaaatacgggctaattttaacgtgcctgccctaaagcccctagatttcaaggctaccgggctttcaccttcgcttataaacctccattcctagaacagcgcggctcgattgttcgtcttttgcct

SEQ ID NO: 215700 - DNA, 506 bp, Homo sapiens
aaacctatttccttcaatgatacagcccctagagcacaatggatgctcagtagatgctaattaccataattatcattatttggagttgaaaaaatgagccttggggtaatataattattataactataattaataattatactcttctcattacattttggaggtgcagaaaccctggtatacttatctctaagtttagtccttttcccactgtacacagcggcttgtcccactgtgctgaaaactaccattcccctatcttctatagtaatagaaattctagatgattgtatgaccaccagctaagattacatttcccaggcatccttgaggcaagatgtggccatgtgactagtttggctggtcgaatgcgcgtggaagtggtatttgaagcttcctggttaggtatttacaaggaaagggcctgctttcccttgtccctttccctcttgggttgactgagtggattttgacatagaaggatataaacttctatcttgtgtaaa

SEQ ID NO: 215701 - DNA, 203 bp, Homo sapiens
gagaagaggtctcactatgttgcctaggctggtcttgaactcctgagctcaagtgatcttcctaccttggccttcccaaatgctgggtctataggtgtgagccatcatgcccggcttgagtatggagatttatacaggatctgagagcagtaaacaatagcataatatttagacactcacatacccttctatcagctgtaccc

SEQ ID NO: 215702 - DNA, 318 bp, Homo sapiens
catggtcactcatatttggttcagaataaatcccttcaaatattttacagagtttgactcttttcattgacacctatttggcccttctttgataaattacaagttcagtagaggccacccaaggataacccacagaagaagttcttcaatttctgtatgaactattcgtaatccatcttaacaggacatttacaaagtttggggcacgcatcacaatttgcatttggaaagtatttgaataatgttcacaaggtaaaattcattgattttggtgaactaattgtggacaacatgttaataaaatttcaactaattcta

SEQ ID NO: 215703 - DNA, 264 bp, Homo sapiens
gaagtcacaagagaagaaggatgcggtcacaaacttaaccagtgctcttatttttcccttctcagggaaaaacaccagaagaagctggggttttatattcattggatggaaacagatatttctcctgggaattctcccaaccaaatagcccttttctattaggctgtgtctgtacatccacaagaggaaagtctataggactgattagttttcacaatcccatttaaataaaaaaaagatctttagttgggcatttaggagcaa

SEQ ID NO: 215704 - DNA, 313 bp, Homo sapiens
gggccaggaggacaccaagcagcctggccaagcaaactacagaactttccctttaaggaggtggagaagcctggggataacaaacggagaaagaagatagtgaataactggtccatgaatgacggaagatgggggagatccaaccagaaaacagtccacagaagtgagtcactgaaggagaaaagtgaccttgctaagaacacgtgagaagaaagggaagcgggtatccatcctctcaaacaggaggggctctaagaaaaggggactgtgcaagtgccccacacacaacctggacatctgcaacagccgacca

SEQ ID NO: 215705 - DNA, 647 bp, Homo sapiens
atgagggacgagaactgtcaaaccaaggtctcttttaaactgtgcttatttatggcttgctgtttgatttggtgctttttcctttaatcatttggtgccaggttttcctatcagtcctttcatgtcctatatggttggccaacacctacaagggggaggttggtcacctaagtaatctcatattggtgaaaaagccaaggtatctgaaaggggttttgtaagaaaaattttaggatcggactataccaggaaacagcttcctgcctagctataggttgttaatttgtctgaatattttcaaaccaggatgcttttggtgtgttggataggcttttgagtagggagagatactatcttgaattgtgctaataatttaactcaacagcatctaacaaaggcagtcttattcttggatcatgtgtacagatcatagtctgaagtggaataagcagaatgttgttctcagtgtgagatgttatttagaacacactggaaacattgtgatgtcattgtgcactgaggcagggaaatgttagtctacattttatggaatatgtacttcaatgtttgcattgtacctggagtgataaaaagcaaaacaggtactcaagacctgtctgggctttggcctttgggcacattccccc

SEQ ID NO: 215706 - DNA, 478 bp, Homo sapiens
acaataactaggggaatttcccccaagggagcacgcttttggatgtctctctccagtcctaacgattggttctttgatcatttgacatttgcccacctgcttcccaggtttaagtctcttagcaatgaaaagagaaggcaacaccagtgaaagtcaaaactaagatatactcacattctttgtttcacagggttaaggtgattttatgaagctaaaactcaagatgcccagtttagtcaaatctgatgtaatttgctactttagttaccaaaataattgaatttccaacgaagcacactgtcatttgacctgtattatcacccacaagaaacagcaagttattttggactatttgttataactgtatttttatgatttttcctgattgaaaaagtaatatgtgtagtctaaaaggcaggaataatgaaatacgaaagttggaaaataaaaatctcctctgctaagtagccaccttcta

SEQ ID NO: 215707 - DNA, 397 bp, Homo sapiens
tagtgacttaacacaaacctattattttacagctctataggtcagaagtctgcagcgagtctcatgaggctaaaatcaaggtgtccacagcagtcattattctacccaccagagacacagaagcttgtcctggcaagaatcctatctgtaagctctacagaactagcatttcctcaatttccatctgccaagatgctaacagagaacacatcaagtaggtggaacacacaagggactgaccttgacttaaagcaagtatggcaatctaagatctctgccatgacatgactatagtttatgaaccatttacaatggtagtaatatcacattattcattgtctgtataccatgtgccccagatattaaagccaattgatgcatactgtctttcactcaa

SEQ ID NO: 215708 - DNA, 429 bp, Homo sapiens
agagtttagataaatagatttaatacttcccttctgcatcttaatcacgagtttagcttttagggaaagtggtcaagcagtattttttatgttgttctcggtacgttttcataatgaaatcttcaacttcccatggcatttctgaacttgagagtctgcttgactgagatattttttgggctttttacaaagctgttaatattatctttaaagtagttcaagcgttttagtgggtttcataatttgagggacgactaagtgtccagggatgttaattctgtggttcttttaaggttaacatattaccattgtgatccctttttttaatgcaaagatgtcacatctttattgagataatttgcatgccataaaaatgagcttcttaaataacaatgatttttcagtaaatttacttgtttatgaaagaat

SEQ ID NO: 215709 - DNA, 399 bp, Homo sapiens
agccgagatccgtacttttgcactccagcctgggcaataagaggaaaaaaaaaattgagaggtatgtcagtgcatacaacagacagtgcttttgtctatggcttttggacttttggactgtgattcacaggtacctatctctgccttatacatgtgtgtatataaaactgaaattagtttcatgaagcaatatttgcctttcatgtgatgcacttgtattacattcattaaaaaaggatatggctcactaaatttattttacgatccacaaactgattgtgacctgcagtttgaaaacccctgattttagatactgatctattggagtaaagggaagatggagagatttggattccagtagatcttggttcgtctggcttaacagttttaggtaatttc

SEQ ID NO: 215710 - DNA, 370 bp, Homo sapiens
tggtgagaaagttatgagaggtaggaaagaagatactgaaacactgaaggtggaagccgtttggacacagtaaaaggaaagcctcagataagcatgagggaaaggaaagaacgaatttcagagtgtttgcatgcctatggtaggcacaggatgcaatgagacacgcatgagagagtgcttagagggctccccccatcctctctgggcctccatttccgcatccctaaaaagttaatttttttttcctagaataaaacatgagagatattcaacttgaagcctaggaaggccactgtaaaatgttacaaattttaaagttagtggcaaaaataatacatgtgtgataattcaagcaaagacctatttaaaa

SEQ ID NO: 215711 - DNA, 105 bp, Homo sapiens
ttttgtttcttattcctttgtggctaaaagtatgttcccggcttggtgtggtggctcacacttacaatgctggcactttaggatgccaaggcaggaggatcactt

SEQ ID NO: 215712 - DNA, 413 bp, Homo sapiens
caggtggccgctggcaatgccactgactagccacacaggcagcagaggccctgtagggaccacagttgatctagacctctggggactcggagagcacacaccagcttctaaaacgcaggcagggacatgtgaggtttctacatgtgcattccgtgtgtcatgtcactttgggggtggtgacagggaaagtggaaggaaaccagccctcagcatggccaagtcccccgttagctgagccccaaactagagattggaagaaagtcttgattgaaaaaccatttcccagccaggcgcgttggctcatgcctataatcccagcactttgggaggtcgaggcgggtggatcacctgaggtcaggagttcaagaccagcctggccaacagggagaaaccccgtctctactaaaaatacc

SEQ ID NO: 215713 - DNA, 440 bp, Homo sapiens
tttgaaatctgtgggtggttctggaaccaatctcccacagatactgagggacaactactttatttgaattgttgtttgtcatcacaaatttcctcaagcttgatcccacccttgattccacaagcttgattccccatgaaatataagtaagatttctgttccttcaacaatggatgaaagtgcttctttcttcacaatatagttagatcgaacttttgatttttgagaatctgagaggtgaaagttcggtctcatagttttaatttgccttcctattttaagtgaagcaatcaatcttttaatgttgatgaacctttttgtagtttttgtgtgaactagtcattccctcattatgtcctttgcccattcttttactggtggtggtcttttacttacttcatatgttaagtaattaatttggtctgggtctgcgatctatc

SEQ ID NO: 215714 - DNA, 374 bp, Homo sapiens
ccataaacataagtaatgttttgctttgataatatgcagcaccacaccattttttcttaccctgcttagattgggcaggcacaatcgtagctactcaatggttatgtgttggctatcaaataggtctctgctgtaagagtatgattaggaagctggggctcacagatacgatcaaatgcatctagtgaaactattaatcacaattttcattttaagataaaaaagaacactggctgagagaggtaagtggtttgtcaaaagtcatgtaaccactctgtggcagatccaccaactgaactcagatcaaattccaaatgccaagctctttaccttatttcatattgcataagagaacttcagacaaagtaatttgc

SEQ ID NO: 215715 - DNA, 599 bp, Homo sapiens
cgcagtggctcacgcttgtaatcccagcactttgggaggcctaggcgggcggatcacgaggtcaggagatcgagaccatcctggctaacacggtgaaaccccgtctctactaaaaatacaaaaaaattagccaggcgtggtggcgggcgcttgtagtcccagctactcgggggctgaggcaggagaatggcgtgaacccgggaggcggagcttgcagtgagccgagattgcgccactgcactcccgcctgggcgacagagcgacactccgcctcaaaaaaatttgttgcttatgctttaaagtatatgtaagtacattcttgctttaaagcatatctaaatgtgttatttaaaatgaatgcagggctttctcaaagtaagggttaaggagctggacaagggctgttggttagttcaaagccacctggactccagaaactcctgattataaaagaaaggccaggagtcaaactcacatatagtataaatatcacaaattcacatataagagaaaagaggctttcctatttgaaacacaaatgtcaataaacttttctgatggaacaaattgtacaaggtaggccaacagactactatttt

SEQ ID NO: 215716 - DNA, 903 bp, Homo sapiens
cagagatttttaaaaaaacatttatttcaaggattcttaattaagttataggtattgttacacatgaatcaaggacttaaaagaaacaatactgcataatatccagtgtaatagtaatggtggcaaaataaatagtttgaatattaacatcaattcaaattgctgagtttccttgattactggacagacttggttccctgaagtctaaattccttagattatcacacaactcacacaaggcctttacgacttgcctacaatctaccactcagtaagacttttcttttactgtcctcccgtgctgccgccactcagaattttataatgttccttaaaattttcattctctttcatcatcacatcatgactttgtatgttgctaatttccttggtctctttttcttcctgatatactccttcatacttgaagtatcatctcacctgaaaaacttttttttctttttctttttttgagacagggtcttactctgttgtccaggcgggagtacagtggcatgatcatagcttgctgcaaccctgaactcctggactcaagccaattctcccaccttaggctccagagtagctgggaccacaggcatatgtcaccatgcttggctaatttttttttctctatttttagtggaaacaaggtctcgctatggtatccaggctggtgtcgaactcctgtgctcaagcgaccctctcacattggtctcccaaagtactgagattacatgaataagtcaccatggccagtccctgagaggtttttctaactctcccaaacaattatttactggcaacacagcaataaacaaaaacaaacaagaattcccacttttgcaaaacttacaatctatttttagtggactgtatgtttttaggtcagcctcctcaact

SEQ ID NO: 215717 - DNA, 850 bp, Homo sapiens
cagagatttttaaaaaaacatttatttcaaggattcttaattaagttataggtattgttacacatgaatcaaggacttaaaagaaacaatactgcataatatccagtgtaatagtaatggtggcaaaataaatagtttgaatattaacatcaattcaaattgctgagtttccttgattactggacagacttggttccctgaagtctaaattccttagattatcacacaacttttactgtcctcccgtgctgccgccactcagaattttataatgttccttaaaattttcattctctttcatcatcacatcatgactttgtatgttgctaatttccttggtctctttttcttcctgatatactccttcatacttgaagtatcatctcacctgaaaaacttttttttctttttctttttttgagacagggtcttactctgttgtccaggcgggagtacagtggcatgatcatagcttgctgcaaccctgaactcctggactcaagccaattctcccaccttaggctccagagtagctgggaccacaggcatatgtcaccatgcttggctaatttttttttctctatttttagtggaaacaaggtctcgctatggtatccaggctggtgtcgaactcctgtgctcaagcgaccctctcacattggtctcccaaagtactgagattacatgaataagtcaccatggccagtccctgagaggtttttctaactctcccaaacaattatttactggcaacacagcaataaacaaaaacaaacaagaattcccacttttgcaaaacttacaatctatttttagtggactgtatgtttttaggtcagcctcctcaact

SEQ ID NO: 215718 - DNA, 111 bp, Homo sapiens
actctcccacaggacctaaatatactcatcatcaggcctcactgagactcattctacctcaccctttcccaaggggctgctcatacttctagtcccatcacactctccctc

SEQ ID NO: 215719 - DNA, 773 bp, Homo sapiens
caaccattagtagtcatctacaagacagccacaaattatgtttctccctgctctgatcactctggtcaacattaaactagctgccgacggatgagagacaggaggcgtggaactaagtttatctcagagaaaagacatctatcctccactgatcatctctgtaggtctccacacatcaagctctgcttaaggaagctacacaagacctttgcccttgtatgggcgaggaagatggggtacaagggtcgggggcattgttcatgaaggaaggtaagtgatagtttcctgctcaccccttcgttttaggggtcaatctcatatgtagacggcaaatgaagttttttccaagtctgaagtaaacaaacagagatgagaggtaccagtgaacttttgtaaacagactaactccctattgcttgactgtacgcataacctgatttgataaaatgctgaaaagaacacactctatcttccttttgcctctatccagaatagacaaattggggtgttttgaaaatgttcatgcctggccttgttactcatagctttaccttctcagaggttaatgacaaagtgatgttcaggccagtgactctgacctcaaaatatgttgccatcattaataatgatttgcaaagagtagaacatcacaattcgtgatggagggcgtgatacaggcacttaggtaaagtgtactcagggtggaaaaacctagacttgactaattactggcaaagagatgctaggaacttgtccatctttactcatacagt

SEQ ID NO: 215720 - DNA, 233 bp, Homo sapiens
gaatttccactaggatgcccagattagttgatagacacattccaaataaggccccgtatgaactggtgtggacagagagccagtgtgatttggtggttattattaatcagacttcactggtagtcataggctgggaagccttgaaaaaattgtttacattagtctgtcttgtgaaagcttcttcaaagatgctctgtcagcatgttagctttgtattacagtggaattcttta

SEQ ID NO: 215721 - DNA, 609 bp, Homo sapiens
tttcctgactagaggcagggattggaattatgtggccacagccaaggaatgcccagggctaccagaaactggaagaagcaataaaggatcctctcctagaggctttacagggagcacggccctgctgacaaattgattgcagacttgcagcatacagaactgtaggaaataagtttctgttgttttaagccacccagtttgtggcattttgttatggtggtcctaggaaagtaacacaatgggttttgcacactattatagttacacctaggtattttattttttggttttgagttttttctctgtttcctttttgctgttgttcctgtaacttatggggttctccattatattttcctagctgtatgcatataagttacgtttttctttttactaattttatattccattacacaacttaattcttttactgcttaaagtaattttactgtaagttcagttgactcttggatttttcaggtgtaaaattagtcatctggaaaaggatttttttttttgagacagagtctcgttctgttgcccaggctggagtgcgatggcacgatcttggctcactgcaacctcagcctcacaagctcaagcgattct

SEQ ID NO: 215722 - DNA, 453 bp, Homo sapiens
caacttttttttctaatgactttttaatacttcttcttatctgagtaaaaaccaggaagtgggaagcaaatgtacaaaaaccagcaatacacacacacgtgtgtgtgtattttcatgtacatatgaatgtgtatgtgggtgataggaagaagagaggatgcatagagaagatgatctcgatcaagtttgatgtaaatgtaatagcaaattagagtacattcttgtcttaatcttttctgtaataaagataaaatggggcattatgttcatatgattgaacaaaagtggatgatttcaacctttttcttctcagccattaaaagaagaatttgaaagaaacagtctttgcatacatatacagagagtttgtcagcctttcttcagacacagccagccacagtcagactaaacattcgaagacgttacatattacgtccacagtggaagtatttg

SEQ ID NO: 215723 - DNA, 451 bp, Homo sapiens
aaggagagctcttcagcagctggaggagggagcacattagaaagagcccctctggtaagattgggggtaggaggccagatgagaacctctgcagttgttctccgtgctggtggagatggaaggaagggatgaattcaagtattgtttaagagagaaaaatttctggccaggcttggtggcccacctgtgtaatcccagcacgttggaaggccgaggcgggaggatcacttgagcccaggagtttgagactagcctggccaacaaggcgagaccccttctcaacaaaaaatttaaaaattagcctcgtgtgatgcgcacctgtggtgccagctactcaggaggctgaggtaggagactgcttgagcctgagtggttgaggctggagtgagctgtgatcacgccactgcactccagcctgggtgacatagacagaacctgtctctaaataaat

SEQ ID NO: 215724 - DNA, 517 bp, Homo sapiens
tctgttacgtaaatacaacttatttaaatgggaaaaccgcaacaaagaaagaactgtggtgttgggacgggcttccactccacctttgtgtttcggctcattcccttcttccaaccgaagagccacttttgacctgacttaagcagattttcaaagctgtgacaaacactattaattcagaaaattagtcctgacttacctgtttttcaattaacaggaactgagctcatttggattccgttcagacttgtagaccttttgctgagaacagagagacacagcaacactgctggaatgaaaacggctaaggtttattagttcactaggaaatgttttccgagtgagtgtatggtgtgaaaaggcccaattttgataatggatgtgcctctctgagcttttaattccatgtttaattgggcacaaaattcaggctctcagatttagtgtaggtgctggccagaataatcaaaccagcagtaaaatgaatggagtatggcgagacttccagctttgattc

SEQ ID NO: 215725 - DNA, 400 bp, Homo sapiens
gccagggactttcccctgggtggcacgctggggagtggtgtcagagccaggatttgaacctggactctctgaccttgagacccctaaccattcccatcccaaaggagacaaaggagatcagtctcacggaggggacactgaggatggccccagggctcgggagtgactatggttccacatacagacgagggaagaggcaggatccccgggtcactgttgggggagcactggtgtgggaagcagatggaggggggccatacccaggggccactcggtgggcccactgacctgtgaacctggagaagaggggcatctgggtgggagctgaagggccgtgggtcagccagcacagggcacacccgaactgggtgtcccctcgtgggctcccgggacctggcac

SEQ ID NO: 215726 - DNA, 428 bp, Homo sapiens
aggagatagtatcagatcccacaggtttgatcctacaagactgcccaacttcagatgccgactgcaaaccccaggctgtggcctgatcagctggctataaattggacttccaatgacccccaccttgaattctattaatttgctggagcagctcacagaacttggggaaacactttatttacctctactcatttattataaagaaaggatacaaagagccagatggaagagatgcataaaggaagatgctgcaacccaccgagaacaacattagactatactatgcccacattaattactttccccctcatcaccttagaaaatactttcatttttcagtattgtgtggacacctgtgagctggttattttgaaaaaggaaaaacccaaccaattaaaatggactgctctattaaagaacataacata

SEQ ID NO: 215727 - DNA, 545 bp, Homo sapiens
cgttgagtacagaaaaaatggaagcagcaagaaagagtagttcacagagctgccaaaagaggccactgtgaagataagatgaaggcaaaatataataataatcagatttctttaggcatcaaaaagattataagtatgacaccggaaaaatagttctttctgcaaatcctcttcagtggtgtggtttaatgaaaactctgtaatctcctttccaagaggaccataattttcttgaattctaggaagctgaagataaaaatccttaacgatgtatccttatactatctacaacatacaggactcagggacacccacacagggagaatctcatgtgaagcctgaaggtatgctgccataaggcaaggaactgcaagcaactaagagacagacctggaacagatccttgcctagagccatcagagggaacacggccctgccgacgctgggatctcagacttgcagcctccagaatgactaatggcattttaaatgagatgtgaaatttggactttactactgcagacctttggctatctagtcaaaga

SEQ ID NO: 215728 - DNA, 600 bp, Homo sapiens
gtagctgggggagggggcaggctgggggtgttgtcgtacaaaggaagctgctcaatgaggaagctcaggagagctggagagctgatgctaccagatcagcccacaatcttgatgggatgggagttgatgagtaattgctccaggcttcctgtgcttctgtggggcacctctgagttttattctgcacagtttctcagagtcccttgtgggattgagtgctagttctcactagtatgcagttactattattaatgcatagttcatcggccttcctcttttctgtttcatttttctcactcccttacttctttctcttatgagcacctctgaggtaaattaatctgcacccaagtccttgtttctagctccacttttgggggaatgcaaatgtaaacagtaaatgtgtttggacttgtgtgcacacactggtgatgattatcaatgagaatgtctctgttcttgaatgttcatcattacgttatatgtttccaaatgggtttttctatctactttggagggtttgactaacgtattactttggtgtttctatgctgtgttcaccccttcccattttcaaatatattttaaaattctttaaaa

SEQ ID NO: 215729 - DNA, 147 bp, Homo sapiens
cctaacttccacaatactgttctaaaactggaactgttctattggtatactggcagataaattgaaaccaaatgttccaccttgaattgcctctggatcaaggctaagatcttcatcaatatcatttgaagagaactgagcaatcat

SEQ ID NO: 215730 - DNA, 601 bp, Homo sapiens
tatatacatgtatcagtatttaagtgccaaatataatctttcaaaaaccacacacacacaaagatatttaaagaaaatctaagaccctaagaccctagggatttcagactttccatttgcctctttatctttgctccattactcaaattgggagtgtgagagtgtatcatttaaacatgagcccttatccctaccagtgaataaggaaaggccttcccccagtaaatatccattctctccattctttctttttactccaatgcttcttaaatggcaaatggcaggcatcttttggttggctgcttcatgctcacagtgttttaaaaggcaaggtaacaagataggttttaggcttgggtgcaatagaaatgcttttgtttcacatccagatctcaagcatttcatgtaccaccagatgtaaccatttgcatttatgacccctggtttcagctgtattttcttctcctagtttcttaaatggcagaaaatggccttatttcaatctagagcagcactattcagtagttttcaacagatacatatctaaatgcaaatcaaatatgtaattttaaattttctagtagctacattttaaaaagta

SEQ ID NO: 215731 - DNA, 1231 bp, Homo sapiens
ctaatacttatttcaaatccagtaagttacctttggagcctatgtacattattgcagtttattataaaggcaagtacattattgaggtttattataactagttaataaaagacgcacaccggcaacttcactgtggtagctttgtagttaataatcttctacatcagcattttaagtgacagactggaggcctgaacatgacttagataggagtgaatttgtatttttgtggagattgggacatactcacctgtagtttctaatgagaacggtgatattagttctatagctgtttctcatggaatccagaatactttgaggaatcattatccattcttttactcaaccattcttgaactacttcatgctttttactcatgtacaacctattggaggaatgaatttgtattcactcttattggtctataaaaggggctttcctatgtttgtctctctgtaagtaaacagaacaaatgttctatatgacagctgttcaaatatttgaaaattgttggcctgttccctttctctctctctcttgtttttcccctggctaattatccttggttaatttgacggcagattgagggcctcctggatgcatggtcctatcccagctgctggaaggaataccaaaaaataaataggacagttttgtactaaataaagagtttttaaaaccaatgtttaagccatccttgtttgctgtggtttccaagcctgtcactattctgaagatctttctggacatgttctgatttgtgaatgctcttgatgaaaagaaaaaggcagtcaaaattagaatctttaaacgggttggcgcccttacgcgcttaaaggactattactcccttcattcaggcttcattcatttaacgtgagccagaactctttcttcatacctccaccactcaacatctccatctctttctctccgcactcttagaacgcatctaaactaggttgcctcatccgcctcatgacactctgtgtaaccccgcgctcctctcatcccccaactccccctatatctcaaccacccgcggccctagcatatgcgccatggctcaacgccgcctctcacactgccgcgctcttggcgcagcactcctgtctcgaggcccctcgctcttgcgctccactccctcctcgctccttcacatcctgtctcatatctccatccctccctcgtctactcctacggctcccactatacccactccggcccgcg

SEQ ID NO: 215732 - DNA, 790 bp, Homo sapiens
agtatcctctttcagaagacttttttgaactcccaggttgagctctgtgcctccctttcagttttccatcacgctcaatatctttatcttgttctttaggctcattcaagtaaaattatctaccctgaagtttcttttgtgggtttttcctcctcattagattctaaagtcctcatgggtggggattgtctttactcagcatttttacctctagatctagtaaagttcttcataaatgtcagttaaaccaaattaaatgggtaaaagctggttttcaataagatgtagtgagagttccataaatctattgtagctttggaagtgagaattgtttctactaaactatcactgaaaaaatgtcaccaaaattaaaccccataatgcagctgtcccagaaaagggatagacttaagtcttattgctgatttctgattctaatttgttttgaaacaggttgttttttcaaggtgtcttaatttttctagctacaaaatagctgtggacattgtgttcattgaaatctgtggggcttgctattctcactgagtcagcatattatgaatgcagtttattattcccaaaatgtcgtgcatgcagcttaatcagtgcagaagtgaagaccaagagccttggagcagttgtactgatttgacattttcgtggaatcaacaaagaggatatatctccatgaggcaagctactggatttctctccctccctatatttcaagctataaacacagtttccccattgacatttattagaaagtaacacaaagcagattgctagg

SEQ ID NO: 215733 - DNA, 447 bp, Homo sapiens
caatttccctgatgtcccagtgataaaagccttacagcttctttctctactcaggatacaagtgaacaaatacattgcatttggttgtcagggtccccaaccttttttatttcctccatgacatagacttttgtagagtccgagatatttatcctgtaaacggtcccataatctggattatctgagttccttatgattagactcaggttaattggtttttttatatgaatacctaagtattttggggtgtttctcattgagttataccaggaggcacaaaaagtcttacacttggtgagtttaatggtttgattaagttgttttcgtttgttatacactaaaggttcaattatcctttgatgttaagaggcaatctatgcggtaatattttgagaacaagtgattatcccattccccaataaatagttttaacatctgtggatactt

SEQ ID NO: 215734 - DNA, 573 bp, Homo sapiens
gaaaccatcattttcagcaaactaacacaggaaggaaacaccacgtgttctcacgcataagtgggagttgaataatgagaacacatggacacagggaggggaacatcatacaccggggcctgttgcagggtgtggggtaggggagggatcgcgtaaggagaaatacctaatgtagatgacagattgatggctgcagcaaaccaccatggcacatgtatacctatgtaacaaagctgcatgttctgcacatgtatcctagaactgacagcattataatgataataaaaaaaataatggagatagcattagggatgtcagaaggagagcaagtttgatttcagatacactgagtttttaatgtcataagagatttaaactatacagtccaaatttttggagaaggattgagattttgttttcctattacacagaagaatcgaaaatgaaagattttattttctcagcatggatgcatccaggttttgtgtagctgaaagctttatacaaattggaggtaggggacctcttgatacaaaactacaaataaagtactaaatggagtctttatttaat

SEQ ID NO: 215735 - DNA, 439 bp, Homo sapiens
tcagttcagaaggcacagggattgtattcaatggtgtgtggtttattgacagaggttctttttgagaaatgtgtccctgggcaatttcatcattgtgcaagcatcaagggtgaattttcacaaacctacaaggaataccctactacacacagggtatgtggattagcgcagggttcccagacaactaacctgtacagcgtgttactgcactgaacactgcaggaaatggaaacaccatggtaagtatctctctatctaaacacatcaaaacatggaaaaagtttagtgaaaatatggtattacaacattatgtggccacaaacatatatgtggtctactgttgactgcagcattgttacgtaacacatgactttactcaaattgacgtgggttgggggggactaaaaataaataaaacctgccaagacgaatcttaaaa

SEQ ID NO: 215736 - DNA, 345 bp, Homo sapiens
ctttgggaaatgcagaatcgatgcttggaatctttgcctttatttaccagttttcagaataatgagttaatgagtcagtttcccctctgaagggcaagagtgagttttttgattgatttttagtgtcacaatgaagtcatagatttaaagatatttgctcttctttgacccatcacagtgaaacacctacctcatgctcaaatcgtcgcatccatggtcaacagcagcctgtttgggttggctcctgagacctcgcggtgtggggttagttttcttgctctctggaatctgttccaggttcacgctggacattttctgcccagatctctttttgttttcatctcc

SEQ ID NO: 215737 - DNA, 618 bp, Homo sapiens
caccacaagttataaacaaaacattactattttattcaaagtaattatgagatattagttctttacaatgttatgagtataatggttaatagagctctatactgcctaataaggtggtcatgaaccacatgtggccactgagctttagaaatttggctactccatgttaagatttataaataagtgtaaaatatgtgtgggttttgaagagaatataaaatgtaaaatattcatatttttgtattgattatgagtttatacaataatttggacatctcagtgaaatcagtaaaattaattttatctgttttttgttttttactatggcaactagaatatttaaaattacatatatggcatgtattatatttctattgagctgcactactataaaagttctacttgaatttagagacaagaacttactgtaaggttataaaattttaagaaaatgtctgtgtgaaaaggattttgttcctaaaatgtgactgaatacatcctcatctagtctctgcttataaacatttagcattacttgaaaatcagtgtttttaaaaaaattgcagtcctcatcagttgttcttatataaacctaaaatttaggctccaaataatttt

SEQ ID NO: 215738 - DNA, 648 bp, Homo sapiens
tgtttctaaaagaataaatgaatagttttttgttaataattaatgtaggcctctgcttacctgctttatacattctttacctgcctgtacgtagcacttgcctatgcaagtattcatttactgaaaaagttaccaactttgtagccttgaaatcatttaaaaaatatgttaactgacttgaatactctggttagaagcaaaatgcataccttctacttgaaggaatttgttttcacctttactgaaaaaaatacatatttagttgtattttaaacactacttattttgacatagtaatcactttatagttttctaggaagttcatctttgtatgcattttatatctcctattcttttcttgtaaagattaggttacaattaaaataattcaaagatcattgggaggtactgcattaaactgtgggttggatcttgccttttgtcttgttcaaactgcacctctccttttatttttttcaatctgaagatagtagcatgcttagagcatgaatgtaagccatgtggtggctaagatagagaaggcagagatggatgacttcagaggaagtaagtgtttgacaggagactggactgggtgatggtgtgaaccaaagtcaaggtcacagggagaaaaagagcaggctggct

SEQ ID NO: 215739 - DNA, 553 bp, Homo sapiens
gagggctgcttttggcctcccctttcaaccagtggaaatctgcatgttaggatagagacttgcgtgaagtatcatctggtaatcatccttgacaatgttcaggattatgctggagggacaaacaagtaattccattgcagtagcagtcatggaaatatacaaatcatagcagctttccaatcagagctgtggagggggaaatgtgggagagaaaacctcttcctctgtctgctccccctgcccttcatttctggatccacttgctcactcctcgaatttctcttcaggtttggaaaggtatcacaccatctctaaataattctgggctccctcattttgaaagctcttgcaaagctaaataatcttcttcgtaggtaaacataaatcattgtctaccttctttgctccttgagtagaccttttgatacattcattaattatggccactgcctggtggtgcagtaatggctgagtcactgccgtgagcatctttcctggaacgctcccatttctgacactgaacccgaaaatccaattcagtgttaaagaggcc

SEQ ID NO: 215740 - DNA, 261 bp, Homo sapiens
tgatcagtctaggtaaaggtttctcagtttttgctaaacttctcaaagaacatttggttccattggtttttctgggtttttattttcctatcctctatttcattaatttctgctctcatctttatgtttctctccttctccttcctttaggtttagtttgatcttctttgcccagtgtcttaaggtggaagcttaggttattgatttgacatcttctttacatcagtaaagaagatctacccccatacatttcactctaaa

SEQ ID NO: 215741 - DNA, 551 bp, Homo sapiens
caatgagttagtctactcactatgacttaccaggtaattgcttcacctagactccagtgttgcaatggaaagactgaaacaattggacagttatctggatcagggcacttattaatttgtaagaaaaggaaaggattcatttgtctgaaattgccatcttgaaggttttcattgatctaagataaattccacctcattcctgcagacacagacttgttctgaatttaaaaggaagagattgctgtttttaaagacaaaaattataaggctgggtgtggtggctcatacctgtaatcccaacacattcagaagctgaggagggataattgcttgaggccaggagttcatgatcagcctgggcaacatcatgagaccccatctctacaaaaaataaaaagttggccagacatggtaggcactcatagtcccagctacttgggaggctgagttgggaggatcgcttgagcccaggaggtcaagattgtaatgaggtatgatcatgccactgtactccagcctgggccacagagtaagaccctgtctcttaaaaa

SEQ ID NO: 215742 - DNA, 598 bp, Homo sapiens
ccagggaagctagcagtgcagccttcaatctgtggctgaaggtcagagagaccgcatgaagtcactgttgcaagtcccagaattcaaaggccaaataacctggagtctgatgtccagtggaagggggagtggaagcaagcatctggcatgggaagaagaaagaaagaaaaccagaagactcataggcgggataagcaaacttatcccacctttttccacctgctttgttctagttgcactggcaggctcccagcggggaggctgcgagtgcacaggacatacctatgttctatatatgtgagatctatagcctaagtgttcatttatggagggattttacatggtattgtattttgaaatgtcagtgcccatgtgtttgttgctagcatgtagaaatagaatcgacttttgatcgtttatcttatgtctagcgaccttgttaaactcacttattagttctaggagggctttttagagggtagattccttggaattttctatgcggagacaatcatgttatctgtaaatgagggcagttttgtaacttcctttcctgtctgtgtgccttttattccttttcttgccttattgactggca

SEQ ID NO: 215743 - DNA, 449 bp, Homo sapiens
ctgatagtcccttagagttagttataatgggatttcggttaaaatttcttaaatatgtattgaatgctcaatgcgtagctcaattatgtagatagatgcttgctgttacacagggaaaacatgactcctaccccaagcagtttaatattctacatatgtacacttctaataaaaaagagactaggaagccatctcagtcatcttcactataaatgaatttctattttagaaatttagtagttgtaattctataataatatatattattggtgaaagtataaatggttctattatatgccaaattgtctttaacccgttttttatcttcttctgttaaaacttagaaacagtagaacttgattaaattctataattttttggtaagcctttcatcacaaatttataaaagctattcagttttctccataaaatcaagtttgttttccatt

SEQ ID NO: 215744 - DNA, 421 bp, Homo sapiens
  misc_feature (406)..(406): n is a, c, g, or t
  misc_feature (410)..(411): n is a, c, g, or t
  misc_feature (414)..(414): n is a, c, g, or t
ttgccagaacaacatgccacaggacactgctctcccctggaaaaacaggtccacccagttaggaactcagattctgaaccctcgcagccacggcattctgcgagccttgtgtgacttccctaaaaaccacaactgctcctggaagctcatctttctaggccagaagacagtattccttagaaatatggagacaaatctaggctaaaaaggatgatgtctcacatctgtggagcacaaagcatgtgccaggcactgagccaaaaaggtttttgtttgtttgtttgttttctgattttggttttggttttggttttttgagaaagggtctcgctctgtcgccgaggctggagtgcagtgagctgtgatcatgccattgcactccagcctggggaacagagcaagaccntgtnnccnagcaaaa

SEQ ID NO: 215745 - DNA, 1554 bp, Homo sapiens
ctgccactgcactccagactgtggacagagcgagactccgtctccaaaaaaaaaaaagaataatttgacctgtgtttgagggtgggagatatgagaaacttctcactttagcaggatatgctgagggttaagatatctctggaaaatctccaaatgctatgtcatcaactcattaaagacagaggcatctccaaacctgtacagtcttgtcacctctcagacatcagaactgcagagtggcaaatccaggtaagattcaaaacccaattcatgcattcactgtacatttattaaacacctgtaagttgtcaggcactgatctagggactgagaatataaacatgatatatggaagtatacccatccattattatttacctttattatgcccaacctctcaagggtgcaggcaggaagttcttctcctgttgcctaaggagcaccaaataagtctccattctcatttctgtgcctctgatcatggggtacccacctgaaacatgcccatcataactcacctacccaaatcctcacatccttcaaggccagcttaagtctccctccttttggaagccctgacttccactccatccctaaatgatgtctctgttctctgagctgctagcaattacagcgagtaataccatccaccatccatttatttagaaatttattgtcctgcaactgatacttttatttcttcaacaaatcttaagtacctacttatattgctttttaaaatcttcctgtaaagacctggtttggtactcagtgcttaatatctattaataacaatttattagcgccttaggcttatatggtccaagctcactcaaactgaagttacataaagtaatggggaacaaaagctaacgaaggcatttctaaatgaacttccacttcttaaaaacctcaaaagaacaaggaaggaaaaagaaatcaggctatgaaagcgctgctgaactaacacatttaactcacactaacaaagcacccccaatcccccttcgaagccacacaaaactgatgtttttccctcggtccttacagctccagattgaagcgtttaacaacagaccttggaaaagtttacagcatccttcggtttcctaaacaagtctctctgcctttatttctagatgaataagcccctggatgaatcctgcatatgccacttagactaatccaatgaggttcactacaaggaactacaatttgaacttcaagcacaagagaggctcaaagacgaacatcttgaaaatgatacatccagaggcaattttaataaaacaaaagcgaggggccaggcgcggtggtcacgcctgtaatcccagcactttgggaagccgaggcgggcggttcctgaggtcaagagttcgagaccagcctggccaatatggtgaaaccccgtctctactaaaaatacaaaaattagcctggtgtcgtggcgggcgcctgtaatcccagctacttgggaggcagaggcaggagaatcgcttgaacccgggaggcggaggttgcagtgagccgagatcgcgccactgcactccagcc

SEQ ID NO: 215746 - DNA, 623 bp, Homo sapiens
catggtggctcacgcctgtaatcccagcactttgggaagctgaggcaggcggatcacctgaggtcaggagttagagaccagtgtgaccagtatggcaaaacccgtctctactaaaaatacgaaattagccaggcttagcggggcatgcctgtaatcccaactacttggcaggctgaggcaggacaatcgcttgaacccaggaggcagaggttgcagcgagccaagatcgcgccacggcactccagtttgggcgacaaagcgagactccgtctcatttaaaaaaattaatatctctactgactagggaagtaaaaattagaataaaccaccatttcacatccatcatagtgacaaaaacataagtcttaaaaatgtaggccgagtgcggtggctcacgcctgtaatcccagcactttgggaggccgaggtgggcgaatcacaaggtcaagagttcaagaccagcctgaccaacatggtgaaactctgtctgtactaaaaatacaaaacttagccaggcgtggtggcatgcgtctataatctcaggaggctgaggcaggagaattgcttgaacacaggagatggaggttgcaatgagccaagattgtgctactgtactccagcct

SEQ ID NO: 215747 - DNA, 549 bp, Homo sapiens
gctttaaatgtctatgaatatctaaagttctgggtattcttacagaaacatctgatcatacttctgagtaaaactttctactgagtctgatgttcagttgctcagtattatttcaataacatttgtagcaacactcactgcaggaacaagggacatattccaagaaaaaaaaggaaggaaggaaggaggggagaaaaggaaacattattataggtcatgagagttcagggaaaattaatcatgatctttattattttagttcaaagtgtcttcttggaacacttgtataaaattgtagcattattattctatattattgctctgttgtatttacatatgcatctgagaatttagctaatatgaactatgtagtttataacttaataattatttattatatatttgattttaaatgttcatgtttatggcttcttatttaagacctgatcatattaaatactacccgcccagtacaaccgtcttttgtgattccctggaaacccttaattcaatagtcctgactgaaaataaaagattatccttagtctc

SEQ ID NO: 215748 - DNA, 485 bp, Homo sapiens
tctttctatacctctacctcagtttttcccatgtgtatgtgtgtgtggaatatgttctctggggtatgttaatatataaatggtattatatatcataatttatgcatcatgttattttgatacaaaaatgacttgaagctctattgttcatatatgtagttccaacttgtttttttaaccactgcttaatatttcataatatgaaaaatcattatatttaggaattactaattacactattacttgagtaaaccctttttgtacatttctcctttggtacatgtcttgcttctctttccagaatatattgaagtattttgatacagttctaaatgaactagatgattagctttctacctgctgctaagatgatttgattcactaatttattcacttcagatacctgtattgatcctacatttaaaagttgcttgtgctgggactgaagatgaaaatgtatgcagaccctgtctttgacatgcaca

SEQ ID NO: 215749 - DNA, 429 bp, Homo sapiens
agcatggagacatatgcatatgcgttcagtctgggaaagggagagtagtttcaggtggccaaagtgtgaggtgtgctgggggtgggggtgatggttttggaaattctgttaaaaatatatatatatatgttcacacacacatatgcgtacaaatataatataatgaaacatcatataatatgtaatacagtaatgtaatatctggacagtgcatatccttaaatactttcacttgagaccatttgagaccagcctgggaaacagagcaagaccccatctctacaaaaaaactaaaagttagccaagcgtgatagctactcgggaggctgaggtgggaggatcacttgagcccaggagttcaaggctgtagtgagccatgatcatgccactggactccagcctgggtgacagagtgagaccctgacttta

SEQ ID NO: 215750 - DNA, 214 bp, Homo sapiens
atgtccaaaccagtgcataccttcattgtaaccttgtcattctccataacaactttgaatttattcttgtgggtcccagctatatcataacaatttgtaacaagaaatatgttttgttttcttatattttcaaagtgataatatgcctagtccacagtagtcacttcttaagtagacagataaacaaaaataacattaaacaagaaaaacattt

SEQ ID NO: 215751 - DNA, 112 bp, Homo sapiens
atctgtatgatggtgatcacagtaggatgtatctgagagagctgttttaagaaccaaatagatagcatatgataccataacgtaaggtgcgtggaagctctcagtgagttgc

SEQ ID NO: 215752 - DNA, 500 bp, Homo sapiens
cttctatatagtagacactcaaaatgcttattaaactgcatttacattcagcagagataaacagagtggaaagctgccatagcattacctgtggaaatgaatgaaagcctgtgattcggatcctaatgggagaaaagtgccatggcagaaggagattctgttgagaagataaatgccctctgactatgtcttcttcaatcctcaaaaatattgccattatgtttgagagcagttgataaagcatagtgtgctgggaagagtgctggagaaggagtcagttgaccttcacgactgtccaattctgcaatgagcaagctgtgtcactttgggcaaatcatgggttctctgtttctctgtttcatctataaagtgaggcaatgaaatattatgatcttaaattatttctttacagttatatgacattaatcaattcctgacttccttcttccattggtcataaatatgtgtatgtatgtataatatattcatagataatgtgt

SEQ ID NO: 215753 - DNA, 152 bp, Homo sapiens
tcaaataagcattctacttgagtctgatggagaaactaaggtttgatgcagtttaatagcttgtaaatgttaaagagcagtatttagcctaagcatattcacccacttacaatataggagttctgtttttttatatcatattccataaatat

SEQ ID NO: 215754 - DNA, 367 bp, Homo sapiens
tggccagggatggacgtctatcatctagtcagtccatccttcccacgcagagtaggaacttctcattggccagatgtgttgtcaagtgtggaatctgagtggaggaatagggggcggaatcaaagggggcgggggaagtcacaaaagaggagccatatactcatcgcctcttgctattggctggaagaggaaataaagttttatggttggcctacgctcctgcccattatcagccaggtctttggaggtgggagaaaggatggaatcatgtggcgtgccacttctttcaaaggcggccgaggggaggagtaacaagggaatgcgggaggggaaccgcttcccaagaatctctgcgcagagatcctta

SEQ ID NO: 215755 - DNA, 396 bp, Homo sapiens
ttctcatcttattttttgtttctttgggtggcatccttactgggaagagagagttcttgtaaatattaaattgcctttgtaagaacatgagctttgaaatcagacagacgttggctcaaatccaccctccccacttaccagctctctaacctctctacatctcaggctgtcccttctgggagatgaggttgttataaggaataataaaactgcctgcaaatgcctaacactgacacggcacaaagcagggggttggaaagtgttcattctccagttgttctgctaataatgggtttctctgcattttagccaggcagaagttttttcccaggacctgggtttgagacctagaattatgggagaactcatctcaagttaattagaggaaatgaaact

SEQ ID NO: 215756 - DNA, 1189 bp, Homo sapiens
gttctaccttcttattaaaatcagctcctaccttcaaaaacctgcaggcttttctttagctatgtatgaaaccgactgatatctgtcttttcaagaaagggtaggggaataataactaaattcctctgaaacactaatgatggaaaactggaaagcatactttagtaacacttgacttatgaatagtgtccaagtttcttactgaatcttgggttggtccatctggtaattgtagcattgttgccccaaacctcctcaaatataatagcggtttttttcttttcacgacctgtgcaacctgtggtagtctgaggagctctggacttggggccagaggttggggttggtggaggatgaggagcagttttatttaaaatgactaagtgcaaaggtaacagacaagatgttactgtaacagaaggcagttggctgtcctcagaccaccacaggatgccttgaatgtgttccatgggtcctggagacttgggagaaggaaagatgaatttagtaggggatatcagactatgtagaagagaagaatttactgggcttccttacttgtaaggtgaaaggattagactaacattgagttattgctaagatactgaactttgaagttttctttatttaaatttttattttagtttttaataaaattttactcaattagtatgcagacttttgcatatatattttaggcctgttaatgatagttttgggttatacctttcaagatataattttaaaatatatacaactgttatgtattcataaaaattaaatatacatatttcaaaaaattacagccatatttctcaaatgtctttattatactattttcttaatataagaggtcttgaaaaatatttgttgcaggtctctttgggtattaccatgttttccttttaaaaaatatgttgtcaacaatatccaaacaataatgtttcccatattaaaaatagtaacatacaaattctggagaggtatattgacttacttttctaatcattacattgtgaagttttccagcttactgtattctagttggttttaatatgtcacattagaatttgtcttatattcacccattctatccagaaatccaaatgattatttttaaaattacaggatttttcttcaaaaaacattgagaaatttttctcatttatatgaagaaaggagaaattga

SEQ ID NO: 215757 - DNA, 720 bp, Homo sapiens
ctcagagtaaaacagtagtcacactggtctgcaaggccatatagagactcgtctccatttgcctcgcagatcatatttgctttttctttgcaccctgtctgatactggcagtgggttcttgaccctcagaaaatagaaatcgaccaagaatctaagatggacttgagcaaggaagtttattagggctttcggcttgagcagaaagggagacagcaaccagaggtatacttgcagctggctccttgaaagcaagctagtctagtttgttattcttctgtgagcttcgtctaggtgacatcatggcatgtttggggtggtctgttggatacacctttgcagtcccttgtcatgctttttcctgtgtctcaggtctcattggcagcttaaatctccacgcaggggtatgaattttatcattaacatgatgcaaaagttaggttaggataatcaaagtccctatagcacatgttcatttggggaaggtcttttggaagtccctatgctgatggcgaggatgtttgtcgttagagtgttctatttcttttatgtctgattggctgattttatgagcggaagcttcagtggctgcaaggttatggagctgggtgctgctgtagtcagcacagcaagtaaacaagtgtggaggggtcccttgtcctgccttccattgtctgcctcacctctgcccctttttccagtcataatacctgctttttacct

SEQ ID NO: 215758 - DNA, 543 bp, Homo sapiens
ctttgggagtccgaggcaggcagatcacctgaggtcaggagttcaagaccagcctggccaacatggtaaaaccccgtctctactcaagaacaattacttaaacatttttatgttcctcatgtaactagttcaaaaacctcacagtggtaaaaagataataaaagaatcgtgaaagtgtgttgaaagggactgctagattttcaaagtgtcttaggccagtattactacaaaagaaaagtgtaactggagtcagaaaatatcattacctgaatgagaaaattttatcagccattcttttaaaaagatattcataagacatacacatctgcaaagtaaagcatgtaggtgctcaaatatctgctgaatgtatgatataaaattttaagttaatattagagtctaaaaacttttctcaggctaacataatcaaaatttaggttcaaaatttcgaaaacaaaagtcttgtgtcttctgcctttatgaacttgatttgctaaagtaaatctgccatgcatcctgatcttgtgtttggcagcaagagcc

SEQ ID NO: 215759 - DNA, 431 bp, Homo sapiens
ttgagccagagaggtccaagctgcagtgagccatgtgccactgcactctggcctggagaacagaacaagactgtgtttcaaaacaaaacaaaaagatgtatcttggtatgtttttctttgagttatcctatttggtgtttgttgagctccttgaatctgtaaatttatatctgaccaaacgtgggggattttccaccttttttttttcaaatgtatttttctgccttagtatctttctttctttctttttttttttttccatttaaccctgagttgacacagcacatgtttcagagagcacagggttgggggtaaggttatagatcaacagcatcccaaggcagaagaatttttcttagtacagaacaaaatggagtctcctatgtctacttctttctacacagacacagtaacaatctgatctctctttc

SEQ ID NO: 215760 - DNA, 514 bp, Homo sapiens
gaggctctcttcactcactccacatcaaaaaaggtaaaactccatctcagatatttctgctacccagagtcccttctggatccttctccccacaggcagttcaatctctggtggcccataaatagcccataaatagcacttggcatcactgccccctatcccacgaggctcttttattctccaactttccacaccccttagaaggaagcaagttcctctccttggtgtttatgtatcagtttagcatttcagccaggacccatggctcattttgtctccaaatacagttctaatatcatccctaaaaaataaaatatgagtgaacatgactcttacgcacacacacatttaaccatacaaatttgttgacaagttttactttcttactctgctgttgtgttctgcccatttttctaaatgttactcggctgatatctttaaaactggatcttgctcaagcttcctacttcttgcactggtccattgcaataaaagacaggcgacacgtggacaa

SEQ ID NO: 215761 - DNA, 445 bp, Homo sapiens
cataactatttgcagttgtattttcctttaaatctaaattggagagaaggaaggtaattaaggcataattatcagacttaatcaagcacttatttattgagcttacttggtgcctgggcttgtatcttttgtttctgatttttagtttcgtttcattgctccagcgtgggggaatttgcctgtgtatccttgaataaatgtctttctttggaaggcagattaagtagggatttctcttactgtttatttttgtttctaactgaagttcaatgaattattcttttacccagacacttacatattcctagccattccttttgcttaagtttgcagagatttgtgcttaaaactgaataaacaatctcagggtttttgtgtgtgtgtgtatgtgtgtgtgcgtgttatatgaagtcttgctagaatgcataaacaaacaaaaaaaata

SEQ ID NO: 215762 - DNA, 405 bp, Homo sapiens
tccagtttttttttttattgttttcaaaaataaagtaagtagaacaactcattggtaaggtagttttctcttttctttggaacatttttgggaaaagaactttaccttatgttcactgttatgatctaaaatgatgataatgagatgaagagggagtcaaggataactgtgagatttttgacctggccagatggaagaatggaattgctatttaatgaggtatagacacttgctgtattctgcttaatattgtagatattttatgtgcttatgttattccttctgtgcttatcttattcctccttctagttccccagggtttggggctgtgttgtccatgtattattcacaatacccagcacagttctttgtaccgagtaattgccacctactttcctgaattaa

SEQ ID NO: 215763 - DNA, 319 bp, Homo sapiens
ctcatactaagaggaaaacagaaaatacagggttacagagttcacagccaacactcaaaacaacagactggagtatgtgtctaaggaagacatgaaatggaagggccactacagacaactggcggttgagaagataagactcagcctacatcctccagaagcatactgacagacagagtctggggtcgtttgaggctctcctctgtactgatactctccaccccactccctgagaacaactggagggagggtgcctgcctaggggctctcgagtggtgagcacagtgctgggcacacacagtaaagctccagaaaagtg

SEQ ID NO: 215764 - DNA, 366 bp, Homo sapiens
ggtcaaatattgttcagctccagtcagagccacacttcatattgcaggcttctgcctggttcattttcatttttatgcaagcaaaccatcacaagagcccgcctgtgtttaccccctgcccaggtgtattatgaacattgtctctagttcctacctgtggctcacatagctaaggacagcagggcttacctggctggggctgagcgtctcaggtgaaaagtgccacctggaggtggggttgagaatgaactccgcctgatggccatgtctgggtctggcaccccaggagtccactaagcagtcataggcaaaggatgccatttgtctcttgggttcactagtgcagtgggtgacttctgccagcag

SEQ ID NO: 215765 - DNA, 343 bp, Homo sapiens
gccatgactcgctctgttacggcctcagctccagaaacttcactgctgtgcactctgggcagatgtggccaagataagcgactccctctccccatagctcctgatcttgggctatggtttcggtctggaaagggaaactgctgggatttcttattcttaccccagccccatgttgcagaagctctattccaagcaggtgtggccaagagggctcagactctcttcccctcggcccattgtcacttgttggaagaaactccactctaagctcagcatactgagaataactgtgccctaatgattcctgacccagtttgcttatagagtgaaagttccaagccat

SEQ ID NO: 215766 - DNA, 516 bp, Homo sapiens
tcttgaactcctgagctcaagtgatccgcttggcttctccaagtgctaggattaccagtttatctctttaacacctcctccactgtggaaaagagaagagtggcactgacctccaggacctggtctggtgctgtgggccaggccctaatgttgttggaagctggctggcacccataggaaggccatgttgttctcctgttggacataaacaatcgcgcagaccacccacacaagggcactctgcaccactgatgacaggagatgaaacgagaccacctcatcattttgtctaagcagagaaaaaagcaaggtcactgtgccacccacggaataccagacatctctttctcccagctgatagaagtgactgtggcttctttacatgttacagctttagccttactccagccaaatctccttctagaaaagacagagctactggatagaattttcccacctgctttcagtactcaacacagagaaaatcccttgaccctcccccaaatcacccagcca

SEQ ID NO: 215767 - DNA, 996 bp, Homo sapiens
gcttaggtgtcatgtgaaatcaaagccctatcaatgaactttttatattctgctactgtaaaatcccttggtctgtcttgtacttgaatttaccttttatccaggcaggactgtgcagcatcatgcattgatcacttggaaaataatagataatagacataaacaggtctgccactgttgatatatgctattatgtaatatctttttaaaatcacatttgcaccacccaccacagtagaaaagtgtaaatgttgggtttctgttatgttacagtggcagatacaagattcctcaaattccagtttgcacttgcaaagtctgattttgtgatcagtaacagatactgccgcttgttttccatgaggtgtcaggctcactttgttcatttttagtaacatatctgtcaaatatccaagtcggaataacagtagtttgtcagtcattctttgggttaaaaaagatgatgtttcattttttgaagttattctttcaagttgaaaaaaaaaaaatggtgtttccaaagtagagaatgaacttgtcatgtttaagaaaaggaacagagttcattacacacagaacagagtagacaattgggagagaaatcaggatgaggatggagaaatatgagtagacagtccattcagagccttatggacagaaggaaatcatttacatttttttctaggtggaaaggaaatcatatcagaattctttttttttgagatggagtcttgctctgttgcccaggctggagtgcaatggcatgatctcggctcattgcaacctccgcttcccaggctcaagcgattctcctgcctcagcctccctagtagctgggattacaggagcacgccaccatgcccggataatttttgtatttttagtagagacggggtttcaccatgtaagccaggctggtctcaaactcctgacctcaggtgatccgacccgcctcggcctcccgaagtgctgggattacaggcatgagccaccaca

SEQ ID NO: 215768 - DNA, 578 bp, Homo sapiens
atggaaaacatcaacaccgacttcagagaataacaacttcctctgggaaggaaaaaggggccaggaaaagatacaaaggtggccttaattataactataaaaccacctttttcttttgtttttgagactatcataaaatagcataaaaccttctttttaaagaagtaaaaaaatctgaagcaaatgtgtcaaaagttcaacatataccaaacctaggtgatggatacttggatgttatcaaacaggctaataaatatatatgttaatccatatatatttcatgtgtaaaattttcattaaaagaaagtgtatgtctagaagggttccatggtagcacaacagaaaaatggaaacatcttaaatattcaccaactagaggagtggttaaataaatccattcaagggtgtattctacttttagaaatatctcaatatacaaaaaaaaaaaaatgtacatacacatataaaataaaaaacacaaatatagagcaatgccattcaatattttcatttcattttttaaatctatactgtggcactgaacttgttccaacaagcaggtgctaactacaacaatt

SEQ ID NO: 215769 - DNA, 229 bp, Homo sapiens
aagttacttgtcatcagttcccaacatgaatgctcttgctcaaataagtcacatccccattccttaaatgcaacatattaaaatctgtttatgttccatattcatttgttagtttttagattcttatctcttccatgcagcttttcctaaccaccccaggcctctttgacttctctaagcttaatggtattctttatgtatttccttcactgttctctaaaattttctt

SEQ ID NO: 215770 - DNA, 687 bp, Homo sapiens
tgttagacaggatggtcttcatctcctgcccttgtgatccacctgcgttcagcctccgagaatgctgggattacaggcatgaaccatcgtgcccaccctgggaccgaccatcttttttgttttgaagttataacacattataaatgataaataagtaacagggtctggattctagcctgggtgttctggctccagagcccatgctctggctgttctgtgatgttggatgtttaggttgcttccaattttcccttttataaataatgttgacacagaatcatgctgcattgtaacttttgcttttggccagattggatctgctggtggtcatctaagaagaaagtatttggtaacacgcagtgtacaatactaacactccttcatttactgtagttattgatgaactgctgtggttaatgtggagggaaatgtatgttatattctttgtctgaatagcttatgataattgaattaccatgtttctttgattctaaaattcacgtattcctatttttacaattcctaaatcataatgtttttgtagccagtgtgtacaattaatgtggctgtgtgtgtttctctctcttttccttcctttcttttctgagacggagtctcgctctgtcacccaagctggagcacagtggcgcaatctcggctcactgcaacctccgcctcccgggttca

SEQ ID NO: 215771 - DNA, 364 bp, Homo sapiens
gaaaactaacagcagaaatacgtggtatctgaatatattttatatttaaatctttaatctgtttggaatttattttgatgttaacctcctcactctcttgccattttctgaataatccattctttccctaaggatttatggtgttatctcctttatgtgctaaattcctatctattcttaggtctgtttctggggatttctatcctattcatttgatttgtctgcctattcctgtattagtactacactgtttttaattattgaagctttataatacaatttaatatctggtacagcacattcctcctcattattcttcttattcaaaaattttggcagtgtcacacacatctattcttctaga

SEQ ID NO: 215772 - DNA, 434 bp, Homo sapiens
aaagaggtttaattgactcacagtaccacaggcttaacaggaaatataactgggaggcctcaggaaacaaacaatcatggcagaaggcagatggaaacaggtacatcttcccatgacagagcaggagagaaagaaagagcaaatgcggaggggccacacagttttaaatgccagaagtgccacagttttaaaccattggatctcgtgagaactcactgtcatgagaacagcatggggaaaaccagtcccatgatccattcacctcccaccaggtccgtcccttgacacatggggattaaaattcgagaggagatttgggtggggacacagagccaaaccatataatcagagaaatgcaaatcaaaaccacaatgagataccatctcacacctgttaagatatccatgatccaaaaaataaataaataaataaga

SEQ ID NO: 215773 - DNA, 525 bp, Homo sapiens
cattatctattttcatcactgcatatatctgaggaaggataatgagactctactatcagtagaaggatgcttggattatcacgtgcaacactttatagcctatcttgacttttctcccaaacttcatagaagaaaagatgggattttctgactctttttaacttcctaggactagagagccaggaagacagaaaaaaggggcaaaaggggccctacttttaacttggtacaaagtttataatgggaacataatagttccagaaagcggaatagaaaatcttattaaagaaaccaaggcagggagcttcattaacattctgctcttgaactcatgcttttattagatacttatgtgtagggctattctgaggacctgctattcattttttccaataattcatattttaatgtatttagataggtaatttacatgacattatttttagaaatcatgacctatttcaacctgtcattgttatctatggcttaatttctgtgaaaagcaatgaagtctctctgcaatat

SEQ ID NO: 215774 - DNA, 411 bp, Homo sapiens
gctctcccaagagagagtgggctcctgaaggaagaaataaggaataaccagatgacgaatatgatttagagaggattcctagtacaacgcagcttgtttggaactggagaggtcgcagaacaggagtggaagaatgcgtggaacgcagagctcgccctagttgagagtcggaagggttgagcacttgctctgcggcataccaaaaggggaaattcagacacagagacatgcatccagggaagaaaatgtgaagtggcatgcacaagagtggaccatttacaagtcaaggaaagatccctggaagagatccttccctcttactactcagaaggaaccaacccagctggcgctttgatttggacttccagcctgcctaaatgtaaccaataaatttctgctgtttatgccgcc

SEQ ID NO: 215775 - DNA, 485 bp, Homo sapiens
cagtgcgggtgaggaggtaatgagacatgagctgagctatctgctgtgaaagtgaaaactaaattgccaatatggaacaaaattatgcagccgttggaaattatatttaaacaatatttaagtttaaaaaaaagactaccatttaatacacagacttaaaaatttacttacattgtgaaccaaattttaagtatctatttctagggaaaaaagtgaaataaaaaaatacagtctgtgaagttaattttcctttgtttaaaccttgcttttccacttagctgtgtgacctgagaaaatttctgaagcttttggggcctatgttctcatctataagatgaggaaagtaaaacaacatgtgtatcttacgaaggactaaatatattaatattttctaagcactcagggcaatgtctagcactttgtaaagttgcagtatttgttttttgtttatcataactattggaataaaatgtaaaaatctagga

SEQ ID NO: 215776 - DNA, 334 bp, Homo sapiens
gggggggtcttgggggccctgtggtggctcccacccctcgcctcccccaccccgtgaggctggctggagggggccagagcagctctttggaaactagggcagcagggttaggaggccggaggccctggggtcaccggccagccacacaggcaccgttttcagatgtccacttctcattgggtacatcaatcttttaactttgggggtcacagttttagccacctttcggggggtgactggagcagtaggaggtgtggggtcattttatgaatataataaaatggagctgactgtggacgaggactaagtgtgggggagaggggacgatacaggt

SEQ ID NO: 215777 - DNA, 585 bp, Homo sapiens
actttgtatctacaaaaaatactaaaaattagccagacatcatggtgtgcgcctgtagtcccagctacttgggaggctaagatgggaggattacctgagccctggaggtcaaagctgtggtgagcagtgatttcgccactatattccagcctgagtgacatagtgagaccttgtctcaaaaaaagacaaagagaaagaaaaaaaaacatttgggtgttttcaatgtttgatgattataaatagagcgactataaacttctgagtatagatttttgtgtgaacataagcttttatgtctccagggtaaatacacagaagtgggattacagggccatttggtaagtttgtgtttaactttgtaagaaactgtcaaaccagtgtggctgtaccatttgtatttcctttagaaatgtatgagagttccagttgttctgcatccttgccagaacttcatactatctttatattgttaagatatctatactgccccaaacaatttgcagactcattgcaatttgcagactcattgcaattcctatcaaaatcccagtaacttttttctatttctgcaggaaaaaaaaaaaa

SEQ ID NO: 215778 - DNA, 598 bp, Homo sapiens
tgtgcttacttcagattatctctgaaacaatcagatgtaatggccagtggatgcaaaatacatataaagtaagatttgggattaggaggctcaagggggatggatatgtagagaaaagacctaggaagaacaagaacagggactggcagaaaacacattctgagacaaaggccatttatttagctctggccagttggtttatctagcctgacatttctcaacctgggcgctattggcgttttgtgccaaattattcttgattgtagagagctatcctgtgcattatggtatgtttagtagcatttctgcctctacccagggacaatgctaagcatcctacaataaacaggatggtccctccaaccaagacttatccagcccaaagtgacagggtgctgaggttgagaagccatgtggtatataacacagatgtacacactggaggaaacgtcactgaagtagatgctggtcacttaccagtttcactccttcaggatatcctcttctttaaacgaggaggttgtgactagttacttcccatgaaaagcagctgacccttagggttgaaaagtatgtttattcccaatagcagtgaatg

SEQ ID NO: 215779 - DNA, 429 bp, Homo sapiens
aataatagagacagtctttcattcctagtgccaggacccgtctcgggtcaacgaaatctgagacagtcaaggtaacagaggcagctgttcgaatagattcattggagagtctaaggcagctctccggaccaagctgtaaagcagataagatagaaataatcactctggtaccacagcagacaggccttgtaggtactgggccgctcacagcttaatccgacttagaaagcatttttgcctctgaccttctagttgaaacaaaattagttaccagtagacttaggcgaatgctacactgcacacaggcgcataatcccaacctatataaacactaagacaattgttaacactttaagttggcctggtggaattatctccagccttctgcctgtatctggttacagcaataaattcccttctttcctagtc

SEQ ID NO: 215780 - DNA, 258 bp, Homo sapiens
ggtagatacccagtagtgggattgctggatcgaatggttgatctgcttctagttctttgagaaatcctcacactgttttccatagaggttgtgctaatttacatttccaccaacagtgtataagcattcccttttcactgcatcctcgccaacatctattgtttttttactttattttccatataaaaaggggtttatttagatgttagaatcatctagtgattcagaaagattggacatgaatccacccaggcccag

SEQ ID NO: 215781 - DNA, 444 bp, Homo sapiens
gcaaagtcacatcttacatggcgacagtcaagagaagagatcatgtgcaggggaactcccctttataaacccatcaggtttcgtgagactttttcactatcatgagagcagcatggcaaagacccgcccccatcattcagttacctcccaccaggtccctcccatgacatgtgggaattatgggagctacaatttgagatttgggtgggaacacagccaaaccatatcaatattcaagatcagctttttataaattcagggtagcaagtttttctgtgagttttggggtatagttgcaaaatactactttaaaaccaacttataaattacctgttatattaaatatgataacacaatacaccataaagtctacttgagagatagtttcgtaaaagattttatcttagatttaaagtaatctaatagtacttaaatttctaggct

SEQ ID NO: 215782 - DNA, 160 bp, Homo sapiens
tgtggcctcatgctttacagagaaaatagaagccaccaaagtgagatacctcactaattcaaagtttacagaagccgttcctcctcccacccaaggttaatcccatctcttgagttgtctcagaaaccttatgacctcaatgacccttctgtcttgggta

SEQ ID NO: 215783 - DNA, 259 bp, Homo sapiens
tctgtgtgagaggcttcaagaatcaggcttaggaacctgtaaagcacaaatttttcagagacttattttttaataataattaataaaaatataacttcattgataataggcaaatagattaaaatgtgtatattacattatcgaatgtttcctcagtctttcatataataacttcataatttttgccaaacctcaaaccacctgtaatacatttagttattatctaaaacaaattatttctttttatttcaattaattc

SEQ ID NO: 215784 - DNA, 561 bp, Homo sapiens
ctcactgcaacctccacctcctggactcaagcaatcctgccatctcaccctgccggtagctgggactataggtgtgcaccaccatacccagctaatttttgtatttttaatagagacagtctttcactatgttggccaggctggtctcaaacgcctggcctcaagtgatctgcctaccttgacctcctaaagcactaggattacagacatgagtcactgcaactggctgtcctcagcatctttatgaaaatgcattgagtaggcatcagttgggcacagtgctgagaaaggcactaacaataaaaataaggaattaaaagatttctctctggcgttataaagaaggaaatgctattaaaagaaggaaaatatgtgatgtgtgttttcatctgtattagcatagactatgtctcaaagcacatatatgcaaccggtgcctctggagagggatattgggtgggtaaagcataagatggcagggggacttcctgtatatccttttgtgtgtttcatattttgtactatgtaaatatgttccacctataacattttttagttttt

SEQ ID NO: 215785 - DNA, 534 bp, Homo sapiens
gatggagaggacagttcctccctaatccagcagagttttaaggcacacagactgatcagattccacatgggaggaaggctgggaaggatcatttacaggcagagcttcaattttaagctggaatttgaaaggagcaagaaattttacttggtcggaaagtgggtgaaaatactctgatgggaagagaggtcagagtgataggagaggagaggtttgaggcagtcagacctgggattgagcttgggaacccagtgtcctcatgtaggcctcataacgggttgttgtaaaaattaagcgaggtgaagaacctgaagcctggtaggtggccagaaagtgtcaggccttttgcaggtggtttgcttttgtggtgttctgactctcagctgaaacaggagcttgatagcagtgataataactcttacttttttcttcttcttcttcttctttcttcctttctttttttttttgagacaagttctcgctttgttctccaggctggagtgcagtggtgtgatcatggctcactgcagccgc

SEQ ID NO: 215786 - DNA, 324 bp, Homo sapiens
gtcgacctaacttttgtcatcactattaccagcattgtcatcgttatcgttatcttcgtcatcatcattaccaccgttatacctgatactgccataacaatcagaacattatgtacaggtaaaggggacttcactggggagagcaagttggcaaaatgtagcaagttgccattaagtatgttctagttttttgttaattgactgtttttataatttagtttttattcctggacactgttaagaaacactctattgtctgaggtctacagaccctttgaagtctctgggaaagtttccaaaagttaaaaaaaaaaaagtcgacgc

SEQ ID NO: 215787 - DNA, 371 bp, Homo sapiens
ttctagctaggagttgtatataggccaaattattcaaaagagtaagaaaagaaatactacttatggatatcaaattcttaaaagtgacaggttatatgaaatgtccaggaccggaaacactttagagacagaaagtagattagtagttgcctagggctcggtgtggaagtagagattaaatgtaaaaagataagagaggaatcttatcttttaagaaccgatggaaatgttctaaaactggtttatggtgctggttgtagaactcagtaaatttactgaaaatcactgaattatatagaaaatataccgcagtaagttggttttttaaatgacaaggtgatcatttggacttagcattttaattgggactg

SEQ ID NO: 215788 - DNA, 124 bp, Homo sapiens
tgagcatacgtgttacagtttgagttattttcctttagaaaccccttcaagcccttttagttatctgttgccaggctttaggggaaattttttttcatgtttgtttatttacatagtcagctga

SEQ ID NO: 215789 - DNA, 816 bp, Homo sapiens
ttgcatgattcaatttatatgaaatacctaaaataaataaatccatagagaaagaacacagattagtggttactagggaatagaggaaggggagaatgggggagaaagtgcttaattggtaagaggttttcctttggaatgatcgaagtgttttggaattagaagtggctattgcacaacactgtgaatgtactaaatgccactgaattgttcactttaaaatgattactttcatattatgtgatttttactcaataaattatataaaatgtgtaaatggtctaaacatcccaataaacagagatcttcaggctgaattaaaaaaacacccaactatatgatgcccattttaactataaaggttatatttaaattacaaaggtcatatttaaattataataaataaggttatattaaaatataaataggttaaaagcaaaacaaaaaaaaagaaaaagatataccatgctaatgctaattttaaaaagctgaagtagaccaggtgctgtggctcacgcctgtaaacctaacactttgggaggctgaggcaggagcccagtttaagaccagcctggcaacacagggagacctcgtctttataaaaaatcaaaaaattagccaggcatggtggtgtgtgcctgtggttccagctactccgaagggtgaggtgagaggatcacttgagcccagaggtcgaggctgcagtgagctgtgattgcaccactgggctcgagcctgggtgacagagcaagacccagtctgaaaaattaaaaaatactaagctggagtagatataccactatcaaagtagatttg

SEQ ID NO: 215790 - DNA, 259 bp, Homo sapiens
tttcaccacgttggccaggatggtctctatctcctgacctcatgatctgcctgccttggcctcccaaagtgctgggattacgggtgtgagccaccttgcccagccagccaccacgcctggcctcttttttttttcttttttttttgagatggagtctccctcttatcgcccaggctggagtgcagtggtgtgatcttggctcactgcaacaacattctgcctcccgggttcaagcaattctcctgcctcagcctccaga

SEQ ID NO: 215791 - DNA, 520 bp, Homo sapiens
ctcaacagtttttaaaaaatcaaaatcatatcaagatcacaatggtctgaaactctaaatcaataataagaggaactttggaaactacaaacacatggaaattaaacaacatgctcctgaatgaccactggattaaagaaaaagttaaggaaaaaatgttttaaaaatttcctgaaacaaatgaaaatggaaacgcaagacaccaaaacttacaggacacacaaaagcactgctaagagggaagtttatagcaataagcatctagatcaaaaaagcagaaagagaaaaaaagcttcctcatgctgaaaaagtgggtcgcccaaaagagggtctctagtttgtggcaaaacataatcggttttgtacagaggcttgaggaggcagtgattgatttacatagggctcaggggattgggtttaccaggtgtgccatttacatagcttgcaaaaagactggccctctgaccctagtcttttattatgcaaatgcggcctccacctggtggaggccatgatgcct

SEQ ID NO: 215792 - DNA, 473 bp, Homo sapiens
ataataaagatcagagcagaactaaattaaatagagactaaaaaatttacaaagcatcaacaaaatgaaaagttttttttcaaaaaaagataaaattgataaactgctagtgaaatggctccattttctggggtatataccctggttctttgtcacagttgagaaagaattcaagacatggacacacacaaggagtggatttaggagcggaaagtttaatagaaaaagaagaaagagaaaaaaagcttcctcatgctgaaaaagtgggtcgcccaaaagagggtctctagtttgtggcaaaacataatcggttttgtacagaggcttgaggaggcagtgattgatttacatagggctcaggggattgggtttaccaggtgtgccatttacatagcttgcaaaaagactggccctctgaccctagtcttttattatgcaaatgcggcctccacctggtggaggccatgatgcct

SEQ ID NO: 215793 - DNA, 352 bp, Homo sapiens
agaaatagcctatctcagcaggcatcgttctgctttgcttattgagccaacatttatgaagcatagacttcataccgagctcaatgcaaacagactcacctctagcaaggctcaagggaggcaacaaaagaaatagaaaacacggcccttgtcaacaaacctaggattaagttggagtggccgggcgaatatactgaggaaacattggttttcttttttaacccttttcgaagtctatttaatgtctgcctactgaatatttaattattaacaacaggagttgaccccccctggccatttttgtatgtcccacgctgggtttttccattttcagatagttaaggcaaaaaga

SEQ ID NO: 215794 - DNA, 638 bp, Homo sapiens
ttttaagacacggggtctcagtctgtcactcaggctggaatgcagtagcacaatcataactcactgcagccttgaacttctgggctcaagtgatcttcccacctcagcctcccagagctgggattgtatgtgtgaaccaccattcctggcttgatctgccttaatatgccataaatccttgcttggcatcctttcaaattcaataaacctatttacctacaaaagtagataagatcatcatgtctaccttaattgtttgcccctaatatttggatatacagcactacaaaatatttttaaaaatattgtgtccctggcattgtaacaaaaaagttttcaaaacaaagcactggatgagtccacaatattattgttaactaccttaaaaacagtcacaatatctgagaagatataaaataactgccaaagacagtccaaccaatcattcaacgtatgttaaaagaaaaaaaagcataacaagggaatcttgaatactccagtgcctgctacaccaagtgtgctctgtagactacagcatcagcagcacctaggagtttatcagaaatgaagaactgcaggtcctaactcagacctactaaacccgaaagtgcaattgaacaggctcccaaggtgatctt

SEQ ID NO: 215795 - DNA, 411 bp, Homo sapiens
tttcatgacatcatttcttatctcaagctaaattctttctctggaggaccttatctaatcctaggatgttgtatctctagctctaatctctcttctgggctccagacctgtatatcctcttgtctacaagacttttacatctgggagtcctataagtagtttaaattcaatatattcaaacctcaactcattatcaatctctgtaagatcctttttctgtgttcctgatttaaagacactgcagctcagtcattcaagtgtgtggaaacgtagaacttttgtaggctgggctgtctgtattacaagctcctgcggtataatgagtatttcttcagccacatcctttaaattttaatttaatagttctgggattggccagggaatacaaactttataatttccccaggtgct

SEQ ID NO: 215796 - DNA, 787 bp, Homo sapiens
gcgatctagaggaccccttattttccttctttattgcctacactagaggaaagacacaagtacaagaagttgctttaatttgaactgcagtacttgatgctccatgtgaagaactttaacaaactccaggctcaggaggaggccggcctgctgcagggccatcaaggaaagcacaagaaagcttgtagcagtaagaacaacaaaggaaagaaggaatgactgggggactggcagccttgttttccctttgccatttggaaggaaaaaaacctaggcttattataggaggaaaaaataataattaaaagtatgtatgatgtattatatatatacgcacacatgcacctgcatatatacatcgtactagctaatgttttcagtggtttccattttctagtgctgtagaacacaaattgtcctatattgcctcaattttaccttttttcttctctctttagaatataggaaatctgtgacatttaaaagtgaaaggaccctacaaaaaattaactcaaagtggatcatagacctcagcgtaagaactaaaactatataacaattagaagcaaacacaggagtaaatctgtatgaccttgggttaggcagtgatttcttagatacaacaccaaaccataggtgacaaaagaaaaaaatggataaactggacttcataaaaattaaaaactcttgtgcttcaaaggacaccatcaagaaagtgaaaatgcagtccaaagaaagggagaagatatttccaaataatttatctggtaagggacttgaatctaga

SEQ ID NO: 215797 - DNA, 1062 bp, Homo sapiens
acgcccggccctgcccccagcagaggcggaagcggtgtcgctctgaggggtcgccagtcgccgcaggcgcttcagcccagcggcgggccttggcccttggctgcctactcctaccgccccagccccgggcggccctgggcctgctgcgggcgcggcgctgcccgaccagagcttcctgtggaacgtcttccagagggtcgataaagacaggagtggagtgatatcagacaccgagcttcagcaagctctctccaacggtgagtgggccagtgggaactgggtctccggaccaagaagccgtgagcctgccctgttcacagtggataactttctgaagttgtttttccaaggacaaaggaatcattaggacaaattgttaatactgcttcatggtggagatgcttctggtttattttgtggctaccgctgttactgcttggagtgcctcaccgagccaggcacgtggactccctttaatccagtgactgtcaggtcgatcatatactacactgaaggctggttacgctcttatgtgcaatagaacctcaaacacatcgtaacacacctttggagaatccttacaagaacaccaagttaacagttatctctgaccacactacctcagcaaaaaaccaggaagaaaaaatattcttcaacccttttcagggacagaaagcatcatttcaaaagtccaagaagggaagcaaaacttctgacctgagacatcgaagcagataaaaagccgctacacaaaatgtatcgctacaactagagggcagtcttgcctttcttccattcaattattcagtttctcatgttcctaagtgccagcccagaaccatggaatgtgaagaaacacaaaactcactcctctgcatcagtgaattgattgtgtggtggggatgtaagtctgcatgtgactgacagttccccaaagtggtgccaagtcaatctaaactagagagaatttctggccaggccaagcagagatttcatggatgaagtctcccaaagactgatttcctaaacattaaacatcactggttttccaaaaaaggtttt

SEQ ID NO: 215798 - DNA, 949 bp, Homo sapiens
acgcccggccctgcccccagcagaggcggaagcggtgtcgctctgaggggtcgccagtcgccgcaggcgcttcagcccagcggcgggccttggcccttggctgcctactcctaccgccccagccccgggcggccctgggcctgctgcgggcgcggcgctgcccgaccagagcttcctgtggaacgtcttccagagggtcgataaagacaggagtggagtgatatcagacaccgagcttcagcaagctctctccaacggacaaaggaatcattaggacaaattgttaatactgcttcatggtggagatgcttctggtttattttgtggctaccgctgttactgcttggagtgcctcaccgagccaggatgaagccccacccgcccttcaggatgccagccttggcaacatcgtgagaccctgtttctacaaaaactaaacaagtgtagtggtgcacgcctgtattcccagctacttgggaggctgagatgggaagatcacttgagcctgggaggttgaggctgcattgagctgagatcaagccacggcactccagcctgggagacagagcgaaaccccatctcaaaaaaacaaagaaagtggatgcgtgctgctcctgccattggatcatcgcagcatttttcttttctctgatatgcgcctttttcctcatcgtgggggctcatgttttcgtaattccctctcgctactagattgtgagctgtgtgaaggaagaacggtgacggtgttgtcaggcccaaacttgtcttggttaccaatttacccttctttctctcgatttttttgaacaaaggggagggggccctgcttccgggggggaacctaggcagggcccccctataatattatgggggagaatgaggacaaggaaggctaaaaaggcacagggggggagaacaacatcaacacatattgagagaagcagggcgt

SEQ ID NO: 215799 - DNA, 799 bp, Homo sapiens
  misc_feature (796)..(796): n is a, c, g, or t
tcccaccccccgcggttcctgccccccaaagctcgaccccggtgtggtgcgcaggcgtagtctgcgcggggactggcgggactgcgcggaggcgactacaggcatggcggtctgggtcctgtcgcgcctgctgagcgctccgcgcctggcgctggccaaggcggtcctgaggcacgtgaatggccaggatcagattgtgcccggcctgtacgcctgtggggaggccgcctgtgcctcggtacatggtgccaatcggctcggggcaaactcgctcttggacttggttgtctttggtcaggcatgtgccctgagcatcgaagagtcatgcaggcctggagataaagtccctccaattaaaccaaacgctggggaagaatctgtcatgaatcttgacaaattgagatttgctgatggaagcataagaacatgagaactgcgactcagcatgcagaagtgccgctgggttagggtctccacaaccgagctggtctcagcaagtggcgcccacacatgggggctcgaatccaggtcgaagggtcaccggagcgacagaaaacttggaactaagctggaggacaccgagtactcttatgcagtccccatgaggttatgcttatgtttctccaggactgaaccatcaagacacctgaaaccttatcatgagcgaatgctgaggaagagattccgggaggatcccgaggacccccccagttgcagcatgtcaagactgatgctgaggaggacccaattgtcacgaggcaaaacccgtcaaaaaaggcatccactgaggtcagantca

SEQ ID NO: 215800 - DNA, 886 bp, Homo sapiens
cggacgcgtgggtcgacccacgcgtccggttcatagttgagttgtatgtacaggcacacaaaatttgtccttggatagacacatatcaatccacttccttctcctctctgaatttctttatttaaaaaaaaaagtagagatggagtctcactgtcttgcccaggctggtgtcaaactcctaggctcaagtgatcctcccacctctactaatatgaattattaggctatgctaatatgaatttgtatactaatatgattgaaattagtttgacttctataataattgttctcccagattgggcttctgttttgatagtagaactaaattattaggctatttcaagaaattaatatattactggtagaaaaactgaagctacaaaatggcctggtttctcacttcagttaaatttgtgcttctgagtgcttgtattctaggtgaaaccgcactgagaaggtatttgtggcctatacgctgattcattgattagacttctttgcacaggagagctgctaaaaattactgcggtgaacaggtacgaagaaaaagactgttctctgcccttctttttgcaataaaatgttacaaactaaaacaaaccaaacaaccccaacaaaccacctacaaccacaaaaaaaagagggggccgcccaaaaaaaccccctcaaggcgccccatatcatgcatataccccggactgagagcaaacaagaccatgcccctcatgacctgaaggtctacataacaccccaagtccaccgccccgaaggttataaaaacggtacgcagaagcgggcaaaacgaccgtaacacaggagaccactgtgggacaaggacacccacacctgaggggcggaaaacaacatggggcacgacgactcagca

SEQ ID NO: 215801 - DNA, 775 bp, Homo sapiens
  misc_feature (772)..(772): n is a, c, g, or t
tcccaccccccgcggttcctgccccccaaagctcgaccccggtgtggtgcgcaggcgtagtctgcgcggggactggcgggactgcgcggaggcgactacaggcatggcggtctgggtcctgtcgcgcctgctgagcgctccgcgcctggcgctggccaaggcggtcctgaggcacgtgaatggccaggatcagattgtgcccggcctgtacgcctgtggggaggccgcctgtgcctcggtacatggtgccaatcggctcggggcaaactcgctcttggacttggttgtctttggtcaggcatgtgccctgagcatcgaagagtcatgcaggcctggagataaagtccctccaattaaaccaaacgctggggaagaatctgtcatgaatcttgacaaattgagatttgctgatggaagcataagaacatgagaactgcgactcagcatgcagaagtgccgctgggttagggtctccacaaccgagctggtctcagcaagtggcgcccacacatgggggctcgaatccaggtcgaagggtcaccggagcgacagaaaacttggaactaagctggaggacaccgagtactcttatgcagtccccatgactgaaccatcaagacacctgaaaccttatcatgagcgaatgctgaggaagagattccgggaggatcccgaggacccccccagttgcagcatgtcaagactgatgctgaggaggacccaattgtcacgaggcaaaacccgtcaaaaaaggcatccactgaggtcagantca

SEQ ID NO: 215802 - DNA, 1190 bp, Homo sapiens
acgcccggccctgcccccagcagaggcggaagcggtgtcgctctgaggggtcgccagtcgccgcaggcgcttcagcccagcggcgggccttggcccttggctgcctactcctaccgccccagccccgggcggccctgggcctgctgcgggcgcggcgctgcccgaccagagcttcctgtggaacgtcttccagagggtcgataaagacaggagtggagtgatatcagacaccgagcttcagcaagctctctccaacggatgaagccccacccgcccttcaggatgccagccttggcaacatcgtgagaccctgtttctacaaaaactaaacaagtgtagtggtgcacgcctgtattcccagctacttgggaggctgagatgggaagatcacttgagcctgggaggttgaggctgcattgagctgagatcaagccacggcactccagcctgggagacagagcgaaaccccatctcaaaaaaacaaagaaagtggatgcgtgctgctcctgccattggatcatcgcagcatttttcttttctctgatatgcgcctttttcctcatcgtgggggctcatgttttcgtaattccctctcgctactagattgtgagctgtgtgaaggaaggttcatagttgagttgtatgtacaggcacacaaaatttgtccttggatagacacatatcaatccacttccttctcctctctgaatttctttatttaaaaaaaaaagtagagatggagtctcactgtcttgcccaggctggtgtcaaactcctaggctcaagtgatcctcccacctctactaatatgaattattaggctatgctaatatgaatttgtatactaatatgattgaaattagtttgacttctataataattgttctcccagattgggcttctgttttgatagtagaactaaattattaggctatttcaagaaattaatatattactggtagaaaaactgaagctacaaaatggcctggtttctcacttcagttaaatttgtgcttctgagtgcttgtattctaggtgaaaccgcactgagaaggtatttgtggcctatacgctgattcattgattagacttctttgcacaggagagctgctaaaaattactgcggtgaacaggtacgaagaaaaagactgttctctgcccttctttttgcaataaaatgttacaaacta

SEQ ID NO: 215803 - DNA, 1663 bp, Homo sapiens
acgcccggccctgcccccagcagaggcggaagcggtgtcgctctgaggggtcgccagtcgccgcaggcgcttcagcccagcggcgggccttggcccttggctgcctactcctaccgccccagccccgggcggccctgggcctgctgcgggcgcggcgctgcccgaccagagcttcctgtggaacgtcttccagagggtcgataaagacaggagtggagtgatatcagacaccgagcttcagcaagctctctccaacggtgagtgggccagtgggaactgggtctccggaccaagaagccgtgagcctgccctgttcacagtggataactttctgaagttgtttttccaaggacaaaggaatcattaggacaaattgttaatactgcttcatggtggagatgcttctggtttattttgtggctaccgctgttactgcttggagtgcctcaccgagccaggatgaagccccacccgcccttcaggatgccagccttggcaacatcgtgagaccctgtttctacaaaaactaaacaagtgtagtggtgcacgcctgtattcccagctacttgggaggctgagatgggaagatcacttgagcctgggaggttgaggctgcattgagctgagatcaagccacggcactccagcctgggagacagagcgaaaccccatctcaaaaaaacaaagaaagtggatgcgtgctgctcctgccattggatcatcgcagcatttttcttttctctgatatgcgcctttttcctcatcgtgggggctcatgttttcgtaattccctctcgctactagattgtgagctgtgtgaaggaaggttcatagttgagttgtatgtacaggcacacaaaatttgtccttggatagacacatatcaatccacttccttctcctctctgaatttctttatttaaaaaaaaaagtagagatggagtctcactgtcttgcccaggctggtgtcaaactcctaggctcaagtgatcctcccacctctactaatatgaattattaggctatgctaatatgaatttgtatactaatatgattgaaattagtttgacttctataataattgttctcccagattgggcttctgttttgatagtagaactaaattattaggctatttcaagaaattaatatattactggtagaaaaactgaagctacaaaatggcctggtttctcacttcagttaaatttgtgcttctgagtgcttgtattctaggtgaaaccgcactgagaaggtatttgtggcctatacgctgattcattgattagacttctttgcacaggagagctgctaaaaattactgcggtgaacaggtacgaagaaaaagactgttctctgcccttctttttgcaataaaatgttacaaactatcttgagtttgatcccttttcgggtgtttgggttttttttaacattcacatatttcttggaattataagaaattaactttgtgcttctgaagtgggtttgccttaatataacactgatgtatttgtaaggggcatttttaaagctgtactttaaaaaataataattcttacattcatttgaaggttttttgtttgtttgtttgtttgtttgtttttgagctgaaggcttgtccagcctgggggacagtgagactccatctcaaaaaaaaaaa

SEQ ID NO: 215804 - DNA, 1620 bp, Homo sapiens
acgcccggccctgcccccagcagaggcggaagcggtgtcgctctgaggggtcgccagtcgccgcaggcgcttcagcccagcggcgggccttggcccttggctgcctactcctaccgccccagccccgggcggccctgggcctgctgcgggcgcggcgctgcccgaccagagcttcctgtggaacgtcttccagagggtcgataaagacaggagtggagtgatatcagacaccgagcttcagcaagctctctccaacggatgaagctccacccgcccttcaggatgcaaagccctcctctataaagtgcatgcggggccagatgcagtggctcacatctgacctcccaacactttgggaggccgaggcagggggatcgcttgagcccaggagtttgagaccagcctggacaacattgatgaagccccacccgcccttcaggatgccagccttggcaacatcgtgagaccctgtttctacaaaaactaaacaagtgtagtggtgcacgcctgtattcccagctacttgggaggctgagatgggaagatcacttgagcctgggaggttgaggctgcattgagctgagatcaagccacggcactccagcctgggagacagagcgaaaccccatctcaaaaaaacaaagaaagtggatgcgtgctgctcctgccattggatcatcgcagcatttttcttttctctgatatgcgcctttttcctcatcgtgggggctcatgttttcgtaattccctctcgctactagattgtgagctgtgtgaaggaaggttcatagttgagttgtatgtacaggcacacaaaatttgtccttggatagacacatatcaatccacttccttctcctctctgaatttctttatttaaaaaaaaaagtagagatggagtctcactgtcttgcccaggctggtgtcaaactcctaggctcaagtgatcctcccacctctactaatatgaattattaggctatgctaatatgaatttgtatactaatatgattgaaattagtttgacttctataataattgttctcccagattgggcttctgttttgatagtagaactaaattattaggctatttcaagaaattaatatattactggtagaaaaactgaagctacaaaatggcctggtttctcacttcagttaaatttgtgcttctgagtgcttgtattctaggtgaaaccgcactgagaaggtatttgtggcctatacgctgattcattgattagacttctttgcacaggagagctgctaaaaattactgcggtgaacaggtacgaagaaaaagactgttctctgcccttctttttgcaataaaatgttacaaactatcttgagtttgatcccttttcgggtgtttgggttttttttaacattcacatatttcttggaattataagaaattaactttgtgcttctgaagtgggtttgccttaatataacactgatgtatttgtaaggggcatttttaaagctgtactttaaaaaataataattcttacattcatttgaaggttttttgtttgtttgtttgtttgtttgtttttgagctgaaggcttgtccagcctgggggacagtgagactccatctcaaaaaaaaaaa

SEQ ID NO: 215805 - DNA, 1135 bp, Homo sapiens
tacttgttctcggtctactagtctctcggctctaccttgtctctcggctctaccttgtctctcggctctaccttgtctcccaggctgcattgagctgagatcaagccacggcactccagcctgggagacagagcgaaaccccatctcaaaaaaacaaagaaagtggatgcgtgctgctcctgccattggatcatcgcagcatttttcttttctctgatatgcgcctttttcctcatcgtgggggctcatgttttcgtaattccctctcgctactagattgtgagctgtgtgaaggaaggttcatagttgagttgtatgtacaggcacacaaaatttgtccttggatagacacatatcaatccacttccttctcctctctgaatttctttatttaaaaaaaaaagtagagatggagtctcactgtcttgcccaggctggtgtcaaactcctaggctcaagtgatcctcccacctctactaatatgaattattaggctatgctaatatgaatttgtatactaatatgattgaaattagtttgacttctataataattgttctcccagattgggcttctgttttgatagtagaactaaattattaggctatttcaagaaattaatatattactggtagaaaaactgaagctacaaaatggcctggtttctcacttcagttaaatttgtgcttctgagtgcttgtattctaggtgaaaccgcactgagaaggtatttgtggcctatacgctgattcattgattagacttctttgcacaggagagctgctaaaaattactgcggtgaacaggtacgaagaaaaagactgttctctgcccttctttttgcaataaaatgttacaaactatcttgagtttgatcccttttcgggtgtttgggttttttttaacattcacatatttcttggaattataagaaattaactttgtgcttctgaagtgggtttgccttaatataacactgatgtatttgtaaggggcatttttaaagctgtactttaaaaaataataattcttacattcatttgaaggttttttgtttgtttgtttgtttgtttgtttttgagctgaaggcttgtccagcctgggggacagtgagactccatctcaaaaaaaaaaa

SEQ ID NO: 215806 - DNA, 1218 bp, Homo sapiens
acgcccggccctgcccccagcagaggcggaagcggtgtcgctctgaggggtcgccagtcgccgcaggcgcttcagcccagcggcgggccttggcccttggctgcctactcctaccgccccagccccgggcggccctgggcctgctgcgggcgcggcgctgcccgaccagagcttcctgtggaacgtcttccagagggtcgataaagacaggagtggagtgatatcagacaccgagcttcagcaagctctctccaacggcacgtggactccctttaatccagtgactgtcaggtcgatcatatactacactgaaggctggttacgctcttatgtgcaatagaacctcaaacacatcgtaacacacctttggagaatccttacaagaacaccaagttaacagttatctctgaccacactacctcagcaaaaaaccaggaagaaaaaatattcttcaacccttttcagggacagaaagcatcatttcaaaagtccaagaagggaaggtaagaatttcagaagtgaaagttatcatgaaaggctataaaagcttgagatgagtctgaaaaacaaatggaaaatgagtcacttcagggcctctcccagcctcaaagccaattaattattacattagtcagagtaattttaagccttccaatccactcaccctagccacaggcaacagtagcctctccaagtgttaagggtttttttcccaagcctgcaggcggatgagctttttacatggcagccccttaggattggatgtggacctgccctgtctttcaccaagaagcaagcactgcgcagatcactgaatcataaaaaccacctgctcttaccagcctcctcttcctctacagcaaaacttctgacctgagacatcgaagcagataaaaagccgctacacaaaatgtatcgctacaactagagggcagtcttgcctttcttccattcaattattcagtttctcatgttcctaagtgccagcccagaaccatggaatgtgaagaaacacaaaactcactcctctgcatcagtgaattgattgtgtggtggggatgtaagtctgcatgtgactgacagttccccaaagtggtgccaagtcaatctaaactagagagaatttctggccaggccaagcagagatttcatggatgaagtctcccaaagactgatttcctaaacattaaacatcactggttttccaaaaaaggtttt

SEQ ID NO: 215807 - DNA, 507 bp, Homo sapiens
cttcttagcagctctcctgtgcaaagaagtctaatcaatgaatcagcgtataggccacaaataccttctcagtgcggtttcacctagaatacaagcactcagaagcacaaatttaactgaagtgagaaaccaggccattttgtacaggagagctgctaaaaattactgcggtgaacaggtacgaagaaaaagactgttctctgcccttctttttgcaataaaatgttacaaactatcttgagtttgatcccttttcgggtgtttgggttttttttaacattcacatatttcttggaattataagaaattaactttgtgcttctgaagtgggtttgccttaatataacactgatgtatttgtaaggggcatttttaaagctgtactttaaaaaataataattcttacattcatttgaaggttttttgtttgtttgtttgtttgtttgtttttgagctgaaggcttgtccagcctgggggacagtgagactccatctcaaaaaaaaaaa

SEQ ID NO: 215808 - DNA, 992 bp, Homo sapiens
  misc_feature (989)..(989): n is a, c, g, or t
gttgtctcattacggaaggatgtcgtggagagggaggcattctcattaacagtcaaggcgaaaggtttactggagcgatacgcccctgtcgcgaaggacctggcgtctagcagatgtggtgtctcggtcgatgactctggagatccgacggaaggacgaggctgtggccctgcagaaagatcacgtctacctgcagctgtgccacctacctccagagcagctggccatgcgcctgccttggcactttcagagcacagccatgatcttcgctggcgtggacgtcacgaaggagccgatccctgtcctccccaccgtgcattataacatgggcggcattcccaccaactacaaggggcgtcctgaggcacgtgaatggccaggatcagattgtgcccggcctgtacgcctgtggggaggccgcctgtgcctcggtacatggtgccaatcggctcggggcaaactcgctcttggacttggttgtctttggtcaggcatgtgccctgagcatcgaagagtcatgcaggcctggagataaagtccctccaattaaaccaaacgctggggaagaatctgtcatgaatcttgacaaattgagatttgctgatggaagcataagaacatgagaactgcgactcagcatgcagaagtgccgctgggttagggtctccacaaccgagctggtctcagcaagtggcgcccacacatgggggctcgaatccaggtcgaagggtcaccggagcgacagaaaacttggaactaagctggaggacaccgagtactcttatgcagtccccatgaggttatgcttatgtttctccaggactgaaccatcaagacacctgaaaccttatcatgagcgaatgctgaggaagagattccgggaggatcccgaggacccccccagttgcagcatgtcaagactgatgctgaggaggacccaattgtcacgaggcaaaacccgtcaaaaaaggcatccactgaggtcagantca

SEQ ID NO: 215809 - DNA, 957 bp, Homo sapiens
  misc_feature (940)..(940): n is a, c, g, or t
  misc_feature (943)..(943): n is a, c, g, or t
acgcccggccctgcccccagcagaggcggaagcggtgtcgctctgaggggtcgccagtcgccgcaggcgcttcagcccagcggcgggccttggcccttggctgcctactcctaccgccccagccccgggcggccctgggcctgctgcgggcgcggcgctgcccgaccagagcttcctgtggaacgtcttccagagggtcgataaagacaggagtggagtgatatcagacaccgagcttcagcaagctctctccaacggtgagtgggccagtgggaactgggtctccggaccaagaagccgtgagcctgccctgttcacagtggataactttctgaagttgtttttccaaggacaaaggaatcattaggacaaattgttaatactgcttcatggtggagatgcttctggtttattttgtggctaccgctgttactgcttggagtgcctcaccgagccaggcacgtggactccctttaatccagtgactgtcaggtcgatcatatgtcctgaggcacgtgaatggccaggatcagattgtgcccggcctgtacgcctgtggggaggccgcctgtgcctcggtacatggtgccaatcggctcggggcaaactcgctcttggacttggttgtctttggtcaggcatgtgccctgagcatcgaagagtcatgcaggcctggagataaagtccctccaattaaaccaaacgctggggaagaatctgtcatgaatcttgacaaattgagatttgctgatggaagcataagaacatgagaactgcgactcagcatgcagaagtgccgctgggttagggtctccacaaccgagctggtctcagcaagtggcgcccacacatgggggctcgaatccaggtcgaagggtcaccggagcggcggaagggtatcctaagagtcgagagcatactgatgtatcagtcgataganagncaataaatatattc

SEQ ID NO: 215810 - DNA, 128 bp, Homo sapiens
ctttaatccagtgactgtcaggtcgatcatatgtaagtatcggcagacggaccaacctgggctgctttgtatccgacccgcttgggtacccgcttgtgtttcctttgtctgtgggtccgtatcacttt

SEQ ID NO: 215811 - DNA, 507 bp, Homo sapiens
ttaaccctgttgctcaggctggagggcaagtggtgccatctccactcactgcagcctcgacctcccaggctccactgatcttcccacctcagcctcctgagtagctgggactacaggtgtgcaccgccacgactcgctaatttttgtattttttgtagagacggggttttgctgtgttgctcaggctggtcactcgatctgcccacctgggcctcgcagagtgctggggttacaggtatgagccaccacgcccagcccactggtttcctttacacccgttttgttccccagcagtccttatgagggcacctgaaataaggaacctcctccccgacttgagagcagcaaagccttcagagggaactaagttattaaaacccaccccacacaaaatgcttctaaacgccttggctgacttaatccttgcagtgtgctgaggttaagtatgattatccatctcctgtgaacaggaagactgaggctcagagcttaagtgatttgcccacg

SEQ ID NO: 215812 - DNA, 351 bp, Homo sapiens
tcgaggtcgcgccactgcactccagcctggtgacagaacgagactccgtctcaaaaaaaaagaaaaagaaaaaggaaaaaaaaacaagaccttaggtgaaagcgactcacaatctggttggggaaagtggagaaaacagacatgtcttaagcatctgaagtgcaggtagaatcaggtaagttctctggtacaaatatatttaaatgtatggctgctgcgatggttaattttgtttgtcaacttgacggcatcatgaggtgctcagatacatggttaagcattatttctgggcgtgtctgtaagggtgtttttggatgagattagcaattgaacctttaaaccaatttctta

SEQ ID NO: 215813 - DNA, 1064 bp, Homo sapiens
  misc_feature (653)..(653): n is a, c, g, or t
  misc_feature (655)..(655): n is a, c, g, or t
  misc_feature (1064)..(1064): n is a, c, g, or t
tcccaccccccgcggttcctgccccccaaagctcgaccccggtgtggtgcgcaggcgtagtctgcgcggggactggcgggactgcgcggaggcgactacaggcatggcggtctgggtcctgtcgcgcctgctgagcgctccgcgcctggcgctggccaaggcggtcctgaggcacgtgaatggccaggatcagattgtgcccggcctgtacgcctgtggggaggccgcctgtgcctcggtacatggtgccaatcggctcggggcaaactcgctcttggacttggttgtctttggtcaggcatgtgccctgagcatcgaagagtcatgcaggcctggagataaagtccctccaattaaaccaaacgctggggaagaatctgtcatgaatcttgacaaattgagatttgctgatggaagcataagaacatgagaactgcgactcagcatgcagaagtgccgctgggttagggtctccacaaccgagctggtctcagcaagtggcgcccacacatgggggctcgaatccaggtcgaagggtcaccggagcgacagaaaacttggaactaagctggaggacaccgagtactcttatgcagtccccatgatacagcagtacctggaaagaagctaaagctattatccagcgatgcccnanttgccaaatggtacattcctcatcttttacaggaggagttaatcctcgaggattggaacctaattctcaagctctagctaaattttctctatacggaatattaaacacattactgttatccatataattctgaaggacagccatagtggaagaatgaatctctcctggagacagcagtgcagaagcaaaggggaacaggattgaccatcagaacctgaaacttatcagagcaatgtggggaagagatccggaggatccgggacacccagtgagctgtagatgatgcggggcccaagtgggaaccgaacacccatgagtaaaagtgacagggaaacgtgtggcgcgaagccgaaagttttaagagagctggtgcagtctcgggactaaagcggtcagcgtacacccaatn

SEQ ID NO: 215814 - DNA, 914 bp, Homo sapiens
  misc_feature (911)..(911): n is a, c, g, or t
acgcccggccctgcccccagcagaggcggaagcggtgtcgctctgaggggtcgccagtcgccgcaggcgcttcagcccagcggcgggccttggcccttggctgcctactcctaccgccccagccccgggcggccctgggcctgctgcgggcgcggcgctgcccgaccagagcttcctgtggaacgtcttccagagggtcgataaagacaggagtggagtgatatcagacaccgagcttcagcaagctctctccaacggcacgtggactccctttaatccagtgactgtcaggtcgatcatatgtcctgaggcacgtgaatggccaggatcagattgtgcccggcctgtacgcctgtggggaggccgcctgtgcctcggtacatggtgccaatcggctcggggcaaactcgctcttggacttggttgtctttggtcaggcatgtgccctgagcatcgaagagtcatgcaggcctggagataaagtccctccaattaaaccaaacgctggggaagaatctgtcatgaatcttgacaaattgagatttgctgatggaagcataagaacatgagaactgcgactcagcatgcagaagtgccgctgggttagggtctccacaaccgagctggtctcagcaagtggcgcccacacatgggggctcgaatccaggtcgaagggtcaccggagcgacagaaaacttggaactaagctggaggacaccgagtactcttatgcagtccccatgactgaaccatcaagacacctgaaaccttatcatgagcgaatgctgaggaagagattccgggaggatcccgaggacccccccagttgcagcatgtcaagactgatgctgaggaggacccaattgtcacgaggcaaaacccgtcaaaaaaggcatccactgaggtcagantca

SEQ ID NO: 215815 - DNA, 1462 bp, Homo sapiens
acgcccggccctgcccccagcagaggcggaagcggtgtcgctctgaggggtcgccagtcgccgcaggcgcttcagcccagcggcgggccttggcccttggctgcctactcctaccgccccagccccgggcggccctgggcctgctgcgggcgcggcgctgcccgaccagagcttcctgtggaacgtcttccagagggtcgataaagacaggagtggagtgatatcagacaccgagcttcagcaagctctctccaacggatgaagccccacccgcccttcaggatgccagccttggcaacatcgtgagaccctgtttctacaaaaactaaacaagtgtagtggtgcacgcctgtattcccagctacttgggaggctgagatgggaagatcacttgagcctgggaggttgaggctgcattgagctgagatcaagccacggcactccagcctgggagacagagcgaaaccccatctcaaaaaaacaaagaaagtggatgcgtgctgctcctgccattggatcatcgcagcatttttcttttctctgatatgcgcctttttcctcatcgtgggggctcatgttttcgtaattccctctcgctactagattgtgagctgtgtgaaggaaggttcatagttgagttgtatgtacaggcacacaaaatttgtccttggatagacacatatcaatccacttccttctcctctctgaatttctttatttaaaaaaaaaagtagagatggagtctcactgtcttgcccaggctggtgtcaaactcctaggctcaagtgatcctcccacctctactaatatgaattattaggctatgctaatatgaatttgtatactaatatgattgaaattagtttgacttctataataattgttctcccagattgggcttctgttttgatagtagaactaaattattaggctatttcaagaaattaatatattactggtagaaaaactgaagctacaaaatggcctggtttctcacttcagttaaatttgtgcttctgagtgcttgtattctaggtgaaaccgcactgagaaggtatttgtggcctatacgctgattcattgattagacttctttgcacaggagagctgctaaaaattactgcggtgaacaggtacgaagaaaaagactgttctctgcccttctttttgcaataaaatgttacaaactatcttgagtttgatcccttttcgggtgtttgggttttttttaacattcacatatttcttggaattataagaaattaactttgtgcttctgaagtgggtttgccttaatataacactgatgtatttgtaaggggcatttttaaagctgtactttaaaaaataataattcttacattcatttgaaggttttttgtttgtttgtttgtttgtttgtttttgagctgaaggcttgtccagcctgggggacagtgagactccatctcaaaaaaaaaaa

SEQ ID NO: 215816 - DNA, 1728 bp, Homo sapiens
acgcccggccctgcccccagcagaggcggaagcggtgtcgctctgaggggtcgccagtcgccgcaggcgcttcagcccagcggcgggccttggcccttggctgcctactcctaccgccccagccccgggcggccctgggcctgctgcgggcgcggcgctgcccgaccagagcttcctgtggaacgtcttccagagggtcgataaagacaggagtggagtgatatcagacaccgagcttcagcaagctctctccaacggacaaaggaatcattaggacaaattgttaatactgcttcatggtggagatgcttctggtttattttgtggctaccgctgttactgcttggagtgcctcaccgagccaggatgaagctccacccgcccttcaggatgcaaagccctcctctataaagtgcatgcggggccagatgcagtggctcacatctgacctcccaacactttgggaggccgaggcagggggatcgcttgagcccaggagtttgagaccagcctggacaacattgatgaagccccacccgcccttcaggatgccagccttggcaacatcgtgagaccctgtttctacaaaaactaaacaagtgtagtggtgcacgcctgtattcccagctacttgggaggctgagatgggaagatcacttgagcctgggaggttgaggctgcattgagctgagatcaagccacggcactccagcctgggagacagagcgaaaccccatctcaaaaaaacaaagaaagtggatgcgtgctgctcctgccattggatcatcgcagcatttttcttttctctgatatgcgcctttttcctcatcgtgggggctcatgttttcgtaattccctctcgctactagattgtgagctgtgtgaaggaaggttcatagttgagttgtatgtacaggcacacaaaatttgtccttggatagacacatatcaatccacttccttctcctctctgaatttctttatttaaaaaaaaaagtagagatggagtctcactgtcttgcccaggctggtgtcaaactcctaggctcaagtgatcctcccacctctactaatatgaattattaggctatgctaatatgaatttgtatactaatatgattgaaattagtttgacttctataataattgttctcccagattgggcttctgttttgatagtagaactaaattattaggctatttcaagaaattaatatattactggtagaaaaactgaagctacaaaatggcctggtttctcacttcagttaaatttgtgcttctgagtgcttgtattctaggtgaaaccgcactgagaaggtatttgtggcctatacgctgattcattgattagacttctttgcacaggagagctgctaaaaattactgcggtgaacaggtacgaagaaaaagactgttctctgcccttctttttgcaataaaatgttacaaactatcttgagtttgatcccttttcgggtgtttgggttttttttaacattcacatatttcttggaattataagaaattaactttgtgcttctgaagtgggtttgccttaatataacactgatgtatttgtaaggggcatttttaaagctgtactttaaaaaataataattcttacattcatttgaaggttttttgtttgtttgtttgtttgtttgtttttgagctgaaggcttgtccagcctgggggacagtgagactccatctcaaaaaaaaaaa

SEQ ID NO: 215817 - DNA, 1570 bp, Homo sapiens
acgcccggccctgcccccagcagaggcggaagcggtgtcgctctgaggggtcgccagtcgccgcaggcgcttcagcccagcggcgggccttggcccttggctgcctactcctaccgccccagccccgggcggccctgggcctgctgcgggcgcggcgctgcccgaccagagcttcctgtggaacgtcttccagagggtcgataaagacaggagtggagtgatatcagacaccgagcttcagcaagctctctccaacggacaaaggaatcattaggacaaattgttaatactgcttcatggtggagatgcttctggtttattttgtggctaccgctgttactgcttggagtgcctcaccgagccaggatgaagccccacccgcccttcaggatgccagccttggcaacatcgtgagaccctgtttctacaaaaactaaacaagtgtagtggtgcacgcctgtattcccagctacttgggaggctgagatgggaagatcacttgagcctgggaggttgaggctgcattgagctgagatcaagccacggcactccagcctgggagacagagcgaaaccccatctcaaaaaaacaaagaaagtggatgcgtgctgctcctgccattggatcatcgcagcatttttcttttctctgatatgcgcctttttcctcatcgtgggggctcatgttttcgtaattccctctcgctactagattgtgagctgtgtgaaggaaggttcatagttgagttgtatgtacaggcacacaaaatttgtccttggatagacacatatcaatccacttccttctcctctctgaatttctttatttaaaaaaaaaagtagagatggagtctcactgtcttgcccaggctggtgtcaaactcctaggctcaagtgatcctcccacctctactaatatgaattattaggctatgctaatatgaatttgtatactaatatgattgaaattagtttgacttctataataattgttctcccagattgggcttctgttttgatagtagaactaaattattaggctatttcaagaaattaatatattactggtagaaaaactgaagctacaaaatggcctggtttctcacttcagttaaatttgtgcttctgagtgcttgtattctaggtgaaaccgcactgagaaggtatttgtggcctatacgctgattcattgattagacttctttgcacaggagagctgctaaaaattactgcggtgaacaggtacgaagaaaaagactgttctctgcccttctttttgcaataaaatgttacaaactatcttgagtttgatcccttttcgggtgtttgggttttttttaacattcacatatttcttggaattataagaaattaactttgtgcttctgaagtgggtttgccttaatataacactgatgtatttgtaaggggcatttttaaagctgtactttaaaaaataataattcttacattcatttgaaggttttttgtttgtttgtttgtttgtttgtttttgagctgaaggcttgtccagcctgggggacagtgagactccatctcaaaaaaaaaaa

SEQ ID NO: 215818 - DNA, 1209 bp, Homo sapiens
  misc_feature (1206)..(1206): n is a, c, g, or t
gctcaggctggagggcaagtggtgccatctccactcactgcagcctcgacctcccaggctccactgatcttcccacctcagcctcctgagtagctgggactacagcactgaggccctacgggattcaaagaagaaaaaaactagaccagagccgggcatggtggcgggcacctgtagtcccagctactcgggaggctgaggcaggagaatcgcttgaacctgggaggtgaaggttgcagtgagtcgaggtcgcgccactgcactccagcctggtgacagaacgagactccgtctcaaaaaaaaagaaaaagaaaaaggaaaaaaaaacaagaccttaggtgaaagcgactcacaatctggttggggaaagtggagaaaacagacatgtcttaagcatctgaagtgcaggtagaatcagagttaaatggattaagggcggtgcaagatgtgctttgttaaacagatgcttgaaggcagcactctccttaagagtcatcaccactccctaatctcaagtacccagggacacaaaaactgcggaaggccacaggcacctctgcctaggaaagccaggtcctgaggcacgtgaatggccaggatcagattgtgcccggcctgtacgcctgtggggaggccgcctgtgcctcggtacatggtgccaatcggctcggggcaaactcgctcttggacttggttgtctttggtcaggcatgtgccctgagcatcgaagagtcatgcaggcctggagataaagtccctccaattaaaccaaacgctggggaagaatctgtcatgaatcttgacaaattgagatttgctgatggaagcataagaacatgagaactgcgactcagcatgcagaagtgccgctgggttagggtctccacaaccgagctggtctcagcaagtggcgcccacacatgggggctcgaatccaggtcgaagggtcaccggagcgacagaaaacttggaactaagctggaggacaccgagtactcttatgcagtccccatgaggttatgcttatgtttctccaggactgaaccatcaagacacctgaaaccttatcatgagcgaatgctgaggaagagattccgggaggatcccgaggacccccccagttgcagcatgtcaagactgatgctgaggaggacccaattgtcacgaggcaaaacccgtcaaaaaaggcatccactgaggtcagantca

SEQ ID NO: 215819 - DNA, 450 bp, Homo sapiens
ccaggagcagctgcctctaggacacgtgttcccctgggccagaagaactatgtgaggaacccatggtgcatgccatgacaaccctcctttagggcctcttgaggccacagtggtgctaaacccaggaagtgggtgccccttcaggggaccattggcagccctgctgcccctcactgggctgtgcctgcagtcacgggaggcaaggacctgcttttgagtctttggcttcactttgttcttacagccagacttggggctctctccctggggctggggataggtagttctcagcctgggcagccccaggagctgctaagtgtcatatccctggggaaggcctgagcagtttgaggctgattttggttgtcccaatactgctgggaaccactggggaatgagagtgtcttggggacctattcctggagcctgagtctaagctgagctgtggct

SEQ ID NO: 215820 - DNA, 654 bp, Homo sapiens
gaggatgcactgcttgtgttgttatttatttaacgacacgaatgagtaagaagagagaagaaattccacagacgtaaggccaaactcagtgcaagctgcaaagtgcattcctggccagctcagctcacagagtcagcctggcagccctgcggccacattccagggccggctgcttctctaaatggaagcaatggatcccacactctagcagtaagtcagcaagcaagactccgagctgtgctattttttttattaaaaaaaaaaaaaagacagaaacaccaggcatgctaaaagctggccttttccatgacaatatggagaaataaaacatcagatttcttaaaaagcctggttttaaggatctcttgggcctctcagatcatctccatctgtccttgcctctttcttaggggagattttaccactcaaagaggaaaagtgccttttatgtaaaaatcccccaacttttaaatcccaaatattttgagtactaccaataactgacatgtataaagcactgaagcacttactatatgctagatactcttctaagtgtgtggttttttggtgtggttggtgttgtcttttgagatgagactcgctttgtcacccaggctggagtgcagtagtgcgatctcagctcactgcaacctt

SEQ ID NO: 215821 - DNA, 712 bp, Homo sapiens
gaggatgcactgcttgtgttgttatttatttaacgacacgaatgagtaagaagagagaagaaattccacagacgtaaggccaaactcagtgcaagctgcaaagtgcattcctggccagctcagctcacagagtcagcctggcagccctgcggccacattccagggccggctgcttctctaaatggaagcaatggatcccacactctagcagtaagtcagcaagcaagactccgagctgtgctattttttttattaaaaaaaaaaaaaagaaaaaaaaaggaccaatgcaaagaaagaaatgtagaaaacagtgaagagaagaaaacaccagaaacaccaggcatgctaaaagctggccttttccatgacaatatggagaaataaaacatcagatttcttaaaaagcctggttttaaggatctcttgggcctctcagatcatctccatctgtccttgcctctttcttaggggagattttaccactcaaagaggaaaagtgccttttatgtaaaaatcccccaacttttaaatcccaaatattttgagtactaccaataactgacatgtataaagcactgaagcacttactatatgctagatactcttctaagtgtgtggttttttggtgtggttggtgttgtcttttgagatgagactcgctttgtcacccaggctggagtgcagtagtgcgatctcagctcactgcaacctt

SEQ ID NO: 215822 - DNA, 453 bp, Homo sapiens
agcagacaaaactgcatgtcagagacatggctctggttgtcatgagaagactggattgcaaagaggtcaatgagagacgagaatctaaactaaggagatggcagtaaaactggagagatggcaccatacgaaagaccagtgatgaatctgcagacggggagagacgagtacaggatggcttctggtttccggctttctcaagcctgtgtgggaaacagaaggaggagaagattctgatgacctgctgctgctcaggccgacttcgaggattctgtggaccgcccagggaagaggccgggtctgtgggtagaaattggaacctggggttcaggctggggctgaggtaggaggcttaggagataatggaagttgaatctgggagggcagacgaaatccctgggaagtgccaggatttaagaggctggtggatgcagaagagcctgccaatgaggg

SEQ ID NO: 215823 - DNA, 326 bp, Homo sapiens
agagctcccaagcagcaacttatccctgatttttccctcatctttaaaacaatgaaaacacacttttcctaagcagttcatctcatgacctcttgccaggtttacagttgtgcccactggcatctctgttcctcgcctccaatccccactcttttcttctttttttttttttttgagacagagtctcactctgtcacccaggctgcagtgcagtggcacaatctcaatctcgcctcactgcaacctccacctcccagattcaagcgattctcctgcctcagcctcctgagtggctgggattacaggcatgcaccaccttgcccggg

SEQ ID NO: 215824 - DNA, 1006 bp, Homo sapiens
ggggccgagttcaccagggcccacgggaggcgagcgagccctcccaccagcactggccctccaggccccagtctgtgcctccatcaggagcccccctgggccctccaggacacagccgtgcacagcttgtaggagcctcccaggcccaacaagccaggccacccctgcccctggctccctgccccctccctgagctccgagggccaggccagtgaccctgggcggggtagcattgggctgggggtccacccttggtcccccagcagtcctactctgggggtcctggtcccaggagagcctcaaagtagcccttccccttgggagcctgagaccccatgagggaggcccccttctccttgggagcttgagaccccgtgagggaggcccccttccccttgggagcttgagaccccgtgagggaggcctcctcagcagcacaggaagggacggtcttcttgggggcagctggaagctcagcgtggccgggggaggggagttgctcagagaaggcatcagtgcagaaggggaaggagggcctggggcagcgaagctgggagtgtggggaggagctcagggtaagagaggcaccccacaaagtcacccgggctgtgggtcccaagagggcagggcatctctccaccaggctctggccttgaatgccctctccactgtggcgaaagggccctgcatagctgcccagggaccactcaggttctgggggaatcacagtccttgggcagtcccttcgcagtctgggttcctttgtgctccacaccacctgccccctggcttttcccccttctttcctcctaacttgtcgtccatcccatctgccgcaggctgggtggtgcatcatccgggcccagctggacggggctccagagggcgagggctgagtctgtccagaagctctgtcctcagcacccaaaacagggaaatggacccacggggacctaatccattcctttgaatgacagagctgggaggtttgggttagactagcgag

SEQ ID NO: 215825 - DNA, 461 bp, Homo sapiens
gttcagtccgtgccagatccagtgggtttctctactccacaataacccatcggagcatgagccacaaccctccacctccatatgaaagaatcacaaaagctggaagagaagtgtgtaaggaccgcctgaggaagatgctaaaagagggtgagttggcagacatgccacatcgtgggtgaaggatgtcagctgccccacaaagtaaactgtacattcattgcaatcctagttaaattctgatgagattaaatgacacaggataagctgcttctggagctgatctaacagaagaaaagccaacattaaaaaaaaggctgggtgaggtggctcacgcctgtaatcccagctactctggagggtgaggtgggagtatggcttgaggccaggagcccgaggttacagtgagccatgattgcaccactgcactctggcctgggtgacagagtgaggccctgtctcca

SEQ ID NO: 215826 - DNA, 553 bp, Homo sapiens
gttcagtccgtgccagatccagtgggtttctctactccacaataacccatcggagcatgagccacaaccctccacctccatatgaaagaatcacaaaagctggaagagaagtgtgtaaggaccgcctgaggaagatgctaaaagagggtgagttggcagacatgccacatcgtgggtgaaggatgtcagctgccccacaaagtaaactgtacattcattgcaatcctagttaaattctgatgagattaaatgacacaggataagctgcttctggagctgatctaacagaagaaaagccaacattaaaaaaaaggctgggtgaggtggctcacgcctgtaatcccaacactttgggaggctgaagcaggcggatcatttgtgttgaggaatgtcatttgtggtcagcctggccagcatggtgaaacccatctctactaaaaatacaaaaattaggtgggtgtggtggtgggtgcctgtaatcccagctacttgggggccagctggagagcttccttagacgggctgtgtggacagcaggcagcttgggggccag

SEQ ID NO: 215827 - DNA, 243 bp, Homo sapiens
gttcagtccgtgccagatccagtgggtttctctactccacaataacccatcggagcatgagccacaaccctccacctccatatgaaagaatcacaaaagctggaagagaagtgtgtaaggaccgcctgaggaagatgctaaaagagggtgagttggcagacatgccacatcgtgggtgaaggatgtcagctgccccacaaagtaaactgtactccagcttgggtgacactgagaccctgtctc

SEQ ID NO: 215828 - DNA, 750 bp, Homo sapiens
gttcagtccgtgccagatccagtgggtttctctactccacaataacccatcggagcatgagccacaaccctccacctccatatgaaagaatcacaaaagctggaagagaagtgtgtaaggaccgcctgaggaagatgctaaaagagggtgagttggcagacatgccacatcgtgggtgaaggatgtcagctgccccacaaagtaaactgtacattcattgcaatcctagttaaattctgatgagattaaatgacacaggataagctgcttctggagctgatctaacagaagaaaagccaacattaaaaaaaaggctgggtgaggtggctcacgcctgtaatcccaacactttgggaggctgaagcaggcggatcatttgtgttgaggaatgtcatttgtggtcagcctggccagcatggtgaaacccatctctactaaaaatacaaaaattaggtgggtgtggtggtgggtgcctgtaatcccagctacttgggaagctgagacaggagaattgcttaggcctgggaggtggaggttggtggtgagctgagattgctccactgcattccagcctgggtgacagaatggtactctctctttcacacacacacagacacacacaaaataaagaaaaagggctggcgtggaggctcctgccataatcccagcactttgggaaaccgaggtgggcagattgcttgagttcagttcgagacgagcctgggcaacatggcaaaaccccatctctac

SEQ ID NO: 215829 - DNA, 423 bp, Homo sapiens
caaaaattgcactccagccagggcaaaaagagcgaaactccgtctcaaaaaaaaaaaaaaaaagaatttagtagtagtgaggtacatgctctggagttaggctactgcggtcgctatcctattatggccattagctagggcaaagtattcattcccttgcatctccaattcttcatctgtatactagggattataatactagaatctccttcaggtgcctgctgtaagtattacataaaacagtaagtataaagctctaggagtagcagctgataccgaaactacacaataaacattagctactgttattactcttctagttttttttttcttctgacttattttccaccattattttccgaccagattcatccgataatcagtggattagcaaatacttgttaagcacctgtgagggttaca

SEQ ID NO: 215830 - DNA, 371 bp, Homo sapiens
acaataacaatagctaaggcttattatggctttatgccaggtactttatgcacttgatctcatttaatactcatatagcctatgagggaagtataatttccattttacctatgagaaaacaggcttagaatggaacctttgttctcatagcttgtgagtggtagaaccgggatttagatccagctctgcctgagtccagcttctgtttgtcaattacttccctcttcagacctaattcttccaataagcaacagaaaaagacccagtggggccatggcctctggcacacagcttctcataaacgagcctatcacacatccccagaactaaagcaatcgtatgttccttctgatgttgaggtaaaaagcagg

SEQ ID NO: 215831 - DNA, 416 bp, Homo sapiens
gtaagtggtcagattccagggctgttttgaaaacatcctcagcaacatcaaggacagatttcaaggccttctggttcagtccactccagcctcagatctaattcaggggaaggagtcgtaatctgctctttcacagtttaccgccattgtgctgagaggtgcacagtctgtcggctggtggggcagataaagacgccctgtgccccgttgcagtgcacttggccaatgagggcatcttcatgtgtgtgtgtgatcttggcgggctctggccagccttcctggcccatgagtgactgaggacccacacagaggggagcagatcccaatcaggttccacctccagccacctccggggtagggcaccacctgaagtggctgacactctcccgggcagtccccagttcccgcctgtccgg

SEQ ID NO: 215832 - DNA, 219 bp, Homo sapiens
gaaaacttaaagtcagattggtggctcgccagtaatgagagtttagagtagaggtaaactttatgacatagtcttagactcttcactttctcctcagccaacatgattcacatttactttattttgctgtactgtgagtgtctttgtgttccctgaattctttctggaataaggcaggttgttagtaagcacaggtttctggtccatctcatagcctca

SEQ ID NO: 215833 - DNA, 585 bp, Homo sapiens
tttgtggctggagagctttagggtataaatgtctcaaatctcattaattggactgtgtggggattctttagaataagattcaaaagcaaataatgcatttataggaggtcaagggctgactgcactaacaaatatacattaagtgtatagtacatagaaatgttacaggtcagggtgagtaaagctttgaggtgaaaatgtattagtcccttttcatgctgctgataaagacatacccgagactgggcaacttacaaaataaagaggtttaattagactcacagttccacgtggctggggaggcctcacaaatcacggcagaaggcaaggaggagcaagtcatgtcttatgtggatggcagcagccaaaaagagagcttgttataaggaaactcctgtttttaaactatcagatctcgtgagactcattaactatcacaaggacagtgcaggaaagactcgcccccataattcagtcacctcccactgggttcctcccatgacatgtggcaactgtgggagttataattcaagatgagatttgggtggggacacagccaaaccatatcagtaaataactgatttg

SEQ ID NO: 215834 - DNA, 439 bp, Homo sapiens
ggagtgcctggcattcgaggtgaccaggggcctagtggcctggctgggaaaccaggggtcccaggtgagaggggacttcctggggcccatggaccccctggaccaactgggcccaagggtgagccgggtttcacgggtcgccctggaggaccaggggtggcaggagccctggggcagaaaggtgacttggggctccctgggcagcctggcctgaggggtccctcaggaatcccaggactccagggtccagctggccctattgggccccaaggcctgccgggcctgaagggggaaccaggcctgccagggccccctggagaggggagagcaggggaacctggcacggctgggcccacggggcccccaggggtccctggctcccctggaatcacgggccctccggggcctcccgggcccccgggaccccctggtgcccctg

SEQ ID NO: 215835 - DNA, 374 bp, Homo sapiens
tgcactacagcctgggtgacagagtgagactcagtttcggaaaaaaaaaaaaatctttaccttctgaaatcagtttatcagtttataaaaagttgaagaggcatttgcattttcaaatttacagacaccaatgccaaactatattgtgcccacttgtcaatgcttctcttttaacataacactgaaaatatgtggcagaagaattagtcaaaaaataaaaaacccattgaaattgaagacaagtaaaatgtttgtttgtagatcataaaatcttacatataaaaatacataaacagtacattaaaacctatctaataaatacactcagtaaattaccaaatataaactcaacttataagttatcattctataaa

SEQ ID NO: 215836 - DNA, 608 bp, Homo sapiens
aattagctgggcgcggtggcgggtgcctgtagtcccagctactcaggaggctgaggcaggagaatggcgtgaacccggaaggcggagcttgcagtgagccaagatcacgccactgcactccagcctgggagacagagcgagactcagtctcaaaaaaaaaaaaaaatagaaagaaatttaacaccatttcaaatattaattggccatatgaatatgctactttgtgaaatgtcaattcacgccatttgtccactttttgactggtttttctgccttttttaaaaaacaggttagtagttctttctttatttttcttatgagtcttttgttagaatacatattcttctcccactctctggcttctcttttcattctcttagtggtattttttgataaggatcagtttctattttaatatagtccaatttatcaacattttcctttatagttaaggctcctttgtttctggtttaagaaatattttctggccaggcacactggctcatgcctgtaatctcagcactttgggaggctgaggagggaggatcacatgagcctaggagttcgagaccagcctgggcaacatagcgagaccctatctctattaa

SEQ ID NO: 215837 - DNA, 386 bp, Homo sapiens
gggattcccatgttggggacatggtagttccattttaacattaaggaagcaaagatagggagacctttgccaaagtgaacaaaaatacataaaggtacaccatgaaagcgtggaggaaagtttctctttctttactattcctagaaaaatattatgttgggatcagaaccttagagttggaaagacccttagaaataaaatcttctggtgaataaataaagaagttgagacccaaagaagtgggttggttggttttgagacggagtcttgctctattgcccaggctggagtgcagtggtgcaatctcggttcactgcaacctctgtttcccaggttcaaatgattctcgttcctcagcttccctagtagctgtagatggaactaca

SEQ ID NO: 215838 - DNA, 511 bp, Homo sapiens
tggctcctccttatcttttaaataagttcaagtcactgccatcaaaaaaacctctggtactctcgcttcagcagcacatacattaaaattggactgagacacagaaggttagcatggcccctgcgcaaggatgacatgcaaactcgttaagttttaaaatctaatttagttttaaaatctaattttaaaaaaaaccaaaccactggatccttttctcctctagctaccatccttgtttctccccttcacagccacatgtatgaaaaagttgtcttgggaggccaaggtgggtggatcacttgaggtcaggagtttgagaccagcctggccaacatggtaaaaccccacctctactaaaactacaaaaattggctgggcatggtggtgcacgcctgtagtcccagctactcaggaagctgaggcaggagaatcgcttgaacccaggaggtggaggttgcagtaatctcgccactgcactcacgcctgggcaacagagcgagactctgtctca

SEQ ID NO: 215839 - DNA, 191 bp, Homo sapiens
tctcaccagaaactagatgaacagacttccacaaggttggaagaaatgcaaatgatctaccttcttaaggcaaaaaagacaaaataggaagtgctgttcacccatcagattgggggaaaaagagtttaaaaccaagaagttactagaggctgtggggaaaataggaatttgtgctcactgttggtaggaag

SEQ ID NO: 215840 - DNA, 618 bp, Homo sapiens
  misc_feature (409)..(409): n is a, c, g, or t
  misc_feature (530)..(530): n is a, c, g, or t
  misc_feature (538)..(538): n is a, c, g, or t
  misc_feature (611)..(611): n is a, c, g, or t
ggacattcatccagtctcctgaaatgatttattcccatgtctgtctccttcagtgcacggtgagctactcaaaagcaggaaccttgtctttttcatccttttctgaaacctagtgtcctctggataaatgtttgctgaactgaactacactgctaacctcaaagtctcaacatggatgctcttagatacgaatatttctaattaatcaaaatgaattaatgtaatcattatagattccaccagagggaacgacttctgcgtcctaatcatgtgtttagaagctgctcattaacatcagttaaaaatgttttctcagccaggcgcagtggcttatgcctgtaatcccagcattttgggaggaaggggcgggtggatcacaaggccaggagttcgagaccagcctggccancatgggtgaaaccccatttctactaaaaataccaaagttagctggggtgaggtggcagatgcgctttcacctggctgataatggaaataaatgggaatgcagagagagagagagagagagnaagaaagngagagaaagaaaagaaagaggaagagaaagagaagaaaaagaaggaaagaagaaagaaagaagaagaagaagnaagaaga

SEQ ID NO: 215841 - DNA, 278 bp, Homo sapiens
tcccagagactattacaaaccaccttctattacaaattacattctactactattacaaattacattctttttttgaggccacaacttcttcgctttgggcataaggcctcctgtctcgtggtgagtaggcacaaatggatctctgtgccctgaccatcccactaaactcggccacatcctcaagctctttcctccactggtgtcttcaagctggggctctcctctccaccttccttccctacctcttctccaggatgctgatgtagccatggtgcgaa

SEQ ID NO: 215842 - DNA, 411 bp, Homo sapiens
caggaagatgtaagccagaatactgatgacaacagctgtctgtctacctacctgtcttctgagatcatcattaaagtatgagatcaccaagaccagggaatacagagtaagataagatggaggcccactggagaattatgaggcctgtcgcattctgactccacttcccagcgggtggaaggtgaatacccaggcactggtttttatctccacctcctaagatgtgagtcattctgagtagtgacagaatcctgcaatggaaaagcccaaagaaaaccaagatctttgggaaaaattataaacaatctcatttattagaggcctctgatggtttctttgaaatgggtaaatttcctcatcttaaagtggagggcaagaattttctacctaaggtttctctcaaactctaaa

SEQ ID NO: 215843 - DNA, 319 bp, Homo sapiens
accctggtctgtggaaaaattatcttccacaaaaccagttcctagtgccaaaaggttgaggaccactgttagagagagtaaattctcagtaaataattgttcagtaaataagcgaacccacagagtagttaatacaaaacaaagatgaagatgaggcaatccaacaactagccatgctgtcaaactgtacttggcggtttgcttttgtttatctctttagtgattatccccaaacatttgccacagggttcctaaggacatccttcatcacattgctgagataattctctccatttcaacatatctcaaccttttttgg

SEQ ID NO: 215844 - DNA, 426 bp, Homo sapiens
aataaggacatagagaagaatcacatgaattttcttgtgagtgctgaagatggcaaggctgagcctttctcctttggtggaaacctttcttgtagtatttgttttcatgggtacttgcgggcatgagaagcctattcctttgtctaggaatatgctgtattgattcttgttttatgtagctgtctctttaagtttttgttttctttactagttaaaagattttgtttgttaagtttgtgtattggcatattttaatcaacatcttacaattccatgtgacaagcatgataggcttgatgataggccagaatgggaattattcattcaacaaacacgtactgagcatcaacatggtacctgttgcaagaaagcatcctctctagtaggtgaaattatgagtgtatggattgtcaagggaaataaaag

SEQ ID NO: 215845 - DNA, 179 bp, Homo sapiens
ggccaggagcatccagatatatccagaagatgggggagtgctgagggagatccacagactgtgtgtgtgatgaaagggacattggagtatagtaggacatacagttgaaagggaagaaatcaaaatgtggctatgctgtacaaaactggcagatatgtattctatatgccactgggaac

SEQ ID NO: 215846 - DNA, 398 bp, Homo sapiens
gtatgtattttagacagggtctcactttgttgcccaggctggagtgcagtggcacaaacatggctcactgcagccttgaccttccagactcaagcgatcctcccgcctcagcccctcaagtagatgggactacaggtacacaccaccacgcctggctaatttttgtatttttcgtagagatggggtttttccatgttgccccagctggttttgaactcctgagctcaagggatccacctgccttagcctcccaaactgttgggattacaggtcaccatgctggccagctacataatgtttcataagatgtatatactgcacctattcaaccattcccctattagtgggcacatagattgttaccaggttttttttgctaataaaatttcttatgtcta

SEQ ID NO: 215847 - DNA, 661 bp, Homo sapiens
cacggtggctcacgcctgtaatcccagcactttgagaggccgaggtgggtggatcacctgaggtcaggagctcaagaccagcctggaagacatggagaaatcccacctctactaaaaacataaaaattagctgggggtggtggcgggtgcctaaaatctcagctactcggtaggccaaagcaggagaatcgcttgaacctgggaggtggaggttgcagtgagccaagatttcgccactgcactccagtctgggcaacaaagcgagactgcatcactcacataatataagcaagagtttcataaaattatacttatgttttagaaatacaggcaatgctgaccgggtggagtggctcacacgtaatcccagcactttgggaggctgaggcagacagatcacctaaggtgaggagttcaagaccagcctcacttacatagtgaaaatacaaaaagtagccgagcctggtggcggacacctgtaatcccagctacttgggaggctgaggcagcacgaatcgcttcggacctcgaaaaggcggccggttgcaatcgaaccttgggaattaacccacttggcattcacagcctcggcaacctagaggggctctggcctccctggttggcaagggaacaccggcaattccctttcttgttcccttcg

SEQ ID NO: 215848 - DNA, 407 bp, Homo sapiens
atgagatcagcctccatgaaagtagcagtgagcaagaaatttaccagggccaaggcacctccgagggagttcgcttaaggaagtgtaggttgggggagaactaaaataatgggcaaaggggagttgattataagggagaggatgggggagattgagagaaggaatgaaaaatgagtcatggtcttccatatccacaacatggtagactagatattgggaaagccctcccattgtaaaacacttaaaatgctggtttaaaatatattttaataatttaaaataaatacgtggctatgctgtcaagaaagtaaggaaaatcgttccaggccaaagacgaatcaaaggtgtctttcagtggtcacttagctctctggattcaagcttttcttcatctcttaaatcccaga

SEQ ID NO: 215849 - DNA, 544 bp, Homo sapiens
agggaatctcccctttttaaaaccatcagatatcatgagacttattcactgtcacgagaacagttcgggaaagacttgcccccatgagtcatttacctcccactgggtcccttccacaacatatgggaattcaagttgagatttggatggggacacacccaaaccatatcagaggagtctttttcattcctttaagccatcagtttcttttcttttcgacaaataataattgtaagtatttatggggtacaatgtggtattttcatatacatgtacattatggaatgattaaatcaaactaatgagcatatcggtcatctcacatgctttttttgtagtgggaacatttaaaatcttattctcttaacaatattgaaatatccactacattattattaactacagtcactctgctatgcaatacatctcaaaaacttactctttttgtctaattagctgaaactttgtagccttggaccaacatcttggcatcctcccactcccatcccccacctctggtaactaccattctattctctatttc

SEQ ID NO: 215850 - DNA, 676 bp, Homo sapiens
cagggtgtgatggctcacgcctgtaatcccagcactttgggaggccgaggcaggtggatcatgtgaggtccacgagtttgagaccagcctgaccaacatggcaaaaccccatccctactaaaaatacaaaagttagccaggtgtgtggcgcacgcctgtatctcaagtactcgggggactgaggcaggagaatcgcttgaagctgggaggcagaggttgcagtgggccaagatgccccgcagcactacagcctgggcaacagagcgactagtctcaataccattgtaaagacattaaagactcattttctgtctgattcttaaatatttaaacaaagccccatatagcgccttaaatataggagtgttcagaaaatgttggtttagtttaaatgaccaagttatttttgaccctattagtctattagcataatgttgtctttttcacttaatgattaagctacttttaggtatgttaggtatcatgagctggtcctcagtgtcctagagagcattataagatgtgaattcagaggagggtgaggaaatgttaaacgttagcaaaatgtggctaaaaccagtctgcagacttgaagaattcaagaaaaggtgattgcctaatagatttaaaaatgaatattcacaaaaaagaaaccccattaaaaaccgggcaaggg

SEQ ID NO: 215851 - DNA, 711 bp, Homo sapiens
tctgagaacaaggagtgttccacgcccaattctgaggacacatagatacagtcaggcagaaaaggtcttgatgtttctgaggctccattcacttctatgtgacacagaagtggagacaagagccagtggacctgtaggggaggcaccctggagacaggggagatgactctggagtggaggctagtgatagacagcccagcccacgggtctgatgggagatatgccagagatgcagaaaggtctccatggtcattaagaggggatggggggctcggtcagcaagaagagccactgatccctggtcaagccaaattttaaatttgccaaataagagcgttaaagcacaaaacacgcctatcaataactatcatttcacaaaataaggagtttcaaaaaagtgagactggtattacctcagaatcaagaaacatgcttttaataaatcaaatcagttccaactaatttagctttttgaacaacctgccatggtgcacttcttttgtgtcatttagccatgcaccagttgaaacttggcagcatggaccagcgcaggtccctgggcccacgctcggaagccactgttgtgtgctgtgttgtgaatcctaaaattgacggagctttaaaacatcttaagtagagaagtgacattgtcgaatgtgtaagttagacagctctttctggcctccatattcaggagggcttgcatttagg

SEQ ID NO: 215852 - DNA, 407 bp, Homo sapiens
cagcaaaaccatggtgggtgtgagctgcaggccagcccctccactgggccattatccaggggtaaacaccactcgtgggttagttccacgagttactggctgatttgacctgtgatactccaaggtggaagtaaccaaataatatgtatcatgagccccaagaacgaagccagtggagagtggtacatgctagagggtaacgcctggccctttgcaggacagcacgtcagccatgcgccatgggacgatggtggtggctgggacacaggaggccacggcaggaaatgggcaggtgggtgggtctatgtaagctggctttagacttcaatccacaagcatttgcagctcaactactcagcgtcttatcttatttaatcctttcagcaataaacactcttttcacatgt

SEQ ID NO: 215853 - DNA, 639 bp, Homo sapiens
ggaggaatggaagactatggacttaagagtgtagcatcattggtcgaaagacttttatttatatttagggagactagagcatgtctttaggtagagcaaaaggaagcaggagagaggggaacactgaaatacaggaaaaagaggggatagttgagtaaacagaaagaaccctaagtgaaagcaggaggagattggagcagtataccaggaccgggatgagccctggaaaagagaaggagcacctatttctcagagctaggatgagactgaggtggacagggaactaacgccttccagaacagaaatatgtggtccgatgagtattgaatgcaacttaaaatctagttggaatgtgatggataagaagagacccaaagtcatcaacaagccttctcatgaactttcagtcattaaccttcctatatagtaaggacagaaatgatgatttaagccatcttaggcaaggcagtgctaacaatatgcttttgtaaagtcaccatccggtgtaaggaataggcaccagcttagtgatgtttgcaaataagccagtggtgggtgtggataaattagagagagtaccaaatgcagtttgaaaagtgttaagttttgtctctagtaaattgcatgtagttttaccaa

SEQ ID NO: 215854 - DNA, 337 bp, Homo sapiens
gaaaagaataatgcagccctcaataaaagtaggatgcaggttttccaaaatattaaaaatgaactgtggctcatgcctgtaatttcaacattttaggaggctaaagtgggagaattacttaggctcagaagtttgagttcagcctgagcaacatactgagaccccatctcttcaaaaaatacaaaaattagtcaggtatgctggcatgtgactgtagtcccagctacttgggtgactgaggtggacggatcatttgagcctgggatgtcaaggctgcagtgagccattactgcaccactacactctagcctgggtgacaatgtgaaacccaatctca

SEQ ID NO: 215855 - DNA, 767 bp, Homo sapiens
ccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatcaccaagtctcctatcaggagttcactgaccactagtaagaccacaccagagtctccgtgcagcggactcaggctccagctgtggctacacatagggttttatacaagaaaaataaagtg

SEQ ID NO: 215856 - DNA, 345 bp, Homo sapiens
acgaagggcattgatcttaaacctccaaccagtatcttcaaccaagacacattgctgagtgtgggaaggcagaggagagggcaggagtcaccccaagggaggccaacttgtggggtgagaaaagtccatttggaaaaaaaaattaataacacagatctccttctggagcccttcaaataataataatgtaataattgggattgtaagttgaataccagtatttctactttatggacattaaagtttgagaagcaccaaacttcgtatattacacatccttagaatctttcatcttttaaatccccaaacaagactcacctgaacattgttctttacgttactttc

SEQ ID NO: 215857 - DNA, 379 bp, Homo sapiens
ccccaaaaagggaacctggacaccctccaccggtgacacagccatgtggaactgtctaaccataaaatcatcaatactgagaaattaaaaggggaacatgtcaggcctcactctttctgtattggctttcaagagtattgtccttggtgaggaagacaaagtgagtgggctcagtaactcgcccgagtcacagagtcaaagcaggagctggacccagatagtccagagctcatgctcgtacacacttcacttcgctatcctgaataaaaaaaccaagactccaggagggctgcagcttcgtccaaggtgtcgtgacttgcccacagccaccctcttggcaaatgacccagtaaactccacctccagctcctctacctcc

SEQ ID NO: 215858 - DNA, 558 bp, Homo sapiens
ttgcatgtaattagaccagaacaaggcaggtaataaaaatgagccattgcaaccctggcttatataactcaaacagagtatgatggggacaatggcaatctggtgtgtgcaagccctggctttcagagatgaccctactgggcccagccactctggccaagcagaaaaaagctaggtcttgttcagcatgcttagttttcaagagaatccaggtacatagatttgtgtatgatttgtaaacattggcaatacattcaaaaatatttttaaaaccactctgtgggccaaactaaatacatctgtgggcagagggtgacctctgagttacatcatttggctatttcagttgcacaaacactactctacgtttaaatgaagctgggtcaggcctgaggtcagtgtggtttggtggaaggattatgatatttacaagctgacagacttgagttttagatcctggctctgccacttgctagctacgtgaccatgtgcacatcacttaaggagtgtcataaaaccaacctcacatgcttgttgcaaaataaataaggaaatgtc

SEQ ID NO: 215859 - DNA, 697 bp, Homo sapiens
  misc_feature (459)..(459): n is a, c, g, or t
agcctcaaatatattttagatacttatcttttgtcagttttgtatgtagtcagtatattctgccagtttgtggcttgtcatttccctctctttatgtgtctttggttctaaggttctttttttggtgcccaggccgaaggcgcagccccacacctgcactcccagctacccacgcacctgcgcccgcatcattacctgccccctgccagtccccagccccgccccgcgccgccatgcccctgccctccagccctgccgaccgcgtctcccgagaccccatctcaccccctcacaaccgtccgcgctcccacccgctcacacctcgccttcacagctcctcccccaaccgccacacccatcccccgccaccctacacctacctcgctcccactactcccccctcctccaggctcacccccttcccccactcccccactgccccctctctccccctccgcnctcccccccacgcacctcctcagcgcccccctccactccgcccctcccaccatgtcctctccccttcccctccccctcgcctcgccccaccccctcggcccccccacactcccctccccccccccgctccccctctccctactctccccgccacccccccctcccacccgccctcccctcccccccgcccctccgccccgcccctctcgcccctctctcccgctccgcctcctccccg

SEQ ID NO: 215860 - DNA, 671 bp, Homo sapiens
agcctcaaatatattttagatacttatcttttgtcagttttgtatgtagtcagtatattctgccagtttgtggcttgtcatttccctctctttatgtgtctttggttctaaggttctttttttggtgccaggccgaagatccaggcacacacctgtactcccaggcattcactacgctgaggcaccacaattactcgaacccgtcagccaccgactgcagccagccgcaatcatgccactgcactccagcctggccgacaccgcttctctgacactccatctcaaccacaccaacccttcgcgcgaccagccgcttacaccgctaccacagtacatctcgcacgctcgcacgctctccctcgtccagatactaccgcacctgccctccacattatcccgctccctcacgctactgatcttcaccccacgccccctcgcctaccttctcaccacatcgcccttaccgaccccgccgttcttcgcgctccctcttaccacgccccttcacccctcctcttcgttcccatccccacccatcttcctacttcaccccgcgtctccctccctgccccaccgccctccctcctccctcctctcaccccccgcccccctcgcctctcgtccctcgcctcctctgcgccccctctccgccctccctccctcctcccccc

SEQ ID NO: 215861 - DNA, 421 bp, Homo sapiens
gatctcttcctcttcacaagttatatttgatctatcatcaataccatgcccttgtcaaaatgcaagtatgtgctcacttcagcatcacatatactaaaattgaaatgatgcagagaagattagcatggcccctatgcaaggatgacacacaaattcgtgaagcattccatacttttattaaaaaaaaaaaaaagcaagtattccattgttaggagaccctgattcctttcttttgttcatgttctctgtctctctgcctctgtctctctctctctcttcttccctccccccaaccctctctttcccttcttcactatctcccctccctttccccttctcttgccctgcttcaagtgaaaaattagcatctgtgccagggaagaattgctagtgaatatcaagattgttgtaattaatcgat

SEQ ID NO: 215862 - DNA, 425 bp, Homo sapiens
cggtggctcacacctgtaatcccagcactttgggaggccgaggcgggcagatcatgaggtcaggagatcgagaccatcctggctaacacggtgaaatgccatctctactaaaaaatagaaaaagttagccgggcatggtggtgggcgcctgtagtcccagctactcgggaggctgaggcaggagaatggtgtgaacccgggaggcggagcttgcagtaagccgacattgcgccactgcactccagcctgggtgacagagcgacgtctcaaaaaaaaaaaaaaaaaaaacaaaaaactattcccagaaattcaagaatgaatctttagtataattcacaacactaacaaagagaaaaataaaacgtgatcatctcattcctgataaaaacttgattttaaaataccccaactaggaatgaatgtct

SEQ ID NO: 215863 - DNA, 348 bp, Homo sapiens
cgggggtgttgcatcatctcacagatgggcaaacgatggggaatggcctaaggtcacatagcaaggtggctcaccaggtgcggtggctcatgcctgtaatcccaggactttgggaggccaaggcaggcagatcacctgaggccaggagttcaagaccagcctcgccaacatggtgaaacctcatctctactaaaaataaaaaattagccaggcatggtggtgcgtgcctgtaatcccagctactcgggaggctgatgcaggagaatcgcttgaacctgggaggctgaggttgcagtgagccgagatcatgccactgtactccagcctgggtgacagagactctgtctc

SEQ ID NO: 215864 - DNA, 475 bp, Homo sapiens
tttcgtgaaacactctcattttgcacataaaggagctgtggcccacagaggaatatgatttactgagagtgacccagttagtggccataaaccaaaagccccaagatgctaaatgtttgttatgaagagtaaaaatcctcccagtttataaggagtaacttcatccttccattttctatttccactatgactcccctggcttaaattttaatctctattttggatgactccaaaatctcattcttctaaattaattatctaataccacaatgttgcacttatcttcctacaaatctactttcatctgccttgacaaagccaaccctaattttctctagtcctcattagaaattattgcaacaaaaattcacatccagtctgaagtttgggagccagaaaagaattttcccattaagatgagacagtaccaattattaagcagaggaagacacaagagggaaagcagctttcacat

SEQ ID NO: 215865 - DNA, 671 bp, Homo sapiens
tttcttgctacagagaggtgggaaggtgatacaaacaggtggtccgctggtaatccccatcgagtgactggatgatctgcaaaagaggaaaacaacccggccagagagtcaggggacggccaccagatggccctgtggaccgccgcccgacccccgagcaagccgtgtgccccgagggcccgacccaagatcacacagctctctgccactcactctggaggagaccagaaacctcgaggtgctgtcttcactcggctcctctctcacacagccctgatggagaaggtgggtccctggcacgtgggccccaggagggagaagactccgctgtacaggaggttctggaaggaagccgtgcgcctggctcttacgtcccagctcttccctacatcttctttcacgctgcagcggaaaccagaatgcctactaattccttaagaaccaaaggttcaagtggtgctacctatgtatttgcttcttacgtcccctgaacgtcgctacgattccacacgacagccctcgagaattctttcaagttttccaaatgtcctctaccgtagaaacatctcaattaaaacaagagtttccaaactgtcaccttactgcaatattttttcaaaaaactgtgtaatgaaacttttttttttttttgagacagtctcgctctgttg

SEQ ID NO: 215866 - DNA, 375 bp, Homo sapiens
ttagtcattgatgcctcttaatataaatacaaagagaagttccacaatggtcatcctcttatccccccaaaagcagaaattattgattcagaaacttgactaacaaaatgccccaaagagaaactgttgtacaagtcaaatgagtaaataatctcagcacttttcagttctttcctttactggaggcctgggggtctcaactagaccagcatttccccaacacaattgttgttaagtataacttggggaataaaggggaaccattagtttgcacagattgaaagggaggctcaatgaaacccaatgcactgttctgtacccaggaagaggccacactgggggctcatgttttattatttcttccaatttattaga

SEQ ID NO: 215867 - DNA, 610 bp, Homo sapiens
tccttccaggtcggaggagcggccggtgaagaagcgcaaggtgcagagctgccacctgcagaagaagcagctgcggctgctggaggccatggtggaggagcagcgccggctgagccgcgccgtggaggagacctgccgcgaggtgcgccgcgtgctggaccagcagcacatcctgcaggtgcagagcctgcagctgcaggagcgcatgatgagtctgctggagaggatcatcaccaagtccagcgtctaggccagcaggcggcggcggcggcggggccgggcggctggtggtactgctcaggccacccagggcaggccactcaggccaggcgggcaagggggccgccccgcgagcggagaccgccttccacctggcctctggcaggatgtcccttctgaggggtattttgaggaacccccaggccctggggaccgtgaggctccagtctccagcatgaatgcccttcctcggacacaggccagggcctctggggttcactccgagtaagaacgtcctagagccactctccagtgtcgttactatcaatgatacttgacgtggctttgatattaaacgtatactttttcattcttgcctggaaaaaacagt

SEQ ID NO: 215868 - DNA, 490 bp, Homo sapiens
tgtccattacagaagtaacgtatttattgtagaaatgtaatagataaaaatgaaataattattcatattctcactattccacaaatgtctgtgattaacagattcattgtcaactttagttctcattctgcacatatgtaagttatgtttgtatctaatgtgaaattgtaatacagtcatccctcaatatgtttagggaattggttccaggacccccatgggtaccaaaatctgtgaatgctcagctctctgatatgtagaatggtgtagtatttgcatgtaacctatgcacatcctcctgtatactttaaataatctctagatttcttataatacttaatacaatgtaaatagttgttttattgggccaggcacggtggctcacacctgtaatcccagcactttgggaaatcaaggcaggaggattgcttaaacccaggagttagagaccagactggacaatatagcgagacctcatttctaaccccca

SEQ ID NO: 215869 - DNA, 429 bp, Homo sapiens
  misc_feature (6)..(6): n is a, c, g, or t
ccccanccaatgaatgagcacgttccatgtttgttatgtttatgtccttgagaagattagataaacatggttttattctgtataatagactattcttgtttgattcttttaggtcattgaaataagttagatttcttataggttttaatagtttgccaaaatgatggccgggtgtggtgactcatgcctgtggtcccaaagcgctgggattacaggcataagctgctcccggccactaagttaatgttttttaaataaatgagtgtaagcacttttatgtaatcataaattttcatcatcattgtaatgaatgcataatgtatcataagtgttttctgttttttactgctgtaacactatggatctttttatttccattcagtaaataagtgattgtcattgttctaggcactgaggatatgataatga

SEQ ID NO: 215870 - DNA, 185 bp, Homo sapiens
ccatataaatttgagccgaccttaagacgggcattgggcggcagagaaccaggcaggttgaagaggacgttctagactcactcggaaccaagctctggctccagagcccccggaccctctgggcagtctgtgtcccagcctggggtctcagccaagaggaccttcctgtgccatccccccgaccc

SEQ ID NO: 215871 - DNA, 430 bp, Homo sapiens
cagtgtttggaggaaagctccttctttagctcctcttgggctataccgaacgttaaggaagtagactcctaacagagaggtagagaccgtagctctgctttcatctgtagattaagcacctctttcctttaaaaaaaacaaaaagttggctggacatggtggctcccacctgtaatcctggcatttcaggaggccgaggcgggtggatcacctgagctcaggagtttgagaccagcctggccaacatggcgaaaacccatctctactaaatctataaaaattagctgggggtggtggcgtgtgcctgtaatcccagccacttggggggctgaggcaagaggatcacttaaacctgggaggcagaggttgcggtgagccgagatggcaccactgtgctccagcctgggcaaccaagcaagactctgtctca

SEQ ID NO: 215872 - DNA, 658 bp, Homo sapiens
ccctaaatatctttcaaatctatatacatatctctgttctccccgctacagccctattttaagtcactagcatctatgttctggattatttagcacccttctaaatggtcttttgcttccagtcttgcctgccctagttttgttcagagcaaaggatgttgtaaaagctgacttgaaccactaacaggtgtgtccctggtatggagatgaatatgtagccgccatggatgaatgtgtggtatggagatgaatatgtatcacatgacagggactggtttagcattttatgcattatctcatttaaccctcaccataagccagtgaagtattattcaccctttaaaaaccggagtttagagaaggtgagtgacttgcccactgccactctgctgggacgtgaataattctatgtgtgtccaggcctctctggttccaaagctgatgctctgcccctgcttcatgctgcctgtgctgttcagtgttctaatcctatttctaagtccctgccttctgggcttactgtacactcctggtaacagctttgcgcgtcgcttagctacggggagatgatggtggatgcaaacatctgattttcctgacagtcacattccctttagtatattaataaactgacattggccgggcagtgtcacgcctg

SEQ ID NO: 215873 - DNA, 719 bp, Homo sapiens
gatcagcgctgagcccgggagtgcgggtcacgcccgcagctggcgcgcaggaggagtttgggagagaatgaattggactgtgaaactttcatgaacttctcaaaagaacaggaacatgaggagacgaaatggtgatgaaaacccacaattcaatctaccacagtatggtaagcattcccagctttaaaccatgaagaaaaataaattgacaattagtgaatccatatgactcctgcttccaggaaaggccagagccactgatcattggttcactaatggccaatagtgtttcaaggtgaaaggaaggatgggtccaggagcctattggaggaaaatagggtggagacttggagatggtgttaagagaacatttgggtgagtgaacataaatcaaagaaaaaataaattaagaaaaatgcttatagaaagtgaaaggtagacattaaatactaaatcagataaaaacctgcagattttatatttaaccatcttctcaattataataatgatttggaaaatttaatgttttcttttatataatttggcagggtgataactatcctcagtgggataacagactagttttaactcttacatctccatgtttcagagtttatttgaggcaaagtatgatttttaagaacagctactgcttattttgctcaggttgcttattgcccagcccagtctgaggggaccattcatagcttatccatgtg

SEQ ID NO: 215874 - DNA, 602 bp, Homo sapiens
ctttggtgctatttaaatgaagagctcttcctatataagacaccaccatccatttgtaattactaagacatggactgttttcccaaaagcagtagaggtactctaaatgcacagactcctggtctctattataatcaaggacattcattctgagaatgtcagatgggtataggggctctgaagtgacagtgaaatggactttttctctgggacaagctaactgacctgctgggcagtctcagtactagcaccaagagaaagctaacattcttctctgtgaataacagtcctttactggtctattgttccactgcaaccagccaactcagtggctttgtgtctcttgccacaaagagtaacgtgttgtttgtgtttattactctgcttacttcagacctttcagagaagctctacgtttgataagtgttaggaaagtgcagatcctcttccacacccttccttggtgcacgtaaaacatctgtggtgcttggttcgtgcatataatgcagagagaaatgctgcaggaagatgtaaaagaacttgtgctaccaggtaggcatgtgagagttttttttgtttttttgacagggtctcgctctgtc

SEQ ID NO: 215875 - DNA, 375 bp, Homo sapiens
gtcacgtcggctgccatgtggtgatgaggctattaggtggctagtgtcaaagaagggagaagcagcgttatatcggaatgggctcctaccaactcagcagaagccatgtgtgcatctcttcctgaaccatgccctcatgtcacttgaaattagccacggcgaaggtaagtccatgtggaaatctgcaaatactatagaggatttcttctccctcccttgtcccttccccttctcgtctttcctgcatttcttcctttcttcttcttcttcttcctcctcctccagttccttcttttctctttttttttacaacattatatatacttatttattgtttataagcaaagttgttgataaacacttaccagcacatct

SEQ ID NO: 215876 - DNA, 641 bp, Homo sapiens
tcaaattcaggattcaaaggcaaaggtaaaaggagagccttgaatttaaaaatcaaatcaaaacaaaacaaaacctcactcaccaacttgtatggttcctccagtcttttctcgtcttggattttcatcattctgatacatttactgctctgtttggttaaatcccaaattaccacttcaatttatcagctggtcacggtctcatagaacagatcctaatcccaatgtcagcaccactctacaagggctgctcctgcgttaagtttgtatggagttgccctggatacagctccctacctaactctgtggccctcacagggggcgcttccagcccgcaggcaatgcaaattagcacaggaaatgttacattaatttctaggcacttcaaataatagttagaacgaatccctaactaaattggtagggagcagttaggttactgtctttccactcctgggtaaggtacctccctgctgattgacaggtcgtccgcttctgagcaggggaacaggctgagagtttaaacttcgctccccccaacacagcttttacttcagcaagtaaaagcgtcaccatagcggcttgagtatatttgctcttaacctgctctattttatatagacacgtataaatgcatatat

SEQ ID NO: 215877 - DNA, 740 bp, Homo sapiens
ccggcccaactctgtatcctctcaaccactatagtattggcagtggtttctctgctagaaatgcactgctggcctaaagaccagccagaagtacactactgggctaaatctattgtgtgcaagggtaacctccacctggactgcttggacgcagctctcttcccactggcggccaccgcaacacaggtaacctaaataaagctgttgattctgataaccccaagcacaaaacattggaagcctttagaacatgagaggtctgagcacatagactggtttctgtttccgccatgcaaatatttaattgcatggatgtagggggaaatggactttacctgttaccaagaacagttccaaagacttcctaaaaattttcattctaaaaccagattacctactccagctctcttttggttagaaaacaaaagcaaataaaaaataaaaacagattacctagaagactgcaaccatgaataaccagcaataaatacttaacaagatcctatctaggttcagatcataattttagactgtaacttcttcatcaagctgcattcgttattcactaggttagtttagcctttaatgggtagacttgctccaagaaaaagggcatataaataaattaaacaaccgatttttgtaagatgcataaagaaccaaatttcacttctcaaagtcagtctcacctctcacctaggatagaggagcttgaaactcccaacttctatggagataaa

SEQ ID NO: 215878 - DNA, 148 bp, Homo sapiens
gtgtccccgtaaggagcccggccttacaaaacaagtcttatgcgacaggtctcagagaaaatgcagaaagtagaatgaacacattacagggcatagactggattcaagaacatagcctggtggtcagtgtttcattcctaacttgcca

SEQ ID NO: 215879 - DNA, 438 bp, Homo sapiens
ccatgtagtggagaacttccaatctcccagcacaccacctgggggacggtgcatcctcctggaaagtgaaccacacacacagctccactggaaacaggagacttccgccaaacatgagacaaggggcctggaatatttcagttgtgtcctattaggtgctccgctaacattctgctttctcttctgagccgtcaatacgctgccccagcacgggtggaagatgccccctacacatttcaagccgactaatcacaggggaagaaacacggcttgttttaaccgctttctacgggcttcttatgccttcagtctgcgcgttcctgcagagtcacctctgaagggggaaccagattatccaaagcttctggctctcataccaggtgggcttatgtaaactgtctcagggtcctcattcgtaaataaaggacttaaactacg

SEQ ID NO: 215880 - DNA, 495 bp, Homo sapiens
tctcacttttttgagaataggtttgataaaaaggcagtaatggtaaaacagactatatctgaaatctggagagtattaagagccatatattatgttaagtacccaacattaatattatctaatttaaccatcaccacaagcctacaaaattctgatactcttcctcactatttagatgggaaaaaatgtagatgtaaattttttaaaagcaggttaaaaacagtactcagtccctaatcctacagttattaacatacagatgtaacacagaattgagaaatagtagacaatggtctctacatagtgaaaaagcaggtgatttttatttctttgtgcacctgtgtagtttttaaattttttcctccaaaattttaaaatttcattaacattaaaatagtttagccagatcaaatgattgtaaacacactcagggaactcctatttaaatggtattctattataaagcaaagagaataatcaatgctcttctattat

SEQ ID NO: 215881 - DNA, 416 bp, Homo sapiens
tcaactattgctaaactctgagaagccttgaaacaatatgaaatatttttattagcatcccagcttcagacacaaaaggaagcatctgcttgtaaattacatccctatagaaatcattaaaaaggggtgggcgtggtggcttacgcctgtaatcctagcactttgggaggccgacgcaggcggatcacctgaggtcaggagttcaagaccagtctggccaacatagtaaaaccctgtctctactaaaataccaaaatcagccaggcatgatggcggtgcccgtaatcccagctactcggaaggctgagacgggagaatagcttgaacccgggagatggtgattacagtgagccgagattgtgccactgcactccagcttgggcagctgagctagactccatctcaaaaaaaataaa

SEQ ID NO: 215882 - DNA, 235 bp, Homo sapiens
ggggagggacagggaggagctgcagatgatcaaagggtttcagattggtcagtaagtagaccgggaatgtgcccttcaggagctggttaatacacagctggaaactagcctagagctcctgcaagatgcttgggctttaaataataaatctggaaaccagagacatgcgaaatgaagatcacatggatgacactgttcacagcaagcgttaggaactgtgggcactgcatcgtta

SEQ ID NO: 215883 - DNA, 360 bp, Homo sapiens
gctctaaaagccccggcctgctggtattctggggggtcagtggcccatggaccctcttagccaccagctctgagctggcccagggccaagaacacagccaccacctttggccaccccaggagtgccaagagtaaaactgtcactgtggttccagggagtctttgggccacagagggtgttattactggaacagaaatgtagacagaggggtatggattgccataaaagtgtctaccatataaacaacagtaaagtcacacacacacacacacacacacacacacacacacacacacacacacacaatgtggggggtgggggagagagaaaaatcaaaacatctaaaaataaacaatgttc

SEQ ID NO: 215884 - DNA, 381 bp, Homo sapiens
cataagactgccatcagccacccaggagaggggccgcaagcagtgggaaccctggtgccatcgggagctggcagccagcttattaacgaaccgtttgtggctgaactctcagcagggagtggccattcagcaatcctccagcaggccacagatcatcacaaggccctggcgcatctgggagctctgatccagcacagatatctcaacactcaatatgtaaactcaagattcaggacttcatggacatgacctatcagatcctaacaagaagcccaagatctggaaaaggaagacattggacattcactgggctcttatgatatgccagacacaaggtccattcatgtggattctctcattaaatcctcccagcaagtctgt

SEQ ID NO: 215885 - DNA, 419 bp, Homo sapiens
cagatgagatcaaaggattgttctctggggaaactgaaaggccccagaaaaaaaggcctccaaaagccgacatttggaagtcttctaacaaaagaacagcctttcagcccagtaatttgatagtgaagcccaccacctggcaagccccacctgcacacagagtttccaagcagcttggtagtgtcatgggaactaatctaggaacaccagccaagaacccttaagattaggtatattttattttaatgtaaactaaacctcagtacactgggccaggcatggtggcctatgcctgtaatcccagcattttgagggggctgaggtgggaggatcacttaagcccaggagtctgagaccagcctgggcaacatagcaagaccttgtctctaaactaaaaaaaaaaagagagagagagaaag

SEQ ID NO: 215886 - DNA, 539 bp, Homo sapiens
ctatttcctagttataatatcttgccattttaatccattatcctctaacgctatagtctgtgactttccttacttgagtctaggtgggtgccacttgaaattcttttccctttacagttgcttttcaacttatgatggggttacatccttataaacctattgtaagtcaaaaacacaagttgaaaatccatttaataccccaacaaacccacttgtaaagttgaaaaattgaaccattgtaagtcctggaccatctgtattaaacatacgcacaaaaaggaaaagagcaacagtgggagaatcagccccgaagggggagtatcaatgactggagtgaggaaaatcaaattttaaagtatgctttccactgttcatttatatggaaatatagtggaaacaacataaatatggtggtttctgttcccttattgattattaaggaatgtctaagatatatatggtttattcctgaacagagatccattatttttaaacatgtcttttttaaaatttaaaaataaatgttcgatttgaatcta

SEQ ID NO: 215887 - DNA, 493 bp, Homo sapiens
ttcatcagtgtctggacattgaagagttaggtatttattatagtctccaccgtctgggcttgtttgtgcctgtcgttcttgagaagtctttctaggtattcaaagggacttgggccccaagcccaataatgctgtgttttttgtggactcatgcctaaggtatctccttggtggtcatggataagagccagaattctcttgattaccacgcagagacttttgttcttttttcttactttcttccagacaaacggagtctctctctctctgtgtgctgagtcacctggaactgggggtatggtgatgcaagcacccttctagccaccactactgttactgcagtgggtcagacctgaagccagcacagcaatgggccttgcccaaggacctttccttcagggtggcgagttcctccaggtccccggcatatccagagatgctgtctgggagccaaggattggagtcaaaaactttagaaatttacagccaggtg

SEQ ID NO: 215888 - DNA, 499 bp, Homo sapiens
attgttagtgaaaactaagtttggtctagaaagagattttgatatttcagtatcagactagcctaatactacgtatttgtcattacttcataaaatgcttttttcggtgccttctgttgataaaaggggaaaagttggggaaaaaatatttaacattaaagttaagattgtagtgtttattttgcttatggttatttaaattggataaactcatctgaaatgttgctttgtagttcacattgagtgtgaatagaaagttctctcctgaaaaatgcaggtaaagacaacaccaaaaagtatatagactaagtagatttctgtactgaaaatattactacctgccaccccactttaaaaattcagaactttcatagctgacgtggtgttgggcacctgtaatcccagctactcaggaggctgaggcaggagaattgcttgaacctgggagatggaggttgcagtgagctgagatcgtaccactgcattccagcctgggcaa

SEQ ID NO: 215889 - DNA, 1025 bp, Homo sapiens
cttttgattttgaaataactctagactcacatagaagatacaaacattgtagaatgttcctgtgtatccttcacccagcttctccccatatcttacgtaataactatacaattatcaaagcacaaacttgacactgggtacaatactattactattaataaactacagcccacgttcagatttcactagtttttacatgttctttgttgtttgtttgggtttttttacatacaattctataaaactttatctcatatatagatttatataacaatttccacaatcgggatataaatctgttccatcaaagcacattatgtattgaaaagacccttttgggattataaacatcatctgctggaagcactttggtaaatgatgaggactttcttttgaccttttcccttaccacattaaaaagccaattgtctatgctccagctggtatgtacaaaccacaattgccagagaagttcacttttcagaatgggtgtttgtcctgttcactctttgtttattatatgccagacccagtagaggcagagtggataaaatagcaaacaagagaacagtacttcctgcctttaaaagaatttagagtgtgagaaatattcattcactcattcatacacacacacaccacacacacacacacacacacacagtgacagacactatccatgaatgaaaagtaaaaagtgagatgaaaggttaaaacacaatctggttaagacagtgaggaaggtccttgtaagcaagccccatcctcagactcagtattcaaggccttctgtgggaccaggtcatccaagtgccagagccattgagtatgaaacacagaaaccaacaagttcttaaagcagaatacaaagatgctcagggcttaagaaattcactgaagacttcttaacttctccttaagtcagagtccagcccaaaagatatacagagttggcaattatccatgtgatgttaccttaggacacccataggcctatttctgccttaaaaggttctttgcaacca

SEQ ID NO: 215890 - DNA, 295 bp, Homo sapiens
tcgcgaaccccgtgaaagcacaccctcacacacccctcacacttctgacacacaccctcacactccttgcacagacccctcacgcacacccctcacacacccccacctcacacacactccttgaacacacccttcacacacacactctcacacacaccatcacacccctcacatacatcctcacacacatgcatcgctctcccacactcctcatgcaccctcacacaccttcacatactcctcacacacatacccctcatacaattctcacattcgaatacacacaccctcacac

SEQ ID NO: 215891 - DNA, 919 bp, Homo sapiens
  misc_feature (54)..(54): n is a, c, g, or t
cttatggttgttttattatttttatttatttttgagactgagttttgctctgtnatcaggctggagtgcagtggctcactgcaacctcctgacaccatgaagttttaaaaatgcagttacactcaacatacccctattgagcctctgctctgggcagggctgcatgctaggttctgggcagctagggttggggaccatgatgaagatgagagacatagtgctgtcctccaaagtcctgaaagggagaagtatgccacctctacacctttctggtcataaggcagagagtggggagtattgtttaagtaagaccttctgctctcattgccataattctggatcaggcaagcagggaaaaggagagcctgtatacagaaatctaccttctcagttgagggagggggtctcctgaacaaaggaggccaccagcctccgggagagagcgaaggattcgtaaaaaacactctgagaatccagctcctcaaggtgcccaccctgggcctcctctgcacctgggcactctcctacatgatctgcagcacacactctcacatgtacaccatgccacacacctaactgcattcgcacacatatcctttgccctccaggtgccaggctcacatctgctgtgaaggaaatttgtctggagtcccagtgggaccctgagggtggacattaacttacccagagggctgattcattcttgttggtgggtcagggacgaagtgggtccagtagggaccctgcctcgcccaccccacctttcagccagccccttccccattcagcagctggaccctccccactgacacatacttgtttctgccctttgttttcctccctggccaaatccccaaggcttctttggtcattaacctcctgccttaattagcttagtgaggaggaaagcagaggcagc

SEQ ID NO: 215892 - DNA, 611 bp, Homo sapiens
agcgtcttctgctgacctcgtgcagcaccgcaggaagctgggatgctttcgagcttactttttctttatttgagcttctggtcatgtttcaaagccatcaaaatctaagcaagggagttacagggagggttagagaattaccaaaggacacaaaatgtcttgggttgtggaatagcacacatcagagaaatctcaaacatctcttaggaaaatctctaaatgtgtatatccccaagtatcttagccttccacctaccacataaagtgagggtatgtgtccctcaaatgagaaaaatgaaaacacactttcttaccacttcaaatctgggaggtggttggctcatttgttttgaagatactcgacactttgccctagcaaaatattgacttctttgatttttccttcagaaaaataagccctgttattcctatagacctaaataagggaggcagccagtttcaagaggctggctctaacaaaatataccaaggctgtcatctgtctcacttaatgaatgggaaactcctgattgagaagaatttgtcttcattaaaactagctaaaatgtacattgcaaatctgaagaaaacaatcatgactctgctaattt

SEQ ID NO: 215893 - DNA, 385 bp, Homo sapiens
ctggtaccagctgttcacctctaaaaaagaggctcaaaatcattacaccatgttttttggaactcttctctccaagttgactcaaatagcctaaattaattaatgccacaagacaattctcaccacattactagggttcttttgaagtttgtgtccaacatcctcatatacatggcaactaaaaaaaaggggcctctcaactgctggtaggcaaaacctgagtcctcttgttgcttgcagctgagaaaagcaaaataaagcacacttgagaacatctgcaaattttttatttttttatttttttttgagatggagtctcgctctgtcgcccaggctggagtgcagtgtcgcaatctcggctcactgcaagctccgcctcccgagt

SEQ ID NO: 215894 - DNA, 459 bp, Homo sapiens
cccgggcagcggccaggagtccagcggcaggactgattcgctagggggtacagacttcttaggaccgcagaagggaccttctttctttctctgtctctctctctccttcctctctccctgtctcccctctctgtcttccaccccgccttggcgcatctcttcccagcccctagcccatgtctcccccactgtagttttttttggtgggaacgtggtggctggaagatgggcccggaagtgcacactctcatccccttccctacgatcttccaactcaggccaggccggggacgcatgccccagcccaccccagacttgtcctaccatccggttatcccggctgtgctcggggaagaaaaggcgaggccctttgccgctctgccttctgcccctcgggcctgcgctgaccggtgggactcaggaggatgcacacagggaaggaggaaaataaaggcgccc

SEQ ID NO: 215895 - DNA, 475 bp, Homo sapiens
aggctcagtcagggggacaatgggactgatctgtaaatgatctaacttgtcattgcagaaaatatacttactccgtggccacaaaatttcagcccttcagccaagcttcatccatcacatcataaagaataacttgccaaagaggggtttgaaaatccaaaccagatccctctccactcctagagaggccagttccatgacactgcaccggagccaagtgtttccagcaagccctgatcagttgcatgttagtccttgtttgtatgataaacgggacctagtagattaacatcatctcctcagcccaagggctgaccccagtggtgctgctcaagaggaaggaggaggctgggagcggtggctcccgcttgtcatcccagcactttgaggggctgaggagggcaaatctcttgagcccagcattcaagagcagcctggaaaatgtagagattctgtctctaccaaaaaaaaaaaa

SEQ ID NO: 215896 - DNA, 599 bp, Homo sapiens
aaagtgggaaatgatagaagggtcacttaggagcctgcagtggcatggtgaccagtctgttattactcatagatgaccttttctggctcttgaaaccaagctaacgactcctttttcttctgggcctcaaagtttctttgtaggaagtaaagcatttgtcactttccctgcagtgatttattgaaagactgaagataggtcttccttagttaaggacgcacactggctgctcgctccagaagcaccaagaatggctgatggataaatcccttacccatactcctgtttctgcctcctaaggttgctgtgaaaacctaactaaccaaacctcaccagcttggcctatattattaatcaaattcccttctgttctctctgtgtatatttaatactgtagataatatgttttatttaaaatttctaatacaccaaattaatttgaaatagaaaaggctggggacttcattctcatttttgtcatttgtttaatcagtttgggaaaacattttccgttgttccattgtatgcagtgtcttgtcagcatgtacctatctaggagaaaacgctttgttttcagcgttctgtctttaccctcaaag

SEQ ID NO: 215897 - DNA, 623 bp, Homo sapiens
gcaggggaaactgccactttttaactatcagatcttgcgagaactcactcactatcacgagaacagcatggggtaaaccacccttatgatccaatcacctccctccctcgacacatgggattacaatttgagatgagatttgggtggggacacaaagccaaaccatattaaaatagtactgaattttgaataactgtaattgtgaattgatgttaaaatctgattgaaagagtacatcttagcacaacaatacggtatattgcctagtaatagaataatgcttcaagaaggagctctggagaggggacggggtgcttatttaaaaaaaaaaaaaatttggcaaggcaaggcacggtggctcacgcctgtaatcccagccctttgggaggccgaggcgggtggatcacaaggtcaggagttcaagaccagctggccaaggtggtgaaactccgactctactaaaaatacaaaaattagctgggcgcggtggcgggcgcctctaatcccagctacttgggatgctgaggcaggagaattgcttgaacccaggaggcaaaggttgtggtgagctgagatcgcgccattgaactctagcctgggtgacagagcaaggctccatctca

SEQ ID NO: 215898 - DNA, 700 bp, Homo sapiens
ctccacaacgttgtgtaagtttcctgcgtacattgtgttagaatcctctctcttgaaccaatatcctgtatcatgacttccttttagaagggagaaagtgtgttctccctaaagtgaaaattttgactatcaaattagctgaggaaaatagaaggagtttatatctgattcgttttacacagcttgacagaaatcactgtacccatttaaataaattcaaagcagagaatatgctaagtgtgcagtaacgactacaagctcatttgagagcttatgagagtagaacataccaaaatgggctccttaagcaattctaactactacaagggtggaaacgggccttgggaagataatgaggtaaatgtttcagccctacaactgcttcccttttactcctttctgccaccgttcttgttatgaaatgctgtttcttatgtagcaccgtccattgaattatcccttaaaagatgatgtaaaagtatttcttttttttacatggagaaaaatgtatagcagagccagagatcacttccaaccccccctcatctcccatctttcactccacgtaggttcttcagctggatctggaaaccaaattgacaccaggcaggttaaacaagagaaaagtatacaaattttattaattctatgtgtacaggatcttcataacagagtgaagtccaaagaagtggccaaagca

SEQ ID NO: 215899 - DNA, 194 bp, Homo sapiens
gggggctgcgctctgacttgactgctaagaatgaagagaacaaacagagcagggtatcttcacatcctttcattctctatacctcactgaccaatgtcattatttactgtcagagtaccaaaggtcactgaacatctcattttgtaattctttgaaaaatgactaaaaatgactaggataatccttttgaccct

SEQ ID NO: 215900 - DNA, 567 bp, Homo sapiens
actctgtagagctgggtacacaatttccctggactcactcccatctaagcagcctctatcagagggaccagagcagctgtaagatacctgttcaggacagatgtgcataggcctgaagcaggatactgcatcccaagcaaccacagactgccaagaaagtttcctgtcatggcacaacttaagctgaaaaaatagcatcacagcctgagctggaaggggtccgagagctgctatcatccaatcatccaatcccttcattttctagttgaggaatcaaatctacacatctctagcgacctgcccaagataatgcagctaattagggtcagagttaagatttgagacagaatacagaaattttttttaaagccttctgtactgacatttgttttcattaaatttgataccacttctatcctttgtcaacttttatctctgagaaataattaatgttgcaataagctggaatcaaagaaattggtgagagaaattgtgctgacatgtttggggttgtctttgtattctctgaaaccacagaaaacatttgattaaacagtttgcagccaa

SEQ ID NO: 215901 - DNA, 181 bp, Homo sapiens
tagcaaagaaaatttgttcaaatgtgaactagaaggcaagtttcataaacaaaccctggaaaggaactgaaccaagtcacaactttccaattttcattacagttttgaaaagcacagaattaaatttaaaacaaatgttttctcttgcacacacctccatccaacgtgggacagtatcgaa

SEQ ID NO: 215902 - DNA, 471 bp, Homo sapiens
gactgcagggaatggaaaacacatggatgcatttttttaatgtgagatgaatctttcctgaacagttcaaagtgcctatgcctgctcactgttaataagaaaagagttgaagggtgaaaaattaaacaaaaaaaggccttcttttccagaagagagggaagaagaaataagagagagccacacctaggtcgggcgtggtgactcacgcctgtaatcccagcagtttgggaggccaaggcgggtggatcacttgaggtcaggaattcaagactagcctggctgacatggtgaaacctcatctgtactaaaaatagaaaaattagctgggcatggtggcatacgcctgtcatcccagctactctggaggccaaggcaggagaatcacttgaacctgggaggcagaggctgcagtgagccgagattgtgccactgtattccagcctgggcgacagagtgagactcagtctcatt

SEQ ID NO: 215903 - DNA, 509 bp, Homo sapiens
agtcctctcttgacagtggttctcaatgtaagagaagtagatgtcactctaataggcgggcatttgaaaaatacagagtggtttttgttgtcacataacttggggggcattactatggaggggggtaaccaaggagctaaatccctcacaatgcaggggatagacctgcagaacaatgaatgctcccaccagaaatgccaacagtgtccctgttgaaaaatactgcataacgatatactatatcataaccatttgtttatgtgactgtctccctactgcaccgtgagctcctgtaggacaaagaccattttcccccagttatatccctagtatttagcacaaagaccagcaaatagcagatacctgatcaatatttgccaatgaatgaaggaggcaggttctaggcactactagaatgtcaactccaagagaatggaactttatctgttttgctcactgctgtatgcctggcacaggacaggcactcaataaatgattgctaaatgaat

SEQ ID NO: 215904 - DNA, 247 bp, Homo sapiens
cgtgggcaggcaggagctctgtgccactctgcatcttcagtggtatccattttgtttacactatcaaccaaactttctatgctaagaaaagcaagatgcagaatgggtctgaaagaagagattgaatgctgggctggaactcagaccaggattctagccccaagtgtgacatttgtgtgacttgaggcaaatcccttcatgccctgggtctggtttcttggctataaagtggggaagttggaagaca

SEQ ID NO: 215905 - DNA, 352 bp, Homo sapiens
cgaaagcagctttcaggatctcaagctgccacccatcaaagagctgaatgaggagtggaaggaaaactccctgtttgctaatgtactggagcctgtgttggatcgagacaggtggagctgggacaggcaccacgtggactttgatctgtacaagaaaccaccacctttcctcgagctgctcccttcgcccgcaccaaagcctgtaacagtcaggaagaagaaagggaacagccccatctcctgagcagcacagaccctcccacggccaccgcatggtgaacctgcacagcctcccccacacccgaccacaccctcctcaacaatcaacttcattaaagtgcagcaggacaga

SEQ ID NO: 215906 - DNA, 762 bp, Homo sapiens
cagggtctcaggtggggtgtccatagggacctttctcctcctgatttacttactcccccaatttaggagtggaaggaaaactccctgtttgctaatgtactggagcctgtgttggatcgagacaggtggagctgggacaggcaccacgtggactttgatctgtacaagaaaccaccacctttcctcgagctgctcccttcgcccgcaccaaagcctgtaacaggtaacaggcaagggtttgccaagctgggcctcctgatgccgtgggcaggcaggagctctgtgccactctgcatcttcagtggtatccattttgtttacactatcaaccaaactttctatgctaagaaaagcaagatgcagaatgggtctgaaagaagagattgaatgctgggctggaactcagaccaggattctagccccaagtgtgacatttgtgtgacttgaggcaaatcccttcatgccctgggtctggtttcttggctataaagtggggaagttggaagacaggtctaaaggcttcctgagcttcaacactattacccatgactgatctctaggtgtccagccaagagctgggggcagaggctctgggcttcactgggaccttccagcggcaaagatactgacagttctttctttggggtaaggcagagacaggaaacgtaggtcttgctgtaccagtccctccaagtcctcttcctctttatccctgtttatgaaaattgatctcaggatcatctggaggttaacatagaaccc

SEQ ID NO: 215907 - DNA, 2298 bp, Homo sapiens
gtgttttgctgggatggaaaatgttaattcggttccccatgcagcccgctgggcagcatcttgcaaattaagaatctcgtctatgtttccataaaacagtaaagggtgattttctcttgtaaagtggcttgaaccccacagctatagcacaagcaagcagggtcatcaaaagccactccattcttctggaaactgcagagaaagggaacccggaaatctggtatgccggcacagagggggaaaaaaaggaggagagagagaagagacagattcagttggcctcatgctatcttcattggatcttctttggaaaggtattccactaacagcccaaactatcgcatttttagtaccagaagtactattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttaggctaaaggaagaagaagcacctttgcagtctggacagaaaatgaaatttacctcggatccattcttcttaagtttgccagattagtaactaccacagaactgaaaaacatcctaagtctatcggtgactgctactctgaccatagacagggttgagtatacaggacaccctctggagattgctgtgtttttaaattattgcactgtatgtaacgtcaccaaaaagattttcttagtgatatataatgaagatacaaaacagtgggtttcccaagactttacattagatgcccctattgacagtgttaccatgccacattttacattttcagcactgccaggattactgctatggaacaagcatagtatctactattgttaccataatttcacctttactgggattttacagacacctgcaggacatggaaatctatcaatgctatcaaatgacagcattattcatgaagttttcatagattattatggagatattttggtaaaaatggaaaataatgtaatattttattccaagattaatactagagatgcagtaaagctgcatttatggacaaattacacaacaagagcattcattttcttaagtacatctggtcaaacatatttcctgtatgctttggatgatggcacaatacaaatacaggactatcccttacatctggaagcacaaagtatagctttcacaacaaaagacaaatgcccatacatggcatttcataacaatgttgctcatgttttttactttttggacaagggagaggctctgacagtttggactcagatcgtctatccagaaaacactggtctgtatgttattgtggaatcttatggcccaaaaatattacaagagagtcatgagatttcctttgaagctgcctttggatactgcaccaaaactctgacactaacattttatcagaatgtagattatgagagaatatctgattactttgagacacaagacaagcacacgggtcttgtgctggttcagtttcgacctagtgaatattcaaaagcatgtccaatagcccaaaaggtgttccaaatagctgttggctgtgatgataaaaaattcattgcaattaaaggatttagtaaaaaaggatgtcatcaccatgatttttcatacgtgattgaaaagtcatatctgaggcatcagccatcgaaaaacttgagagtaaggtatatttggggagaatatggctgccctctgaggcttgacttcacagaaaagtttcaacctgtggttcaactatttgatgataatggctatgttaaagacgttgaagcaaatttcatagtgtgggaaatacacggcagggatgactatagctttaataatactatggcacagagtggttgtttacatgaagcacagacatggaagtcaatgattgaacttaacaagcacctcccactagaagaagtctggggacctgaggtaagagaaacattaccttccagattgtttatttggaataactaatctggcattttgctattaacaaaaacttgatggaaacattttggatttaaatttgctttggtaaatcaaatcctatttttatattaaattgtatcatggtatttttaaaacgcttcatcttaatttctgcgtgatcttttgttggttctgtgttactattttaattttcactgctgtaaatatgtgttcgcagattattaaatatgtgttaaacatg

SEQ ID NO: 215908 - DNA, 940 bp, Homo sapiens
agcgggcgaggcctggacgggagtggccgaggcggttgggcggaggcggagcaggcgccatgtcagcccgggaagtggccgtgctgctgctgtggctgagctgctatggctccgccctttggaggtattccactaacagcccaaactatcgcatttttagtaccagaagtactattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttagacatttctttaacaactttacccagcttatcactgtgtgggcatatgatccagaaagtgcagatcctgatgagttgctggggaatgcagaagaaccttcaataaattccatagtactcagcacacagatggccacattgggacagaagcctgtcatacatacagttctgaagagaaaagtttattcttcaaatgagaaaatgagaagggggacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtgtagttgcatctgctgttttggtgacagatatggagacctttcacacaactgattcattcaaatcttggaccagaatcagagtgcctccagacattctgagtgatgatgaaagacggagtgtggctcatgtgatcttatcgcg

SEQ ID NO: 215909 - DNA, 1012 bp, Homo sapiens
agcgggcgaggcctggacgggagtggccgaggcggttgggcggaggcggagcaggcgccatgtcagcccgggaagtggccgtgctgctgctgtggctgagctgctatggctccgccctttggaggtagagagacgccagtcgcaggtattccactaacagcccaaactatcgcatttttagtaccagaagtactattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttagacatttctttaacaactttacccagcttatcactgtgtgggcatatgatccagaaagtgcagatcctgatgagttgctggggaatgcagaagaaccttcaataaattccctgatcacagctgtctcatgaaagatacatactctcctctggatgaattccatagtactcagcacacagatggccacattgggacagaagcctgtcatacatacagttctgaagagaaaagtttattcttcaaatgagaaaatgagaagggggacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtgtagttgcatctgctgttttggtgacagatatggagacctttcacacaactgattcattcaaatcttggaccagaatcagagtgcctccagacattctgagtgatgatgaaagacggagtgtggctcatgtgatcttatcgcg

SEQ ID NO: 215910 - DNA, 730 bp, Homo sapiens
agcgggcgaggcctggacgggagtggccgaggcggttgggcggaggcggagcaggcgccatgtcagcccgggaagtggccgtgctgctgctgtggctgagctgctatggctccgccctttggaggtattccactaacagcccaaactatcgcatttttagtaccagaagtactattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttaggacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtgtagttgcatctgctgttttggtgacagatatggagacctttcacacaactgattcattcaaatcttggaccagaatcagagtgcctccagacattctgagtgatgatgaaagacggagtgtggctcatgtgatcttatcgcg

SEQ ID NO: 215911 - DNA, 808 bp, Homo sapiens
agcgggcgaggcctggacgggagtggccgaggcggttgggcggaggcggagcaggcgccatgtcagcccgggaagtggccgtgctgctgctgtggctgagctgctatggctccgccctttggaggtattccactaacagcccaaactatcgcatttttagtaccagaagtactattaagttagagtatgaaggaacattatttactgagtggagtgtgccagaaacttgttttgtgctaaataaaagctcacccacgacagaattgcgttgttcctcacctggtgttcacgctataaaaccaattgttactggcccagatgaagaagaacgctatttatttgtggaaagttctcatacttgctttctgtggtactatagagttagcttatcactgtgtgggcatatgatccagaaagtgcagatcctgatgagttgctggggaatgcagaagaaccttcaatagacctggcgtattgtagtaccaatgacaaaagatgatgcactaaaggagattagaggaaaccaagttacttttcaggattgctttattgcagattttcttattctgttgacttttcctttgttgaccatacctgaaattcctggttatttaccaatctcctcaccacgtggtagtcaattaatggcttcctgggatgcttgtgtagttgcatctgctgttttggtgacagatatggagacctttcacacaactgattcattcaaatcttggaccagaatcagagtgcctccagacattctgagtgatgatgaaagacggagtgtggctcatgtgatcttatcgcg

SEQ ID NO: 215912 - DNA, 345 bp, Homo sapiens
agaaagacagtgtcatgcctgtctctcacatgatacaataacctgtacgaattgtttctcctagagacaagcacacgggtcttgtgctggttcagtttcgacctagtgaatattcaaaagcatgtccaatagcccaaaaggtaagcgacatgggctgaagacccaaatatttcacttcaagaatgtataggcggtcaaccaaataatgcatacaatacctccgtacaatacctccatgcaatacctccatacaatacctccatagagtaccatcctcctattacttagcaagttccatatttattctgcacttatttcttcaaaacaatcgtttattcataattt

SEQ ID NO: 215913 - DNA, 444 bp, Homo sapiens
agaggtagtcattcttcaattatttacttggatgtatgaaatttggaaaatctggttatagagacaaaacaattcaggtttttttggtcagattccaggttttaggacttagggtccaccgtgaagaagaaagacataaatttatcacggagtaaaagaattttgttggctgggtgcggtggctcacacctgtaatcccagcacttcgggaggctgggtggatcatttgaggtgggtggatcatttgaggccagcagttggagaacagcctggcctacatgtgaaaccctgtctctactaaatatatgaaaattagccaggcgtggtggcatgcacctgtaatcccagctactcgggaggctaaggcaggtaatcgcctgaacctgggaatcagagattgcagtgagccaagataactcccagaacgagttatctcactgtctc

SEQ ID NO: 215914 - DNA, 259 bp, Homo sapiens
ggattacaggcgtgagccaccatgcctggcctgctgtttatatattttaaacatcagggtttaaaaaatgaatttattataatttatatgtggcacttgcctttagtattaattgaaatgaacagttatccattcctgaactagatgattccatgctaatttgttttttaagtccttatattttgtttttctagttattttaattgccacttctgcattgaactctgctattttaagatgccgtcattgtactgcttct

SEQ ID NO: 215915 - DNA, 434 bp, Homo sapiens
aaacacaagggaagtttctggagtgatggaaatgttctatgtcttgattgactatggttacattggtgtggacatttgtcaaaattctgaatttcatatttggaatttgtatattttgtatataaattatacttcaataaatatgtacatgtatatatatgtgtatatataatacattttgatatgtcatgatgtctatcacttcacagcatattatatttctatcataccatatttacataatggaaaaagatgaaaaggatgctgtattttggggaaatcacaagagattatcacctttatttattttttatacaaatacatataaatctttcacagtacaatacaaatgtcaaaatgtggtattttcattgctctataaattcttatatgttctatgtatgtaataaatgttaaaaacagtgtttatatgt

SEQ ID NO: 215916 - DNA, 156 bp, Homo sapiens
atcatacctaccctgtcttcaacatacctactaatcactcctagtgaaaaaaaacaatgaccaagaagaaacagagataactttcagattagctcaaaaacaaaagagacccattattccttttcgctttctttccttttatcttttcttttcttt

SEQ ID NO: 215917 - DNA, 519 bp, Homo sapiens
cataatagttaatattttcattttctgatatgttgattttaacaataattattatcatgaggatgtctagaggcagagcttctgtgtgtatctgaatgccttttcacaagtgtcctgagaaagattcctctccaagtatctgggttaattaagtaactgcattaaatttattaataactttgttgcaattgtactgaatcatcatctaaaaataattatatgtttggtcatatgcccctttaacatttcaaaatatttgtttttagggtctcagcactgtaatatttatatatttaaagcaattaacatgttctaaggacaagctaactacatgtatggcagtctccgggttttgagtgattagtaattttcatccttgaataagaaaacaggctgtatggtagaggtgaatatagcccttctctgtgagatggaaaataccatacactccttatatggctaaatgaagcagtgatggcaatgcactataattacaatgtatgaaaatttgagactttg

SEQ ID NO: 215918 - DNA, 415 bp, Homo sapiens
tgggcatggtgctgtgcacctgtgtagtcccatctacttgggagtctgaggcagaaggatcgcttgagtccaggaggtcaaggctgcagtgagctatgcatgcagcctgcactgccactgccactgcaccgcagcctgggtaacagagtgagctactgtctcaaaggaaaaaaaaattaattatgcttttattgagcttttttattgtctgttttctcattggtctctaagttgtattgagtataagaactgaggtatatccccacacctagcaatagtgcctggcacacagtagacaacaaatgtgaagttgagtgaatagatgaatttataacaatattttgtaagctaggggttgtgacccaccaggatcatgaaatcaatctagtggattataatcagctttaatttaaag

SEQ ID NO: 215919 - DNA, 395 bp, Homo sapiens
ggcagcagttaaggccaaagaagaaacactggatctgcattccttaggacggtgccctgtgggcccctcacagagcttctctcctgcaactgctaggtgaaagaaggcaggcttagaatcggactgagatcagtagtttctgcagctgggaagatgagtgaggtgagattgcatgtgtgataggctggcactcagggaagacctcagggttctctcctccccactctgaggcccctctcctgcttcctgaagcccagagtctccacccctgtgagccaaacaccttcctgttatctgcctggtcctagggtagccttcgggttggggttagaaggaatgccaatggttaaccttgtggtattaagcttccagctcaggcagatacttctctctgg

SEQ ID NO: 215920 - DNA, 402 bp, Homo sapiens
tgcggtggctcatgcctgtaatcccagcactttgggaggccaaggcaggtggataacaagggtcaagagatcgagaccatcttggccaacatggtgaaaatgattggcatagcatttcaaacgatgaagcacaaatggtctacacagaaatcaggaaaaaatggttgaaaaaattaactctagatggattaaagacttaaatctaagacctaaaaccataaaaaccctagaaatataaaaattagctgggtgtggtggtgtgtgcctgtaatctcagctactcagggggactgaggcaggagaatcgcttgaacaagggaggcggaggttgcagtgagccaagatcgcgcccctgcactccagcctggcgacagagcaaaactccatctcaaaaaaaaaaaa

SEQ ID NO: 215921 - DNA, 406 bp, Homo sapiens
agagcgccagccagtgaagtcaggacttctgtgttctggcgctggtttctacctctcactctagccaggtgacccgaggctggtaagtcacttcacttctctggattcctccacttgtaaaacatgagaagtgaactggatggtcctcccagcaactgcagtttcattctttatctttaaagaaatgtattttttaaaaaaaacaatgtgagaatgatgaaaagcttctcgctactcaatgtccttgccaatgatagtttgatagggaacctaaagttaatagctcccacagctctgactctttaaggaaattaagaggccagaaggcagcgttctaatcagatttgtgggtaagatggttatcgatagtagttaatgatggatgaagtgcactgaggctcttaaa

SEQ ID NO: 215922 - DNA, 206 bp, Homo sapiens
ggaccagattcatgcaggtccttgaaggccttggttaagagtttgaattgtatcctgcaaatcttttgaagggttcctctctaaagatggaaggagagaggaaactgtagcagtattccaggtgagagggagatatgacttggattagaggaaactggaagaaatgaatggattaaagatacattttgaaggtaaaatgtgtctaa

SEQ ID NO: 215923 - DNA, 173 bp, Homo sapiens
ccaaatctcccaacacgagtacattgtaggtgcccattgagtgcttgctgaatggaggaatggttagctactgcctcctacttctcgttgcaggacatcaatatctttctaaaatcatagtaatgtgaaggctatccagaaagtcaaaaggttccacagagttggccacaaaa

SEQ ID NO: 215924 - DNA, 274 bp, Homo sapiens
agctgtgtattgtctatggtggcttttgtgctacaaggcagaattaagtagctgcagcagagacctgtggcctgcaaaactgaaaaacatttactctctggcccttagctgaaaaagtttgcttatatctggcttaaacaatcatcaccaccattttcagacttgaactgcttgaaattttcaaggaagttttttttagctttcagaagtggaccttctcactttgctgaaggtgataagggaaagctctgatttaccagtgttgagtttcagg

SEQ ID NO: 215925 - DNA, 483 bp, Homo sapiens
acacacacacacacacactctctctctctctctctctctctctctctctctctctctctaggttttcatccagttcctggctcctaattcccacagcccgttagccttgtgttatgatgtgggtgtgtcacaccgcaggagcgggcctcaggaaacagcatctctccagccttctcctgcccttcccttcacctgccccaaggcaggactctaatcttcctctgcctttcccatagtgggtcataagatcctcattccagagggagaatttgggaagggaatgctgacatcatgaagcttccattaaaaacccaagaggactggcctcagaaagcttccgcatagttgaacatggctggacatggtggctcatgcctgtaatcccagccctttgggaggccagggtgggtgatttcctgagcccaggaatttgagaccagcctgggaaacatggcgaaatcctgtctctaccaaaaataccac

SEQ ID NO: 215926 - DNA, 405 bp, Homo sapiens
taggctgtctttcttcactctctgctaaaatagtcacacataatatctagaagcattaagattaataagtaactaatttgaaaattagaacaagtcccaagtgaagtcaaagttactgtgtggttgacaggaaacatggctggatactaagagtgtgttcacatctgttttatgtagaggtaatactttcattgagactcctgatttaacactatttcttgatgaataacatgtaaatcataaaggtggaggttattacctaataattcatattactggtacaaactttcacctaggatatattcctatacctgatgtaaaatcagcccagaatggagaagttacttcacttattagagcttgtcaattaactaaaaaccaggattaaatacagatgttctacat

SEQ ID NO: 215927 - DNA, 273 bp, Homo sapiens
tgagggtgttgaaaaggcagagaagaaggaaagtgctgaagaacaaagcaaagaattggggccaggatggcccaggtgcagaggagaggagaccagccagcttggaggatgagaagggggagctggtctgactgagggatgggcagcctgagccattaccttggggcaattctactgggatctttttttttttttttttttttttgaaaaggaatccccgttttgtccccagggcggattggggactggagggggcccaccccgggcccctgg

SEQ ID NO: 215928 - DNA, 415 bp, Homo sapiens
gggcatcccttggcttgatgtaaagggaacgaaagtagtaggccacattggggttagctgatgtaactattaaacatacttgaaagcaagtatttacttttggagtttgatatcttagaaagaaacttcattagaaattaagtagtgattagtaatgagtagggattgtcactcattacatgtcattatgtatattagaatcacacatttcatatatagtgatagcatattgaatacaaaggtttttaaaatcttaactacaaagtttcttagagtaacacagctttaaaaatactaattttgctatactttgtttactaagtaactttttctcttctgtattgttattgccaaagtaatgatacaaaaatagtacaacatgttgatttaaaagttggaaagtgaaaaaaatttt

SEQ ID NO: 215929 - DNA, 635 bp, Homo sapiens
tataagtaataggcccccaccctttactttttttggtatcactatggacctgggtgttcatttattattcagtgtgttataatccattataatcatgccctttcatgttcaaacttccaaacttggccagagggaacctttttagcccatctccagtgttactgaggagtctccatcaatctttgaatacttctttggtttttgatgcaaaagaagctccagaatcaccccgtaccttccctaccccatttctccaggaaatcagcttggaatctgccatttctttaatgtaccctagctccttttggtggggagtggtatttagaaaccaagatcggggcattagatgtgctcattgccactgggatgtcactgttctatgtcctttcagtggacacagctaggagagaaatatgtacatgtatttaatgtaaatatatataattaaatatgagtgtgtatatatctatatatttttaaatcataagttaatactgttatttcttactgcaagccaacaccaccaggttcttcctccttccttgattccatatttgcagctcccttccacaacagtgagaaccctggtttctaacatcatcaatctattcatttgccttatcctacaataaaca

SEQ ID NO: 215930 - DNA, 243 bp, Homo sapiens
caggaatgggtgaaggtcctttaaacaaaaaaagagttcatgttagttattttgctgtttcactgtcatacaaatgtgttatgacccttgccaatatataattatgatggagaattatttttccaccaatgagaataattggcaaactgaccaactttatagattatgccccttaaactcctgctatgtctcttattaagtgagccagttcttctgaagacaggacttgcttgcaagcactgc

SEQ ID NO: 215931 - DNA, 401 bp, Homo sapiens
atttatttatttatttatttttatttgagacggggtctcgctgtggtatgatcatggctcattgcagcttcaaccttccagccaagtttaatttttacaccaatgattcatttctgcttttacaggtgattactttatctcactagaaaaaaaaaatgtaaaaatctaaacaaaaagtgtccaaaacttacaataagccttaatctcgaataattaccatgacatgtgttacttgtgtgcttattgctgtacagccttctttggctttctgacaagagcaactgctgagcagaagcacttcagcctcgtctggcatttgatgaatttgattaatgtgtgctatggtaagtctattcccctgtataattttatgggagaggccatgtgcaagtctgaattta

SEQ ID NO: 215932 - DNA, 400 bp, Homo sapiens
aatgcagtggcacggtcttggttcactgcagcctccgcctcctgggttcaagaggttcttgtacttcagcctcccaagtagctgggactataggcgtatgctaccatgcccggctgatttttttttttttgtatttttttgtagagacaggatttcgcagtgttggctaggctggtctcaaactcctgacctcaagcaatccacccaccttgcctcccaaagtgctgggattataggcgtgagccaccgtgcctggcctgttaacagttatgttgttaccttccatatctttatctatgtgtatacaaactgtcctctgtaacccattttgtacatattttttattatataatttatttttaaaaaaattcttttataggatactttttcacactaaaga

SEQ ID NO: 215933 - DNA, 743 bp, Homo sapiens
tggtcttgaactcctgacctcaggtgatctgcccacctccgcctcccaaaatgctgggattacaagcatgagctactgcacctggtcagaaacagctattttaatagtgtcatctttaagaaagaaaaagttaagcggcaaaaatatgcttctgtatttagaaccatggacctttaattataactctaagactctatggattatttacaaaggaactaagaaaggcctaaacctgctgaagattatgaaggtagtcaatgacagaagacttgctagagctaagcattcttgtctctggtatagtgctatacgtcctcaactatgcctctgcagcaatagccttcctcttcatcttaggattaatggtactgagaaaatttaacatacagaatacaaaagtcactatcctattttcctaagaagaaaactttagaaatccatccaaccaaaacttaattttgccttttccttcagtgttcaagaagaaaaaaatgtatctagtagctctaagtggacagaaggacaagtgaaaactctagaatgcttaaacaagctataacaacaggtttgggcaccatctggtatcaccttactgaaactttccttagtaactcccctacaccccacaacaaaggacgagaaggaaggagctgaattcctactgttttggaggctgaaatgatgacccgtttgcctcccactccccctgctctgagggtatagagtagtgctttgccataaaa

SEQ ID NO: 215934 - DNA, 504 bp, Homo sapiens
gcatgagccaccgcgccgggagctggccctcttctttcctccacgtgaggatacaatgagaagtcagctgtctgcctcctgaaagagggctctcaccaaaacctgaccatgctggcaccctgatcacagacttccagcgtccagcactgtgagaaataaacttctgttgtttacaataataataatgctataacagatatcttcatgcatataaccttttcagataatgtattgcctctctggggagacttttttgaggtggaaatcactgggtcaaagagcaagaacacttttaaaggtgtgatacacaatgcccaacagttataactatttattgaccccaccaggaatgtgcacagacagacccacagtgcctctaggactccctgttatgttttatgtatttgaattagcgaacagttacattttattatttttgtttgacttgtacttctttcattactagtgacgttgggcattttcctatttataaattaagaatta

SEQ ID NO: 215935 - DNA, 592 bp, Homo sapiens
gctcagtagctggagcagctacgtgcagcgtaggggcttttctcttaggggtttccttgccatagcgtatgggagatggtgttaggcgggttaggaattaataaatgccatagagaggcatcctgcgctgtaggaatgaggacagagaagggggaaagtttctgggggagaaaatagttttaaattgggcctagaaagacaaggcatgaatttgtttctctttactcacacgttttcatagaggaatatattagctttagaaactggaaagcaaatggaagaaaattaaaataacctgccagagaaagccattgtcaatatcttggtgtctaccttccacgcttgtttctttgcatacacacttggaaagtgaggtactatacgacctgtttagtaacgttaaaataatttaggctcatgcctgtaatcccagcactttgggaggccgaggtgggcggatcacgaggtcaggagatcgagaccatcctggctaacacggtgaaacctcgtctctactaaaaacaccctcccactcaataacatgtcggccgccttggcccagtcggattttgactcgtgcgctttgcttgcg

SEQ ID NO: 215936 - DNA, 650 bp, Homo sapiens
gctcagtagctggagcagctacgtgcagcgtaggggcttttctcttaggggtttccttgccatagcgtatgggagatggtgttaggcgggttaggaattaataaatgccatagagaggcatcctgcgctgtaggaatgaggacagagaagggggaaagtttctgggggagaaaatagttttaaattgggcctagaaagacaaggcatgaatttgtttctctttactcacacgttttcatagaggaatatattagctttagaaactggaaagcaaatggaagaaaattaaaataacctgccagagaaagccattgtcaatatcttggtgtctaccttccacgcttgtttctttgcatacacacttggaaagtgaggtactatacgacctgtttagtaacgttaaaataatttaaaaaaaaatcttaacagggcagttaatgttaattataacactttgggccgggcgcagcggctcatgcctgtaatcccagcactttgggaggccgaggtgggcggatcacgaggtcaggagatcgagaccatcctggctaacacggtgaaacctcgtctctactaaaaacaccctcccactcaataacatgtcggccgccttggcccagtcggattttgactcgtgcgctttgcttgcg

SEQ ID NO: 215937 - DNA, 180 bp, Homo sapiens
gtgagggtcttttatggtttttcttttttacctgctcaagctgatctgttgaccagaatagctaatagatagtgctgagaaagaaatcttaaccatagctgaaataaattgtttatattaataagggttaaaatgtgactatcttacttcaattagaaaatgatgtcatgatttagaata

SEQ ID NO: 215938 - DNA, 435 bp, Homo sapiens
ctagtttttgtatttttaggagaaacggggtttcaccatgttggctaggctggtcccgaactcctgacctcaggtgatccacccacctcagcctcccaagttgttgggattacaggcatgagccactgcgccctgcctatgatgacctttatattttcatatggattaaagataccgtccagagtgctttcatttcatcttgaatgctcgttttagcatttcttcttggacaggtctagaatactaattaacttcctcagctcttctttaggaaagtctaaaattcgcctttatttttgcaggtgagttttgctaagtgtagtattcttcattgctgttttgcctatttttctttaagcactttcaatatatcacctcactgctttctagcctgaagatgtctgctggaaaatatatataatcttacagagttta

SEQ ID NO: 215939 - DNA, 289 bp, Homo sapiens
tccccacctctttcccaggccccaccaaggtcaaccatgtgctgttggaaagggaacaccaacgtgtgttcagtagtcagaaggctctgggagacatatgaggctccatttcctcagtctggccaccatctcctccttttcatttagtaaacacttaatgaactcccactgtatgcaggtaccgtgcgttgcactggggagtcaaggacaagtgagccacagagcctgtccacagaggctcatgggaggaagcacgtgtgcgaaatgataaatgcaggcgtgcacaggc

SEQ ID NO: 215940 - DNA, 743 bp, Homo sapiens
tgatttgtcagagccattctggaggtaaaaagagcttttgggaatctacaaattcttttgtgaaaattaaggatcggagcctggctgaattaggcattgtcctataaaccagatttggggagaatgcataatgatgccagagcagttttctcatccaaaaagagtcaagagtttgatcaagcaggaaagaaaattgaaaggaatatagctacagctgagttacagaggtctgagacattcttggcaccctttaacccctatttttgaggtgtatgagaaaacctttgataggttgtacactggctatacaacagaatcacactagattaactcagaatatctggggtgaggtcaagaccttaatatatttaaagagatgcctctatacgtccttcctacctcctgagttgacctaatgttaagccaagtattgagaaccactggcttacagggatcccaaagaagacgaatgtaatgtctatcttcccatggtgtatgccaaacttatagacaacctccctgccaacccttgcctgctgactccattcaagatggcatttgagcacagaatctctaggcaaactagggaacatcttactgaagacagtttagacttgactactggtgcctcttatgcgggattttgaagactcagctttatgaattgagggtttggtggacaagtttgacagtttaagcactgacgtgggcaggaagccaactattagctggaaggtctgaaa

SEQ ID NO: 215941 - DNA, 392 bp, Homo sapiens
gaacagcttaatatcttttattagtttatcttttttctttccattaaagagaataatgatacacattacaatatgagattaacgtgtcaaagcagagacttagatttggcaaatgacaacttgtcattcttggcatcagaaaaattaaattctatgtgtattcacttatttaggtagagtgtctacctttcaacctgaagactgcgaggcaatgcttagtttgacacatgatttggaagcttgatagaaattctgagacattgataaatttacgtagtttgaagtacaagggtataaagagtttgctgtttgtaaataaacataaatatcttggacatcttttatgtaagctcagattctccctcttaagaaataaaaacaacaacatttcc

SEQ ID NO: 215942 - DNA, 184 bp, Homo sapiens
aagaggaaggaggaagagaaggacctggcagaaggaatgagggtgaagctggagtgacttttataaaatataaataaatcgcatcacccccttgcttaaaacccttccgtggtatctggtgctctttttttaaggaaaaattgtattattttaattatttttatgtacagaaaactcaacagtg

SEQ ID NO: 215943 - DNA, 452 bp, Homo sapiens
accctcctacccctcctcctttccccttctccccctcagtccctgtgacccagcctctggcccccttactgatctgcaaatgcctcaaacatgaccctacctcagcattttgcatttgctgattcctctgcctcccctcctatctcctggctcttcctcatttctttagggacaggtgcagtggctcatacctgtaatcacagcactttgggaggctgaggtgggagtatagcttaaggtcaggagttcaagaccagcctgggcaacagggcaaaaccctatctctacaaaaaataccaatattagccagatgtggtggcaggtacctgtagttccagctactcaggaggctgaggtgggaggatcacttgaacctgggaggtcgaggctgcagtgagctatgtttgtgccactgcactccaacctgggttacaaagcaagaccctatctca

SEQ ID NO: 215944 - DNA, 397 bp, Homo sapiens
acatacagagcctaattcaactgcattttaatgtctccaccccgaagtgaatatgggacatatttaacatgttttattggtacacatgtgtgcaactctcatgaatattcataaatcctcttaaaacttattaaatatatatgtttagccaactgatttagtgtaaaacccctgtcccttcaattcctagcttgtaggttgcaacccatcaaaagaaataaagctctcttttccaaatgtaaagatcttatgattttaagccaatataattgaagacaagagtaggatccatggagcagcccaggttcccccagcctaagtgaatgcacaggtgccaggtggagccattgacagctcatttgtctccctgacagctttgggaggaaggtgggtaagc

SEQ ID NO: 215945 - DNA, 407 bp, Homo sapiens
taagacctgacttaattaatactcaagtaatcatagctgctgctgatattatcaggacctaaatcaagtaagcaatcatgaaattggaaataatatcaattataagactgtcaaaggttgatgagcctactactcaatatctgatagaaaaaaacacagctgaatttatcacttactatatagtgggggagaagtgttgttcaggcatagtcctccttgagcagagcagactgttaatctcgtaggttttttgggaatatgaaattcatattgacacctataggactgtagttactggagtgagactgttgttcattgattcacattcagaagcatgttaattggagtgggtccatttctgtttgtttgactttaggaataaaggactcttgctagttaaaaaaaaa

SEQ ID NO: 215946 - DNA, 648 bp, Homo sapiens
cgcggtggctcacgcctataatcccagcactttgggaggccgagacgggcagatcacttgaggtcaggagttcgggaccagctggccaacatggtgaaaccccatctctattaaaaatacaaaaaattagccgggtgtggtggcgggtgcctgtaatcccagctatgtgggagattgaggcaggagaatcacttgaacccagggggcggaggctgcagtcagctgagatcacaccactgcactccagcctaggcaacatagagactccaactcaaaaatgaacatatttgaaaaatatagaaaaatattaagtagaacataagtcatctaggtaagtcccacttctcattaaaagtgtatattcttttagaatttctctctttttagaaaacacagatatattttacaaagtatttttctgataattaaaaattttttattttggagctcttacaatgatgtagatatataattatagacattatattgttaaaaagtgaaaaagaaggttaaaaacagtatcgtagaatgattctctttatatacgatatgtatttatagaaaaatacaggggccaggctcagtggctcatgcttgtaatcccagcactttgggaggctgaggtgggtggatcacttgagcccagga

SEQ ID NO: 215947 - DNA, 534 bp, Homo sapiens
catatataattttaaattttctagtgataacattacaaagtaaaaataaaccagtgagattaatgtactaatatattttatttaatcccatgtttccagaatattgtcattttaatatagaatcaatacaaaattactaagaaggatttttactttttaaaaatactaagtctttgaaatgtggtatacattttatgtttacagcacatctcaattcagactacctacatttgaagttacagcagcatgtggctaggggctgccatattggttggtactacgtagactttaatgaagtccatgtaatatgcatcataagtaactttatatcagatgaaatgtttgtctgcatttagtagaagtctagaattgactccttataaaatggggaaaagctggtcagatatctgtattattttgtatgtaaatttactcatagaaaaccaataaggcaatgtgctctttcaatctagagagaatatgtcagtcaaatattaaagtggcagccagagcaataaaacaagaccctgtctc

SEQ ID NO: 215948 - DNA, 504 bp, Homo sapiens
tttaaacatgtacatttaggtaacactgtacctataaagctcttagtgtctggcacatagtaagtatcaataaataacagcaacatgtgaagacagtacaagaatctgtgaaacctgtaatagcagacccaatataatagctagcatttattgagcacctacagtatgctaagaattcttcatacacacgcacacacacacacacacacacacaaagctatacacacagttgtatttaatcgttacagcattccaagggtacatcatattaccccagtttacagatgaggtaactgaagcttggtgaggttgagttgtccaaggtcacatgtatgtctcagtgactgtgccaggatttgaattcaggtttgacctgaccaaaacttgagcccttggccattaggatgtaccttggaatcccatttttacagcctccattgccacacactacccccgagaacagtccactagcagcacttgtttccctaccctccagtgcctggg

SEQ ID NO: 215949 - DNA, 684 bp, Homo sapiens
tcttcaatgatattttagataatgatcttaaaagcttttcaatgcatttttctttaattattaaggaaatggaaaagcagttgttgtcaatgtccatatgggggcttatattttacttgtcacaagagtgtaaactaatgaaaacaaggtcacaaggttgacacacttgccagagaaagaacctacaatgcataatcaaagatgagacttaccatttaaaactcattcaatgacggctcgtattagtgatattcatgtgagaagtacatggaggagttaactatttcttcatatatccaatgtttgccatggatcatagctgtagcaaaaagtaaattcaataaatgacttttttatacactttcaaagcatttgaagttctgtttagtgagagaactttagtaaatatttttagaagtagtaatcagccattaggacaaatgatggaagaaaagtgccactctactggtggggtagggcatttcaaaaaacaaacacaatgttagccttaacatttcatgtttaagtttcttttattttgtaccattaaatatgtatagtatgtagatttgttgttgacaatagcagccgccagccatatgtaactgttaaggactcaaaatctggcttagctgactccaatgcgcgcgcacactttcccgccaggtcctttggcctcttccg

SEQ ID NO: 215950 - DNA, 295 bp, Homo sapiens
gaacttgtgggttcaagtaaacctcctacctcagcctctgaagtagctgtgaccacaggcacatgccactgtgcttagctaaatgctactatgcgtattgactgagatttttctgtcatttaggtaatatgccctgaatttcaagttgaaatagagctttttgaaaatactatctttgggtatgagaatctttttttatcatttattaaagtggcaacatttaggttattgtttgagatgtttttatttatttttactttttgttacttttccattttaccttctgaatatgatt

SEQ ID NO: 215951 - DNA, 169 bp, Homo sapiens
ttccactaatgatggcatctacttggtaggctgagtagatatgctaagcgacaaataagtgatgccaaaaatacacaagatgggaatgggaagcgggtatttctggtatccctctttcactcacaatactcagaagggaaaaaaaggctttagtaaaaatggatcacca

SEQ ID NO: 215952 - DNA, 651 bp, Homo sapiens
agactccatctcaaaaaaaaaaaaaaaaaaattcacacaaagaaattgcaaaagtgatacgatgaattcctttattctcttcacctctattcaccatttgttgacattttgccacaattgctttctctctctccctttatacatctgcttttttctgaatcatttggtaggaagtttcaagtaattatgattctttaccactaaacacttcagcatatattttctaagaacaaggacattctcttacaaaaccgtaatataatcattaaatttgggaagtttaacactgatacaatattatctaatatacagttcatttgcagattctgctagttaaccaagggcgttctctatagcctttttcctcttctttttttttgaggcaagatcttgctctgtttcccaggctggagtgcagtgatgcagtctcagcttacctgcagcctccgcctcctggattcaagcactcttcccacctctgcctcccaagtagctgagactacaggtgtgcgccaccacctggctaatttttgtgtttttgtagagacggggttttaccatgttggccaggctggtctcaaacttctgagctcaagtaatctgcctgcctcagtgtcccaaagtgctgggattacaggcatgagccaccgc

SEQ ID NO: 215953 - DNA, 456 bp, Homo sapiens
ctatattctttcagcagctatttctacagtcaattctaaccttgtggagttagtcacaaaacattttaaaaactgctaattacttgccacataaacagttccatcataaaaactcttccccttcttgttccaaaacaacctggttaaatatacatgtggaatacaaaataactttaataggcttggcacagtggctcatgcctctaatcccagcactttgggaggccaaggcgggtggaatgcttgagctcaagagttcgagaccagcctggccaacatggtgaaaccctgtctccaataaaaatacgaaaattagccaggcatggtggcacatgcctgtagtcccagctacccagggggctgaggcaggagaattgcttgaatccgggaggcagagattgcagtgagccaagatcacaccattgcctggacaacagaggaagactctgcctcaga

SEQ ID NO: 215954 - DNA, 396 bp, Homo sapiens
ctccatgttattttgtcctgtagaattttccacagtctggaactcttgttacagcatgattttctgtttactctagttcctgtaaatttgttaaagtgaaaataattgatgtcttatactatctggtcactagaggtagaaaaactatgtgataaacagtgtgtattggcaaaatttattaggtccatgtatatagagatatttcaagaagcatatacatttagcagtgaagcaaatgtcaggttttccagattcctattattgagaacagtttaagtttagttcagttaaagttcttacagaaaatagataacatttaaaaatattaagtgatgtttggatttgctgagatctttgacctgagtgtgtttgttgaatcaggttttagcttcttta

SEQ ID NO: 215955 - DNA, 318 bp, Homo sapiens
acgatgatatcatgctaaactgttatgctaaagtaatgtgaattggccaataaggatatggaaataggtccagtctcactagaactgttcaggaaatgtgaatactaatcccctagatacctacttctgggtatatatctaaaggaactgaaaatggggctgagcttggtggctcgcacctgtagtctcacccactcaggaggtggaggagtgaggatcttttgagcccaggagttcattgctgtagtgagctatgatcacaccacttcattccagcctgggcgatagagctaacccatcgcttaaaaaaacaagaag

SEQ ID NO: 215956 - DNA, 273 bp, Homo sapiens
tcttaaagtctttgatctttcttataagtgcagagaagaaaatgctgacgtatgctgccttctttctctgcttcacctacctgaaagggaagggcccccatcctgtaatcacgtgacatgcttcaccttgtcaatcacttagaagattcaccttccttacgctgcccccttgtcatgtatgcaatagatatcaaagagcctagccgttcggggccgctaccagtctccgcgtcttgatggtagtggtccccggggcccagctgttttctcttt

SEQ ID NO: 215957 - DNA, 409 bp, Homo sapiens
attttctcctttccatgctccttcctgctacaagctactctctctctctacttggaatgcatttccttccccctcttaatccagttaatttgacatccttcaggttttgactcatttttctcattcccctgataaagtcaaactcttggtctggttgtcaaggtacctgtgcctgtccttcatagattttatcactgttgcagttttagagttattttgagtaatgttttgattgccatttctaatagattgtaatatctgtcagcacagagatcatgactgcttttgttcaccactgtataccaggtgactagtatagtgcttcatgcttaataaatgcttaataattttttatttaatggatgaagagtagtagaaatcacatacctctgcttgtcaagacatctga

SEQ ID NO: 215958 - DNA, 486 bp, Homo sapiens
ggaaaacaaagtctcattggctttggggatacacagctattgctattaagtaatcttttcaataaagacttggctttagttaatttatctgagcattgcttctgttagggacatgtcacaagtaggaaatcatccttcagagacagatggaagtagaagtggttaatttagacactattcttttttttttttttttaaatagatgaaagagagtttacttatgtatttatataatggccttggtccaaaaaagactaaagggagctcaaaaaagaattatagtaactttaaaaaatacattaaacatatccaagatcttaaatgtatcattctccccaaaagctagttgcttccaaacttgacttaatattttgcatgttttccctccattgcttggtaagtgtatttgcctcttctttctgcagttgatgtctgacggctgagttttgctgttttgtcaactgacatttccccttctgtttcacc

SEQ ID NO: 215959 - DNA, 548 bp, Homo sapiens
gagctgttattgatttttttttttaagttaggaaccatgatagatatcttaatgtggaaaaattcggagttcatgtgacatacatctttcatttttatcagaactaaaaactgaggttttgtatttattcttgagcccacctgaaatgttgacgggatagctatactaacttagaatatgtatactgtagtacttaagcatatatgctgtataataatatgttttagaaaattgctcaacttggatttgatgtttttcttttgctcagaagtgtgatgtgttcttgttctgtaataatttagtagacttctaaattagtgtactaaagtaaagaggtaattaactggtacaaatatcaccatgtttatttgtaaggcatcactagtttatatcagagacctggatatggcctcagatttctcctgttttaagagccactaagccacctattttccatttctacactacgtgtttcatggttaggtggccaagtcctatgcatgtatctcaggtatctttagtgaccaacatgaagtctgcacatattg

SEQ ID NO: 215960 - DNA, 310 bp, Homo sapiens
gcataatgagcttccccattgtcttccactcatcaaaaatccatctctaccgccttctagtgcctgttccctgaagtcttcccttctgctccccagaactctgtcgtggctcaatccaggctgcccagtacatggatttattgggctgtttatgctgtccaccgtgtgcttagaaattccttgaatgcagagactgttaagctttgtatatacttttagtgcctagaacagtcccttatacttcataggtgcttgttggcttaatttcatcttcaaaaggaactttgattttgatggatatttgaatgtt

SEQ ID NO: 215961 - DNA, 471 bp, Homo sapiens
gtgggggaccacactagctgtgcgctttgcctggagaggtggggatgggatgtcctggtgaagggctagaggggtagccagggcccagctgtggcagtgggggcagtggcactggactccagtgtggtgaccatgccggccctggaggggtctgagccggggcatggcttggcaaaggtcatggtggaactggacagctgtgtgggagcggaggggaggccagggtaggcagggccctcacaggcaattgcagccaggccctgacgactgcaagggttcccatgcgggatccgggacccacactggacgagccccctgccactctccacacacttcacccagtctcagtcactctcccaccagctccgaaacagaggggaaactgaggcctcaggaggtagctctgggccccagctcacacagggactgcaggggcttggacccagcttccccagctccagagccagcgcc

SEQ ID NO: 215962 - DNA, 536 bp, Homo sapiens
gagtagctgggattacaggtgcgtaccaccatgcccggctaagtttgtatttttttttagtagagacggggtttcaccatgttggctaggctggtctcaaactcctgacctcaagtgatctgcccacctcagcctccaaaagtgctgagattacagaggtgagccaccacgctggcccacttgcaacttcctttcaaaagtaaacccaaatagtgttgtggatgaggggaagaagagagggagagagaatcatacagccaatgtgataaagcggtaacatctggaaaacatgggtgaagggtatagttttgcaattttcccattagtctcaaattatcccagaattggttaaaaacaaacacataaacaggtcatccatattcatacttctgctgctggtagtctaaaagcagctatgttctgcaccaaaagtattaaaagagataaggtcttttcatttcgtcattcagtccccactatcattcatgactgtttaatcactatctgcctaagagtgtatataggacatgtagatc

SEQ ID NO: 215963 - DNA, 441 bp, Homo sapiens
atgttgcccaggctgatcttgaactcctggcctcaagccatcctcctgccttgtcctcacaaaggaatggaattacagaaacatccctacgttctgcaaagaatcccattttttgttgactttcttaagccaaggcacaactccctctgactcctcccgagtgtgagcccgttccatctgcagccaacacttccggaaaaagagaagagaggggagaaacaccatctcattgttggcatgtggtgtgacgagccaagtgatggcccttcccactcggtcttcagcgctgagaggagcgtttcttctccccaagaaaacacatccagtgattgacctcagccactttatcctgggctgaccatgggattaggaccacaaagaaaatatgatcaaggggttatgactcttaggcaaaaataaagattctattttattgttttt

SEQ ID NO: 215964 - DNA, 542 bp, Homo sapiens
atgttgcccaggctgatcttgaactcctggcctcaagccatcctcctgccttgtcctcacaaaggaatggaattacagaaacatccctacgttctgcaaagaatcccattttttgttgactttcttaagccaaggcacaactccctctgactcctcccgagtgtgagcccgttccatctgcagccaacacttccggaaaaagagaagagaggggagaaacaccatctcattgttggcatgtggtgtgacgagccaagtgatggcccttcccactcggtcttcagcgctgagaggagcgtttcttctccccaagaaaacacatccagtgattgacctcagccactttatcctgggctgaccatgggattaggaccacaaagaaaatatgatcaaggggttatgactcttaggcaaaaataaagattctattttattgtttttaaatacagacattttattaagaagttaaacattctataaatttcaatctcactaacggatattaggaatttttagttattaaagtactcatgagatgtttt

SEQ ID NO: 215965 - DNA, 532 bp, Homo sapiens
aagaaccacagaggttgaccaccctggcaggtcttgtacgtgggcttactacaagagtcaccactagccttttgacctgccctgaggctcaggtaattatctctgccaaagggcactgcagtcactgcagcccaagcagctgctcccctctttggagagaaagtcacagatccttgagtttggttttctttggctctgctgctgtgaagcaagcctcagtcctagattctttgaccaaaggaagaaagagtttgggctgagtttgtttccttatgattctgctgaaagtaaaaaccacatgtcagtttgtcctgtgccacaaaagtagcaaaatcacttaaggtcaggagttcgaaaccagcctggccaccatggtgaaaccccatctctactaaaaatacagaaattagccaggcgtggtggcgcgtgcctgtaatcccagctgcttgggaggctgaggcaggagaatcgcttgaacctgggaagtggaggttgcagtgagccaagattgcgccattgcactccagcctgg

SEQ ID NO: 215966 - DNA, 363 bp, Homo sapiens
aggagaaactaacaatgaaaacggcctcgttgacggaggaaaagttggaatgcagcctctggtgctgtttgagcgatccctctccccggggcctggccgcgcgctgctgtgttctggaagggctcattgtacagtcaaggcggcagggccttcttctgtcacccatgctggagtgcagtagcatgatcacagctcacggtagcctccaccttctgggctcaatcctcctacctcagccttccaagtagctgggactacagactagccctgcttgcaacttccacgtgcagtcctccgcaatgctgccagagcggcagctacaactctatgattgaaggcatcgccctcctggttctccatatt

SEQ ID NO: 215967 - DNA, 601 bp, Homo sapiens
tccaggtgtcagaaggtatttttcaaagtgcagatagttaaaggctgtctactgaaaggaaagtgaagaaaaatagagatgccagcatgctaaattagatgacacttaacactcaaacatttgttgaattaatgcctgaataattaagagttgattgggcagagacacaggaagattgtgtttaagttacagacttggcttgcatccgtgtttccttctaaagagaccaccttctccatttctgcattgtctttctttagagtgaaaatagctagtcatccccaacatatttggggttttgtggtaatttaaatatctaataggcactgcataatgccattcaatggttgtacctaaatataaccctactaatcaaaatgaggatattgtgtttaagagtctggctatatagtctctggtctgattatagtgttgagtcttttttcaaaaactgtctctatggagtaaagcagggtcctgtgtttcattgctttccagacattccccaacaagtgctgaatggattttgttgcaaaagtttctttggaagtctatttagaattcagattgcattttcccaaggacacaatattcttcttgt

SEQ ID NO: 215968 - DNA, 251 bp, Homo sapiens
gcaaaagagaccagaagggaagaactagccttggagtcaggtctccaaccaagtagatctgtcagagattgatttggttgggaagctaatggaggaggaggagtactgtaagtagctgaaaccatctaattgatgtgggctaaagatgatttagagaactaagaaaggaaagagaaggaaggaaggaagagagggagggaggtgagcaaggggaggaaggagagagagacagaaaagaaaagagaagaaaa

SEQ ID NO: 215969 - DNA, 263 bp, Homo sapiens
cccacagtatttgtcatatgaaataataaatgaggttccactcatgcggtctaagcaaagtaaaagagatgcaaagctagagttataatcagatcacaagcacctctcagtgtcctgccaataaaaattgtgctcctggccagatgtggtggttcacacctgtcatcctagcactttgggaggctgaggcaggcaggattgcatgaggccaggagttagagaccagcctgggcaacatagtgagatcctatctctacaaatac

SEQ ID NO: 215970 - DNA, 420 bp, Homo sapiens
tgaagagaagtgaggaaagctagttccatgtcactctacacaaaccatggtctgtgctgtagatgaggaacccagaaattttgaaactgacttatgtatacatacactctgcccattaatctcctttgagaaggagagaaagctttatactctccaaaataagtagtttctttttggggactgtctctatggaaaaaaggggcatctgagtcttaaaactcctggaatgtctccacagtcttaagctccatctgccttctgaaatgtaaaaacactccttcgaagaggtgaaatagtcataactacttattcaggaatcttttaagattgctgagattgtgccactgcactctagcctgggaaacagagcaagactccatctcaaaaaacaattgcaaatacaaaattacacaggaaagt

SEQ ID NO: 215971 - DNA, 428 bp, Homo sapiens
ataaaactcactgtttatggtaacactaattcaaggttatttggagattttgtttttcttatacaattaagccagttctagttaaaatgtaaacaataaaatgaaaacgaaaaggaaaaaagaggtttttaaaaatcaaactgccatggaaacttctttcccccaaattttgatccacagctttccttggattacctatcagggaaaatagagcttagccataacaggtcccaattttgtcaaaagtaatttgggtccaactgtcttttgtaaaaactacaaatttattatattgtctcatggctagagttctgaagtaaaattatcagatctttgtgtatgtatgtatatacatgtttaaatatattatatatgtgcatgtattatatgttctaacatgctaccaaataaaattatagataaatggg

SEQ ID NO: 215972 - DNA, 462 bp, Homo sapiens
aaccatgctagaattattgattaccaaaatgatgagatacaataaattgcttattgtgctaagttttggagtagtttactaagtaacaatagataactggaactaaatttggtatctgaaagtggactttcactataacgaaaactgaaaacaaatggcaatgactttgtacctggttgccacagaagttagaaaggcctcgagaaaaatgttagtgaatattggaaggacatcgaggagactgctggagagactgaaggacagtaaagaaaatactatggggggtggctgaagaaatgacctgtgttatgtagtggcagaaagttttcgtctttgataatgtgggaaaatagaaaaggtgcccaatgaatgggaggatctggctaaggagattttcagcagaatttcaaaactacaaagaggtttcttttagccacattattataagatattgattaaaaa

SEQ ID NO: 215973 - DNA, 619 bp, Homo sapiens
tagaatgtatggatcattttgagaatctgaaagtctcttctcagaacaatacagataaatacaaacttttagatgtactttaagggggttcaccactaccttgaggaacttccattcacttcagggtatacaacccatggtatatatgataataatagtctaacaaaaacagtgtcaggcattgtgtcaagtgctgtacagtcttaattcattagaatgtggtatttatgcagctaaatttgtgggtttgagaacctgttaggtttccagaggaagcaacaccatctggcattgtgacacatgtagaacattattcacaaagaaccaaaaaaaaattattatgtatatgtgtaataagactgtaatgcaggggtgcacaaagagtagttaaataatagagattaagggtgggaaagtagagaaccagtaaggaagagtgatccctgggaagatagacaaggatgagaggagacaattatgggggtaatacagagttgcatctggaagaaacaaaaaccgtagaggaagataaaatgatgactctctgccaaagaaattcttacccttttccttgcctacagcaaaactggagaggtttctgcaatgagtgaggctaagt

SEQ ID NO: 215974 - DNA, 689 bp, Homo sapiens
tttcagccagggtacatcaagaagagatgaatatgggtataatatagctctcaaaatttccagtactttataacaaagaaatatccctcccactgccctgttttttaaaaaataaataatacatgttttccttccagtcgtgggaaacttaatagaatggttcaggagggacaagtatatgcagcatacctgtcattttccattcaagttttactttatttttaaaatttattattttttaaaatatttcaatagttttggggtacaggtgggtttttggttacatagatgttttttagtgatgatttctgagattttagtgcacctgtcacctgaccagtgtatactgtacccaatatatagtcttttatccctctcaagcttcccccccatcctcaaagtccattctattagtcttacgcctttgcgtcctcatagctgaactctcacttgtaagtgagaacatacgacatttggttttccattcctgaattactcacttagaataatggcctccaattccatccaagtttctgcaaaagacattatttcattcctttttatggctaagtattcaatggtatatatacaccacattttctttatccacttgttggtcattgggcacttgggttggttccatatctttgcagttgtgaattgtgctgctataaacatgcatgtacatg

SEQ ID NO: 215975 - DNA, 351 bp, Homo sapiens
atggatgtcctctggtcagcatgaggcgaggggcaggggtgaggtgtggcacaccgggcatagcctgacacttagcaaacactcggggagtagaagccaggacaccctcattgtgagtagtgggtgtgggtgtccgtggggtcagatgctggaccaggcattgggcttcaacaccttccactcctgcctctctcacacacccattctctggactgggcagtcagggaagacctgatcatcctgaacctcagggagcaggcgaggctgcaggagtttgaccttgcctgagaaaactcagaagaggcaagaaggctgttatcttgagctaactaagtaaaactgctttaaaag

SEQ ID NO: 215976 - DNA, 616 bp, Homo sapiens
agatggggtttcagcatgttggccaggctggtctcaaactcctcatctcaaatgatctacccacctcggcctcccaaagtgctaggattacgggcatgagccaccacgcctagccaaaattttttttttttttttttgagatggagtttcactcttgttgcccaggctggagtgcaatggcgcgatctcagctcactgcaacctctgcctcccaggttcaagtgattatcctgcctcagcttcctgagtagctgggattacaggcacctgccaccacgcccagctaattttttgtatttttagtagagacagggtttcactatattggccaggctggtctcgaactcctgaccttggcctcccaaagtgctggaattacaggcatgagccactgcacccagccccagccaagttttttaaaaagagtttctgtaaccattctcttaagtgatctcagaactgatctctgaggtgggttgagtatatgtaactttaaattggaaactgagacacagagatttagagacttggcaagggccacacaatgagttgatggtagagtgctttattatagttaaatgagtaattatcaagttaaatataaaagaatttattt

SEQ ID NO: 215977 - DNA, 450 bp, Homo sapiens
tggcctcaagcaatcccccacctccgcctcctgagtaactgggattacaggtgcgagccaccgcatccagcctgccaaattttctaaagtagttttgccagtttatactcctgccagctgtatataagaattctctttgtgccatattcctgataacacttgatttgaatcagccttcttgttttttgccaatgtagaaggtgtaaaatggtatctgctagaggccttaatttacatttcattaatgtctgaggttggacatattcttatgtatgtgttcattatttgtcatcacttgtgagaatagataatacaggtattactccattatattggtggttaaataaagggactaaaaggaagagtgatttggctttcagtatgcaacttgataagtggcagtagtttatttgcctagactggctaacattggttatttgaaaacacatt

SEQ ID NO: 215978 - DNA, 546 bp, Homo sapiens
aggaaattaggaaagatagaagttctcagcagagaactagaaactgcagaataatcagatagaaattttagacctgaaaagatgatatgggcccagtagcggaataaatataacagagaaaagagtcagtgaacctgaaggtagatcaatagaaagtatacacaatgaaatatacattatgaaacaaaaaaaattggagaaaaatgaaaagcctttcatggtactgtgggacaatgtcaaaaggctgaaacttcttggtattggcattccatctcagaaggtaaaaagaaaaatactggtgcagaaaaaaatatttggagaaagagtggctgaaatagtttcaaatttaaagaaaaacgtatcttcacaaattgaagaatctcagtaatttcaaacaggatacatttaataacaactcctcagccacctcataagaaaacttctaaaaaccaaggattaaaaaacattaagagcattaaaatatgacacattatacgtaagaaaagggaaggaagaaaagagaagaaaggaaggactcaagaaaga

SEQ ID NO: 215979 - DNA, 2801 bp, Homo sapiens
catccgcttgaacaccaaagaagacaaaaatggtgtccccgacttagtggccctgctggctgtgagagacaccccggacgaggagccggtggacagcgacacttcggagagcgactcgcaggaaagtggggaccaagaaacagaggagttggataatcctgagttcgtggccattgtggcctataccgacccgtcggacccctgggcccgggaggagatgttgaaaatcgcttctgttatcgagtcgctgggctggagcgacgagaaagacaagcgagaccccctccgacaggtcttgtccgtcatgtccaaggacactaacgggacccgcgtgaaggtggaagaggcgggccgcgaggtggacgccgtggtcctgcgcaaggccggggatgacggggacctccgggagtgcatttccaccttggcgcagccggatctccctccccaggcgaagaaggctgggcgtggcctcttcgggggctggagcgagcaccgtgaggacgaagggggtcttctggagctggtggcgctcctggctgcccaggacatggcggaggtgatgaaggaggaaaaagaaaacgcctgggaaggcgggaagtacaaataccccaaaggcaaactgggggaggtattggcgctcctggccgcccgggagaacatggggtccaacgaggggtcggaggaggcttcggacgaacagtccgaggaggagtcggaggacaccgagagcgaggcgtcggagccggaggacagggcatccaggaagccccgggccaagagggcgcgcacggcccccaggggcctgactccggccggcgcgcctcccaccgcttccggggcccgcaaaacccgcgcgggcggccgaggccgaggccggggcgtcactcccgagaagaaagccgggagccggggctcggcccaggacgacgccgcaggaagcaggaagaagaaggggagcgcgggcgccggggcccatgccagggcaggcgaggccaagggccaggcgcccactggatccaaggccgcgcgcgggaagaaggcccgtcggggccggaggctgccccctaaatgccgctagtggccccccaagaagccgcccaggctgcgagcaggccccgcagggcacccgcccgcctgtggcccccgccctcccctcccctcttcctgtcctccgcagacgcaatctcctcgcttcacagcgcgcccgggccgcgttttgccagcgtcacgttcccctctcgggccctcgcaggccgggggcgccagcgatcccgacggaggaagcccggatgggaggaggaaagagaagtgggcgcccgaggcagcagcgcagggccgagatggggacgcgccaagtggaccaggattgggggcccgggttgcccccggagggggtgtgtgtgtggacgccgggcacctgcagaggcgagcagggctcttcgtggcgctctcggggcctgcgcctggcaggtgctgtaggccgctgtcgcccctaccccagtctgactgggccctgggtctgtggtggaggctcagtcaccagccgcgcagcgcgtgtcagggcgcaactctcagccaggggaggccccagctcccagccaggggaagagatgattccagaaaggaaagtctgagagatagaaggcggttgggaaggggaggaggaggaaaggggagaggaacggtgggagaagggaaagaggaggaggagggggaggggggagcagagggaagacacatgccagccctgcctactggggcgcccctgataacaaaggaaccagccccaggccaaggccacctgcccctgaccacaagttgaatttgtcactcagactgcagtgtttcccaacattctaattatttgcagaggtgttcaatttggggtaattcacttaaaatccagttttggttcttctgggctgagtgggccctggcccctcccataggctgtggctcccctgggtgccccctctccagtggagctgacccaccgctcagcgctggccttgcagcccttactaaaagacttgaaagtccctgggttcaccccctgagtgaattaaaggccagaggggccccgaagggcactgtgagggacagaggctcacctgggcagtgcagaagccggccgcgtgtccctccttacaggggatgaaatgacctggggaggaaaccccagccctgccctggaggttccagagtaggcgggccggtgctgtgaggcttcacaacctgctgtcccaagcacgcttgagttgtatgtgagtctgtgccgtgccgtgccgtatgcttcagctcctgcaaccccggctgagctcgatttttacctaaatatcagtctccacgggaccccaccttcattcatgccttcttgtccctggggcaatgtgtgtgcttcctcgtcccaatttccattccctggcagtgaggagcccatcgtgccagggggccctgccccacttgtccctgggaaggaataggagggtttgggtgtgacctcacagtccagaccagactgtcccagtcctatgtcagggacacccagatgtagaagctgactgagacctgctgcagggcgtgggtgctcccctctgcttggaggctgtccctggacagtgacccacccactgaggaccaggctgggtgtaccttgagctgggcacagcagcctgtggtgttgcctgtgggtggggagggccccaggtgtgcttctcccgtagcagtcctaggcttctctccctgtgccctgtgtcacctggatcctccagtaaagtgaaattcagcactgtaaaatctct

SEQ ID NO: 215980 - DNA, 2659 bp, Homo sapiens
catccgcttgaacaccaaagaagacaaaaatggtgtccccgacttagtggccctgctggctgtgagagacaccccggacgaggagccggtggacagcgacacttcggagagcgactcgcaggaaagtggggaccaagaaacagaggagttggataatcctgagttcgtggccattgtggcctataccgacccgtcggacccctgggcccgggaggagatgttgaaaatcgcttctgttatcgagtcgctgggctggagcgacgagaaagacaagcgagaccccctccgacaggtcttgtccgtcatgtccaaggacactaacgggacccgcgtgaaggtggaagaggcgggccgcgaggtggacgccgtggtcctgcgcaaggccggggatgacggggacctccgggagtgcatttccaccttggcgcagccggatctccctccccaggcgaagaaggctgggcgtggcctcttcgggggctggagcgagcaccgtgaggacgaagggggtcttctggagctggtggcgctcctggctgcccaggacatggcggaggtgatgaaggaggaaaaagaaaacgcctgggaaggcgggaagtacaaataccccaaaggcaaactgggggaggtattggcgctcctggccgcccgggagaacatggggtccaacgaggggtcggaggaggcttcggacgaacagtccgaggaggagtcggaggacaccgagagcgaggcgtcggagccggaggacagggcatccaggaagccccgggccaagagggcgcgcacggcccccaggggcctgactccggccggcgcgcctcccaccgcttccggggcccgcaaaacccgcgcgggcggccgaggccgaggccggggcgtcactcccgagaagaaagccgggagccggggctcggcccaggacgacgccgcaggaagcaggaagaagaaggggagcgcgggcgccggggcccatgccagggcaggcgaggccaagggccaggcgcccactggatccaaggccgcgcgcgggaagaaggcccgtcggggccggaggctgccccctaaatgccgctagtggccccccaagaagccgcccaggctgcgagcaggccccgcagggcacccgcccgcctgtggcccccgccctcccctcccctcttcctgtcctccgcagacgcaatctcctcgcttcacagcgcgcccgggccgcgttttgccagcgtcacgttcccctctcgggccctcgcaggccgggggcgccagcgatcccgacggaggaagcccggatgggaggaggaaagagaagtgggcgcccgaggcagcagcgcagggccgagatggggacgcgccaagtggaccaggattgggggcccgggttgcccccggagggggtgtgtgtgtggacgccgggcacctgcagaggcgagcagggctcttcgtggcgctctcggggcctgcgcctggcaggtgctgtaggccgctgtcgcccctaccccagtctgactgggccctgggtctgtggtggaggctcagtcaccagccgcgcagcgcgtgtcagggcgcaactctcagccaggggaggccccagctcccagccaggggaagagatgattccagaaaggaaagtctgagagatagaaggcggttgggaaggggaggaggaggaaaggggagaggaacggtgggagaagggaaagaggaggaggagggggaggggggagcagagggaagacacatgccagccctgcctactggggcgcccctgataacaaaggaaccagccccaggccaaggccacctgcccctgaccacaagttgaatttgtcactcagactgcagtgtttcccaacattctaattatttgcagaggtgttcaatttggggtaattcacttaaaatccagttttggttcttctgggctgagtgggccctggcccctcccataggctgtggctcccctgggtgccccctctccagtggagctgacccaccgctcagcgctggccttgcagcccttactaaaagacttgaaagtccctgggttcaccccctgagtgaattaaaggccagaggggccccgaagggcactgtgagggacagaggctcacctgggcagtgcagaagccggccgcgtgtccctccttacaggggatgaaatgacctggggaggaaaccccagccctgccctggaggttccagagtaggcgggccggtgctgtgaggcttcacaacctgctgtcccaagcacgcttgagttgtatgtgagtctgtgccgtgccgtgccgtatgcttcagctcctgcaaccccggctgagctcgatttttacctaaatatcagtctccacgggaccccaccttcattcatgccttcttgtccctggggcaatgtgtgtgcttcctcgtcccaatttccattccctggcagtgaggagcccatcgtgccagggggccctgccccacttgtccctggacagtgacccacccactgaggaccaggctgggtgtaccttgagctgggcacagcagcctgtggtgttgcctgtgggtggggagggccccaggtgtgcttctcccgtagcagtcctaggcttctctccctgtgccctgtgtcacctggatcctccagtaaagtgaaattcagcactgtaaaatctct

SEQ ID NO: 215981 - DNA, 1299 bp, Homo sapiens
tgctgggattacaggtgtgaaccaccatgcctggccatggttattattctgaataatgaattacctcaaaattaattaacatttattaccacatatgctttctaagagtcaggaatcagagagcaacttagctgggtggttctggtacaggtctctcctgaggtagcagtcaagctgtatgctggggctatcatctgaagcatgaatagagatggaagatctgcttccaaaggctgttgacaggtgacaccatcatgtgagcctctctgtagggcagtttaattgtcctcctgacatggtggctggcttccctatagcaagtgatcaaagagagaaagcaaaaattaagctgcatggtcttttatgacctagttccaaagttgcacaccatacttccttcccctctattttgttccttagaagctggtcactgagtcaaacctgcactcaggaagaaggtagttttcaccttttctgaaaagaggaatagcaaagaatttgtagagatttgaaaacactaaaatacctaaacattgaaactcccccagagtatttacatgaattgcatgttttctaaagtagtgcaatgtatcacaatgttcaatttgtcaataagaagtgcttttagacaaagtgcttttcctggaaattagctaactgtcttaaagtataaataatgtcattttgaaaaaaaacaaaaatccttgtaaccatgaaaacaagaatcaccagtacttgaagaatccaaataatgacctaattttgtttttattttctttttattcctctgaagtagattcaacaaattcaagtaaagaacattatgtgcatctactttgtgccaattactatgtcatgtgctctgggaaggggatacacttatgcagaggtgacaaagatataatctgtcccagagaagctgagagtataacagagatgatggacacatacacaaaacttaatatgatatgaagctcactgtattgagttttgtgagagagctacagaggaggtgttatgggggcacaaggagaagaaagttaattaacattgaaagatgagaagacatcttggaagaacttgaactgggccttggaagaagaacagccattcaaatagatagaattgtggtagcaaaggcatagaggtaggaaagtatagatctccagggacagtagtcatggggttggggcactgttggaatttaaggttggaaggatatattggagccccttgaatacggtaacaaggcacaccttgggcagtggagagttatcagagtgtttgaaaaggagggtt

SEQ ID NO: 215982 - DNA, 1385 bp, Homo sapiens
ggcacgagggagaacacaagaggacagagctaaggtgtaggaatgcggaagaacttgcagaaactagagctagtcttcggattgaaatgaattaccaataaagggttgggaaatggatcaaggagagggaagcgttttgatggtccctgctccgaggttcagcccatttgcagttgctgataaccttgtcaggtcaccagataaaggcaagtcttgtcaccctcaggcacctggctgcgaagtaataaaacggttgccttatcatctaaaggtggagtgagtcaaacctcagcccagggtaattatagtaaactgaaattgcctgtcctttacaaaaaaaaaggcggagggagagagaaaggaaaagggcttaaggcaggaaattgtgtttgtctttctccttggatttaaaaaagaaacgagcaaaacagcaaaaagttttccagggagtgagaaaagcagcccggctagactcccctcaccctgggttaacaggattgccgacagatcaggcccacgtgatggtcaagaaaagaggctcaagctgatgaaaatccaagaaatcttcttaggagccttcctttctaaatgtaaatgactgagtcattgctttgctaaggagggaaggaagttacaatcacaccaagtgactcattcattgctgttagctccggcagttggatgaaaagttttagcaaaagcagcaacaaatgtactttaaatactagcacagtaagggaattcctgtctttcaggatgaatgccatccacacaaaagagctcctgttgacatctcatttacaatctcccccaggacacagacaagaccctttcaataaatccagctcagaaacacctattgttcaaaatcttcaactcgccacaggctaccaccactccctatggctttgcaaaattaaagatttagaagaaggatggggcggtggaagctatgaaaagaggcaggaaaaaagttcctttgacccgatgctgtcagagagcgtgcatgaagaagaaagttaatggtatttccatttatataagaagcgcctaagaaatgcctgtgacgttcgtgaactagtgattgtgaattccaaatttgatgccaactttatgtgtaaagaagctaactcctgccaacatcgtggctgaatgaacagctgggactatgcttaacccattcccagcttataaaagccccatggcagctgcagtgaagcatcaggtgagtctgatatgggctgtctgttccctcggggatttgaatcttgcctgtcctttccaagtggagtcttgtgcctaagtgctagagcccactccttcctccccactgattcccttctttccatttctgccatttcccttcttcttttaataaaacttgg

SEQ ID NO: 215983 - DNA, 1399 bp, Homo sapiens
ggcacgagggagaacacaagaggacagagctaaggtgtaggaatgcggaagaacttgcagaaactagagctagtcttcggattgaaatgaattaccaataaagggttgggaaatggatcaaggagagggaagcgttttgatggtccctgctccgaggttcagcccatttgcagttgctgataaccttgtcaggtcaccagataaaggcaagtcttgtcaccctcaggcacctggctgcgaagtaataaaacggttgccttatcatctaaaggtggagtgagtcaaacctcagcccagggtaattatagtaaactgaaattgcctgtcctttacaaaaaaaaaggcggagggagagagaaaggaaaagggcttaaggcaggaaattgtgtttgtctttctccttggatttaaaaaagaaacgagcaaaacagcaaaaagttttccagggagtgagaaaagcagcccggctagactcccctcaccctgggttaacaggattgccgacagatcaggcccacgtgatggtcaagaaaagaggctcaagctgatgaaaatccaagaaatcttcttaggagccttcctttctaaatgtaaatgactgagtcattgctttgctaaggagggaaggaagttacaatcacaccaagtgactcattcattgctgttagctccggcagttggatgaaaagttttagcaaaagcagcaacaaatgtactttaaatactagcacagtaagggaattcctgtctttcaggatgaatgccatccacacaaaagagctcctgttgacatctcatttacaatctcccccaggacacagacaagaccctttcaataaatccagctcagaaacacctattgttcaaaatcttcaactcgccacaggctaccaccactccctatggctttgcaaaattaaagatttagaagaaggatggggcggtggaagctatgaaaagaggcaggaaaaaagttcctttgacccgatgctgtcagagagcgtgcatgaagaagaaagttaatggtatttccatttatataagaagcgcctaagaaatgcctgtgacgttcgtgaactagtgattgtgaattccaaatttgatgccaactttatgtgtaaagaagctaactcctgccaacatcgtggctgaatgaacagctgggactatgcttaacccattcccagcttataaaagccccatggcagctgcagtgaagcatcagaaaagtatagtaagaagaaactgaatttgaagtggattcttacaaaggaaaaagaaaatcactattgtaactataccaaattactatattatgtgatgcaacaaaattcaaatatgaaaaccatctcggaggccgggcgcggtggctcacgcctttaatcccagcactttggga

SEQ ID NO: 215984 - DNA, 368 bp, Homo sapiens
caaaacactaaaatcaacaacaaccataatggattcctgcctaggcaggtcgggacattaagaaaaaaaaaggtctcgctgtggtttgctattagatggagagatattcagatttcatttttaaaatgaaagtgaaagattaaagaattttggcatcctgaccctttgtagaggccattcctcagaggcacagtgtgcagacaaaactatcctagaggtgccaaccagaacaagctctaatgtctgtctcattcctgagccttggtgccttgacgagtcaccacgctcaggaagaaagctgcaactcgccaggatgaaattgggccccacttcttagaacccttccccgcttccttcccctgccagaa

SEQ ID NO: 215985 - DNA, 721 bp, Homo sapiens
ctagaggtgccaaccagaacaagctctaatgtctgtctcattcctgagccttggtgccttgacgagtcaccacgctcaggaagaaagctgcaactcgccaggatgaaattgggccccacttcttagaacccttccccgcttccttcccctgccagaaccacactaaagaattcgctgctctcaaagacagacgttttcattacttccttacattatagagtttgggcttagataaccagttgtatgagtagtaagtcaaacagaaatacaacagcaataatacttatttctttccctaatgtaatatgttgtacttcataagccatcatatgcatttgttgcttttcccccttctacactgaccagtagttttgctttgtttgacagaaaagtatagtaagaagaaactgaatttgaagtggattcttacaaaggaaaaagaaaatcactattgtaactataccaaattactatgtatgtgagctcccagctttgacatcaagtcgttacagccacgtaatgggattacgggtgatttttactttattctttgggcttctctgaattttcctatattttgaaaaagcacctgcattattttgtaattataaaaaagtataaataagaattatacacactattatttcttcactgctatgacatgactagattacaatttttttctttttgagatgactttcggtcttgtttcccaggctgg

SEQ ID NO: 215986 - DNA, 402 bp, Homo sapiens
gggaaacctaggtgcacgaagcttgccaggccaggagggggccggccttcttagttccagtccaccacttttctctcttggctactctgcctaaaaataccagggctggctgggtgcagtggctcacgcctataatcccagcactttgggaagctgagttgggtggatcacttgaggccaggagttcgagaccagcctggccaacatggtgaaaccccatctctactaaaaatacaaaaattagccgggcgtgatggcgggcacctgtattcccagctacctgggaggctgaggtgggagaattgcttgaacccgggaggcagaggttgcagtgagccgagattgtgccactgcactccagcactccagcctgggtgacagagcaagaccctgcctggagaa

SEQ ID NO: 215987 - DNA, 920 bp, Homo sapiens
gtcagacataccttgctataccccctcccttttggagtttagacacaactgaccagcactaatgttaaaatagagaccagaaggctgacaaaacagactctctatagcaataagatacccagttataaacaggacctaaagccatgcatggcaaggccacacctgcaggccatcaatcttgctatgtagcatccttaacttaaaacattcctttgtgctgactccaagtgttagagcctttaaccaactgtaaattacagagtccctgaatccacctataacctgtaagcctcctcttccagacatcccacctttttggacctaaccaatgtgtgttttccatgtattgatttaggtctttgctgtagttcttgtctcccttaaacacataagactgatctgactgcctcaggcacactttctcaggactccctgagattgtgtttccctgagccatggtcatgaaaccgacccaacagccccatagacagtttttaggataaacacagaaattgacccttctggtcttaaagcttgaaactttgttttatgtgcttctttcctcaggaaaggaagcccaggtctctcaaaaagtgtcaaagaactgaaactcaccagatcactgcatccaatgagactccaggcccctcattcaccatgattgcttccttacccctcctgagttcctgttttcttacccattgttacatttcttccctgctatctaaacccttagatctagtcagtcatggaaatggatttgagactgagccccagtctcctccgctgcagcacctgattaaagccttcttcttttgcaatactcctggtctcagtgactggctttctgaagggtgagcagcaggacctagactgaacccgtgatgtttcaataacagattttggttccctgacaagga

SEQ ID NO: 215988 - DNA, 561 bp, Homo sapiens
catgctctgaagctcaggctttccaagatccagaaaggtatgtgatgcaccaccccaacctgggaccagggtggctcctcacaatcaaatacatggtaatttctgcagcaaaacatgcctatttgcactaagtgagacaaataaatgcctcaattcacatagatttcaatttgattttagaccaaaataatttgacgcaaagttacgaaaacaacatcaaaggagggggaaaaattttcagagctgctgagatttgggaattgcagatgaggggctgtgggcctagagctattgatacaacaagggaagcaaagggcatgtcccagaccaaccattctctgaggagggcaggcagcatccagaaagatggtcccaagtctggaaggatctaatctgacatcaaaggagaggaactatccaggtgagtgacatcattttgcagccagggacctccaggaatgaggatgtgttaatgggtgatgtgcagaagtatcctctggggcattcaggatcgacagctgcctgctggggtctctaatgagatggaagtggttggggagg

SEQ ID NO: 215989 - DNA, 96 bp, Homo sapiens
ggagacacagtctagctctcttgtccaggctggagtggggtctatgctttttcttaaacctcttctcaacttttcatacccttctgtcgtcttctc

SEQ ID NO: 215990 - DNA, 441 bp, Homo sapiens
cttgaatgcttgctgctttgttttccattttctctttctagtttaatgttctttatattcctttaaggtaaaaatgtcttgcttccaacttgttttccctgatttatcattaactgcttttaattgaaaaagtaataaaagcacatgacgaaaatggaaagagatgaaaagcatacacaatgaaaagcaagcaagacctctgctctcctaatctctgtctccagaggtgacactgctactggcttcttgtgtttccttttagaagtcctctatatggccaggcatggtggctcatgtctgtaatcctagcactttgggaggctgaggccggaggatcccttgagccccggagttcaagactagcatgggcaatattgagagacccagtctgtacagaaaattaaaaaattaaccaggtgtggtggcacacacatgtagtct

SEQ ID NO: 215991 - DNA, 201 bp, Homo sapiens
aaaaagcccaggaacacgggtatgtaagggataagttggaggcaagaagaggtgaagagagagctctgaagtgatcagctctgtctggtgcttggagtagaagtccagcaagataagaattggaaagtgcctgacgggtgctacatgcagggagcttgtcctgcgtgtaggctggcgtggtgagggcaaaagctagactga

SEQ ID NO: 215992 - DNA, 738 bp, Homo sapiens
ttatttaaccatattttttaatttggcatttacctagagaaatgctatcacatttaattccttcgttttacagtttcacctcctcatgtgattccttcattttgtaagtgaccgattccaccctatacaatcacatggccaatgaatgacagtcagaattagaacctagtcccctgattcccaaccatgtcttataccagactgtttcccctaatcgataggaaactactcctaaagggcagaaactgcctctctttgtttttgtcccccaacctcccctccacacatacacctctgtaatctgatgctttaagctcagattaaagcatcagcaagctttaatctgacacatggccgtaggcttgagttagcagttggtcccttctttcttccagactctcataagagtaccctatcaggtctggacagacttccgtttatgcctcagattcaaaatacccaggaaaaagaagaagaaatacaaaacaacaaaaagaaaatcaagaaaaaaataagatatccaggaaatattttgttagttttctattctggtgacaaatgcaaacttaaggaaacaagttgcacagtgttaactaatgtttaacattcctttccatagtgtttatgtgggccttttatcaattcatgacaaataggtcacctccaaaactgttccaacataggttaactcagaaatttaaaatttaagtactatcctttttggagactatgagaaga

SEQ ID NO: 215993 - DNA, 712 bp, Homo sapiens
  misc_feature (5)..(5): n is a, c, g, or t
  misc_feature (11)..(11): n is a, c, g, or t
  misc_feature (102)..(102): n is a, c, g, or t
ccccngctgtnaatgtatccctgggccctagagctggtggggacccctgctgaaggctgcacctagcagggtgcaggaacaggagtgactcaaatgaagccnaagcccatttggatagtgggtcatgggtttcctgggcagaaatagtgacagtcagaaactttcagatgggtgagggtttaaaagtgagctactgcccccacaagctgactgcccaggttagaatgaaagtaagtcctaggctgaacacacacacacacatacacctctgtaatctgatgctttaagctcagattaaagcatcagcaagctttaatctgacacatggccgtaggcttgagttagcagttggtcccttctttcttccagactctcataagagtaccctatcaggtctggacagacttccgtttatgcctcagattcaaaatacccaggaaaaagaagaagaaatacaaaacaacaaaaagaaaatcaagaaaaaaataagatatccaggaaatattttgttagttttctattctggtgacaaatgcaaacttaaggaaacaagttgcacagtgttaactaatgtttaacattcctttccatagtgtttatgtgggccttttatcaattcatgacaaataggtcacctccaaaactgttccaacataggttaactcagaaatttaaaatttaagtactatcctttttggagactatgagaaga

SEQ ID NO: 215994 - DNA, 379 bp, Homo sapiens
taggttgagttttcctcctctgctaacaggaaacaataccgacgttctttctcttatagcatttgtattataaaaagcacaaagctccagcccactgaacctctgccaattaagatggttgctgggattacaggcatgaaccaccgcccccagctgggattttttaatttttctatcattttaaaataagacacacacttttatagatgctttcatacttggagctctactgattttccatccaagccaacttgtagggttttttccttcctatcaccagaggagacagggtttaggggaatccaagaaggttgaagtcagcactccattttcatcccctttccacccctctgcatcacccaaatcacactttcctttc

SEQ ID NO: 215995 - DNA, 647 bp, Homo sapiens
ttggggagtacggaattacagcagggctgaaaccctgctttcaggggcccccatgtggctggtagggtcagcttttggaagctagactggatcctattactccccagatgaaaagttcaaattccttaatacaactcagagctcatcacaatgtcacaaccctcctttctcggctcgcttcctccttaagagctctggggcgattctttcagaccagcctgagggatcttccacaggttgttaatatgggctagaaacaaaaagtggtggtgtttctatgatctaatttgttggaacaaacgtagtgttaaactcaaacatttctgtaggatttcttggagctttaactatactaacatttactgtaactcttcaggacagggtatgattacgtatttcccacatttctttggtcagagaacccgtttttgtgaggagcatttcatgggacagctgttgtgagaaacagtttgggaagggctgtgttggtcccatggaggggctggctgttcccagagcaggtcactcccccacttgcattgccttgcctggactcttttcttggagggaggtccctttcctctacccatctgaatttttttttcttccaccagtgtccagcttgcctttcaccatgggcctaatga

SEQ ID NO: 215996 - DNA, 522 bp, Homo sapiens
gggtacccatgtggtaacgttgcacctgtcaatggagtacagcagttcaaggggatgttgacaccaatgtgctccattgaccttattcagatttcacagctttccatgtgtctacctgtgtgtgtgtggtttagttctgcgcatctgtcactgtagggtttgtgtgagcccatggccaagatgcagcacagccaccatagggacctcttgagctgccctcttgcagccacagccacctccctttcccagcctgaacccctgagagccactggtatgttctccatctgtatggtttcaccattacgagaatgctccataaatggagtgctgcagggtgtgggcgttgaggtcggcgtgatgtcctgaggtccatccagttgtgtgcactactagtgtgttcctttgactggaggaaacgtctatggtatggatggacggaccatcatgtttcacctgttacaagacatttggttttttcccccagttttttgctattatgaataaagttgccatgaacattta

SEQ ID NO: 215997 - DNA, 336 bp, Homo sapiens
aggctgaagcaggaggatcgcttgagccagggaggtggaggatgcagtaaatcaagatcgtaccactgcactccagcctgacaacagggtgagaccctgtctcaaatctcaaaaacatcataatgaatgaaaccaaagaaaccctacctaagagaagacactgtatgattttatttatgtaaagtttaaaaacaggctaaagtgattgatggtgatagacatcaggatgaagtaacttttttttttttttaattttgggatagggtctcactctgttacccaggcaggagtgcagtggtacaatctcggctgactgcaacctccacctctccggct

SEQ ID NO: 215998 - DNA, 664 bp, Homo sapiens
tctctgacatgaaaatcctgaagcatcccagtggtacttcaacagaagaggtgacacaaactcccaagaagttagtcctttgtcagaaaaagataacctggtacagcttccctaaaacaaattcagacagagatctggtcatcaacactcctgtttaaacttgcaaagccatcatctctgtattgtgagttatctgtgtttcattataaccgaagttcatctgcacaaattggcattctaaattgttacttgttattctgcacattttatgatgagatagttatagaaataaattaatataaattaagagaataccacaaattagtagaataaggaatggccaatatttttcaagaagctagctaaggtttccaatgtcatttattatataaattaatattctcaccacatatcataccccaatctcagatgtatttaagtagctaaacagaaaaatagaaaaaagaaaatattgtgtgttatagaaactaagaaaaatagaaaaaagataatactgtataatagaagctaagaaaatggagataaataattattatctcaacaaaaatatcatcattagaataaaagcaataaaagccaaaaaataattagaaggaaaatatagttttactgtataataaacatacacttaaatataaagcag

SEQ ID NO: 215999 - DNA, 645 bp, Homo sapiens
tgtcagagggcagattttgactgagagtaagggtaactttctagtaattagaactatccagaaaacagaactaagtgctatggaaggtaagtaatttttttgtccatgaagcttgtcaagcaaagattcatagaaatgctacagagaagtttaacacatcagacaagggatagattggaagagttttccaaaacagtttggaaactgttagtttaatttctgtcgtatctgtcaacttggaattcatacttcttggttcctttctaattctatgaatgtatgtctttgaaatctcagtaaaggaaccaaatatttgttattgcagataaacaatacaaactttagttgtatagttaagtgcttttacttgatggtttttttttttaacaaactatttttttaagagcaattttaggttcacagaaaaattaagcagcaagtacggagagttcccatgtatccctgtccccatactcatacaacttctctactgttggctcccacaataatggtacatttcttataattgatgaacctacattgacatataattatcaccaaagttcatactttatattaggttttacttttatttgatggtgttttgaaagaaaatgtgaatattcttgcttgtctttgagaaag

SEQ ID NO: 216000 - DNA, 653 bp, Homo sapiens
tttgaaaataattcatgagtgtttaaaagactagcatattcagcatggtaagatgcactcgtgaggagatgggaccctttgtacttcctagagtacaaagaaacactgacctagagaaccatattctaagaagtctacttttgtttaagcatttttctgggtcagctccagtaaatgaatcttgctattcataatatttcttcttctgaacctataggtttttaacttagggatgagagtccaggatagtagctatttgtacatgtttgcttattttcaatttatgtgtttgttagggattgtccattaacttacagctgttttcactctgatcattgttcctagcaagtatgcttaggtatggtctcacttcctatcacctcactctaatgagtcctcttaatccttatcagaaggaaattccatttcttcttaggggaaagtgaccataatagtgtgtaagattgagttaccttaagttgtatatttcagaagtataaatcaatatttactcaaatgcctggaacttctggttcatctgttgtgaatataaaaccacttatgggcaaatgttaagtgtctagtatttataccagatatttatagtctttggagcctttcctaggatcatgaatttaggctgctactcaatt

SEQ ID NO: 216001 - DNA, 396 bp, Homo sapiens
gccttgtgttgctcccctcgtcccgctgattttaagtctttccaaggtgtcagtgggtttcagtggtggggaaagaagagtactgggtacaagctggagggatagaagtatattttggtttattctgttcatgttgggcttttccctgtctgcaaaaagagggtgcttttgttgtgatggaatggaatactgaggattatttcttgaaactttagttttataacacgcatgtgaaactaaatgttaaaaatgctcatgtaaaaaaaaatttttttttactgtgggttcctgtggagaaagttccgaagtacctgctttaggtgaacatccacatttgctagaacattctaactaagatattttcatgtgtgcaagctagtaaaacggctgttctca

SEQ ID NO: 216002 - DNA, 163 bp, Homo sapiens
gctctgtggcatccaccaactcagtaaccccctgaatatctgacttagccgccaaggaagaatatcttagaagctattaggaattcctcttggggctaggtctgggccttggagtcagtctgatccctggtttaattcttccccttggctcaacagcagtgta

SEQ ID NO: 216003 - DNA, 322 bp, Homo sapiens
aatagagctatccataatataaataattctacattttatcaaagcagaaatacgtatctatggttagagcaagcccacctattagagtgatgggttctttcaaactgaaatggaatgctatcagggaccatcaaaagatgacagcagcacagccaaatgacagagccctcacatggtactcatgggtttcagatgatacatgccagaatgatgtgaacctactgggtgcattgctttgaatataaccctactggtttcttgggataagcatacttattcccttcaaagaatctaaaaagatattgcatgccaaagcaagatt

SEQ ID NO: 216004 - DNA, 423 bp, Homo sapiens
ccagaaagggcaccaagccaactcagaaaaggagcgtttggtgacatgataaaggcgaatcgcgtcggcctaaagatgcagaggcaggagagcagccagtgagatgagcttgtgtggcttcgttaccctcgtgaaattagtgcaaacgcacggtggctcacgcctgtaatccccgcactttgggaggctgaggcaggtggatcacgaggtcaggagttcgaggccagcctgaccaacatggtgaaatcctgtctctactaaaaatacaaaaatttgccaggtgtgatggtgtgtgcctgtaatcccagctacccaggagggtgaggcaggagaatcacttgaacctgggaggcagaggttgcagtgacccaagatcgagccactgcactccagcctgggcgacagagcgagactctccatctg

SEQ ID NO: 216005 - DNA, 665 bp, Homo sapiens
tccgccacctcgcggcccggcctgacctgttaatcacgtccccacggctctcctagcggggacaccgccgtctgcaggctccgtccccacagtgcccagaccccgggaagtctgtcagtcagcaccctgatgccagccgattctcaaaaagccaggagcatccaagcagatgatttgccagacggtactgcagcaatggagatgaacagataattcacacagaaagaaggacgcaggatgctcgagactcttgcagtaatttgggcaaagatttccacagtgcaaaatagaaaaaacgtaactggcaaatagctgtacaaattacagtccattttcatcatggaatgtcagtttggcaacaatggcatcgaggcccaaaagcagctctgcagtaggggggttcctccttggtgactggatgggcacagccaagcacaaattcctgaagatcccagctccaggaaacatcagcatggttcattgcattgtccacctgaattcttcacccctccctgtggctgtgtccattgccctgtagtgttgcagttcccctcaggaacaagatatcatttacttctctgacccttgatttggagcttggctatgtgacgtgctttggccaatgggatattggatgacacaacaaaggagagacacagatatgc

SEQ ID NO: 216006 - DNA, 793 bp, Homo sapiens
agaggcgtaagggaaggaggtcaccaaggggcaggccaggctttatgtgaatagtgctgttgtgagccaagtacttgagtacttcgaggtccccttctactgcagacatcttccctatggttcctgtgacccaggtttgtctcagagtggggttagcacacggtaccatctccatcccctttaaaagtatttattacatttttctggaaatggaagtctgggaattatatttccctgatagtcttatgagcaggattccaggttgattctgccaaatgtgaggcactcaggtgagactagaaagcagaaagatggtttaaaaaatcatcgttttcttcctttgactctgcacttatgacagcaggatgctcgagactcttgcagtaatttgggcaaagatttccacagtgcaaaatagaaaaaacgtaactggcaaatagctgtacaaattacagtccattttcatcatggaatgtcagtttggcaacaatggcatcgaggcccaaaagcagctctgcagtaggggggttcctccttggtgactggatgggcacagccaagcacaaattcctgaagatcccagctccaggaaacatcagcatggttcattgcattgtccacctgaattcttcacccctccctgtggctgtgtccattgccctgtagtgttgcagttcccctcaggaacaagatatcatttacttctctgacccttgatttggagcttggctatgtgacgtgctttggccaatgggatattggatgacacaacaaaggagagacacagatatgc

SEQ ID NO: 216007 - DNA, 737 bp, Homo sapiens
ggtaccacagaagtggaaggaggattagaaatgccagtcgatcaatctgtgagggctgtgggagataacagaaaaatggaggaaaaaaatcatagattatatagcatggtgttcgtggctgggatcaccaaatccctcttacccggggtaaaggactacatacaaggctgtgttaactttcattaaccttgaaagggaagaaatttaatttgaatttactgtgtggccggccctcttccaaaaagttcaagatgcacctaatgcaagaactaattcttgttctttttgtcacttccagataccaaggctcaaactgtttagcaggaatcactatccttcacctgtacaaagcattctgccacaccaggttataggacagattgccaccttctgtctcccccctcctcccacagactacctactaacagttcattcttcactcacttttctgtctctgaaacatccctttctttagttttctctaaccattattagcacctaatcccacccagattaaggcacctagagtgcccccaagacacaaaggtttcaagtcagtgaaagaaggtctgaccctccccacagatggctcacctttttcaggcaaatatgctcccaatggtggaagctaagatgatcgcaaggataatacagcagatcatgatcatgatcttcttctgctcatccagacaaggaaagaaagaatacatgagaaacatcatcgcaaaaagtattct

SEQ ID NO: 216008 - DNA, 741 bp, Homo sapiens
cacacacactctcacacacataaaaacacagactcacacacacacggacaaacacaaacacatacacagactcacacagacacgcaaactcacacacagacagacacacacacagacacacagactcacacacacaaactcacacagacacacaaatacacagactcagactcaaacacaaactcacacaaacacatttacacaaactcacaaactcacacacacaaacacacacacaaacacgcaaacttacacacacatgagcagacacacacccggcccttctgggctcttcttttcttactccataggaagccatgcaaagtctcgccagacctttcttccaaggccagatctggccaaccccacaggaaccctgcaatcacaatccctcgggccccactttgcagccagatgccaccggttcccatgccccatgcctcgccacccctctacctcctctgcccaggaagccttgaacacttcccacctggcagaatccttatcatcatccatggctcaagcgtaatgtcatttctatgaaggtttccctggacaagaaactgccagagagcccttagctcaggtgttcccggaagcactgttcttgctcagcagatctgggcagcttcttcttgaaagcagatctgggccctactcaacattttttaaaatatatttctggtactgctcaataaatattagttatcagaacgagtactgttagatgctgcccagata

SEQ ID NO: 216009 - DNA, 754 bp, Homo sapiens
ggactccatggggtgaagagcagagtggagaggagggttttagccgagagctctagctggcaggaagcacatctggtggccctgttaaaactggaactctcagcagaaaagttttggtctgtggtcagcctgtgaggcacacacgtgcgtacacatacacacacacaaatacacagactcagactcaaacacaaactcacacaaacacatttacacaaactcacaaactcacacacacaaacacacacacaaacacgcaaacttacacacacatgagcagacacacacccggcccttctgggctcttcttttcttactccataggaagccatgcaaagtctcgccagacctttcttccaaggccagatctggccaaccccacaggaaccctgcaatcacaatccctcgggccccactttgcagccagatgccaccggttcccatgccccatgcctcgccacccctctacctcctctgcccaggaagccttgaacacttcccacctggcagaatccttatcatcatccatggctcaagcgtaatgtcatttctatgaaggtttccctggacaagaaactgccagagagcccttagctcaggtgttcccggaagcactgttcttgctcagcagatctgggcagcttcttcttgaaagcagatctgggccctactcaacattttttaaaatatatttctggtactgctcaataaatattagttatcagaacgagtactgttagatgctgcccagata

SEQ ID NO: 216010 - DNA, 367 bp, Homo sapiens
aaaatctttagatttctgcagtccatacaaatgataaacaatcaagagaaggagctattgcttaagtcaaaaatggaaattaatgaatagtctttccatgcagttgtacacagtggatttggtttgtatccgcttacaaattttagaggacaatggccgcaacacatcatggtgttttgatgttactctgattttgtttcttccattattgagtttttgctttatttgtaaaaactggcaccagtagaaatgctaatttttaaaatgcttagccatttataaaactataacaaaatttaaaatattaatacatttgtaacattggtgtctgaatcaacttaacctctaataaagaactgtctatata

SEQ ID NO: 216011 - DNA, 377 bp, Homo sapiens
gtaccccaggaggctgacttctatacgttatgtggactggtctcccatgtccattggcatctggttgggtttaccccagtgggaggtattagcaggagagagtggtcaagatatttgcattttaggatcctttctttcctctactgaagtttacagctcctgttgggtctacccagaatatggtcaagaagaggtatttagactgtaaagggtcatgtcgcctttggcctgtgattagttacaggtgtcctgagattagggtaatttcatcttctcccgtccctttgggcctaggagtggtgaaatcttctggctgttattagccccaggtgcttcaccttcccttgtagttttccctaaattttgcacatacactt

SEQ ID NO: 216012 - DNA, 343 bp, Homo sapiens
ttagagagctgtaacagccgagaagacacgagcgggagcatagtatggtggacaagacaccagcagactcgaaacttgttttctgccctacatctctaacttgctgtgtgaccttgggcaaatcacttttccgctgatttttttctcctttcctaaaagagagtgggttgatctagataatttctgggactgagtgctaaaattctatatttttatgttaattgggtgctaattgtgtgctgcaagcaattagcaaataataaggtcaggattaatgttcccagttctctgctgggtgaggttagaacagtaaagctgcagagaagagggggtggaagagatt

SEQ ID NO: 216013 - DNA, 430 bp, Homo sapiens
agactagttcttagttggcaaactggcagcctagaggctaaatgctgccatgataaatatgttgagtttggttcacataaggtggtggtggtttaattatgccaacattagaaaatttgagcagtttcacagaaaagtctggattcttgaaaagttttgaaaaataaaatgatctagaaatattgggcctgaaatttcaaatagtagcagtattttagagcagtgtaccagctgtttagagggcacatatcaaatttgcaccagaggccccaacatcccctgttgtcttccatacatactcaatttcatgtattcacattacttgcccagcccctgtgtaagatcgtctcagaataagatactgggatgaactaagaaacaaactcattcaactacccatgaaaggtcctttttagactctgcattgatg

SEQ ID NO: 216014 - DNA, 415 bp, Homo sapiens
cccccagtacttatggacagtgagtggccacatcttatgccctaatacgaattagttcttgaactacagagaacaaaggctccttggagatcaattgattccatgccttgggtgcctcgggatgaagcaaaatttggatagattatgagctggagtggctgccagaaaacaaggaaattgtagcaatgtgtagagttgtaccaaaaggacaaaggagatagcttaacaagacccccactagccaagatgcaacaatttgagcatccaaagggagaaactataactagttgggatgaattgagtctataagaaagccatgacattcaaagaggaaataatttaattacagtgtatgagatgataattatactacaaaaaagggtgaaagcaatttttcaattaactaaaattagta

SEQ ID NO: 216015 - DNA, 468 bp, Homo sapiens
aaggtttcattatatactagggtggcccatcagcagaaaaccaactctgacatatttcatagacaactcaaatagagttcttcatctatccaatatatatttattatgtgttgacattgtttcaggcactgtgtttactgtacactgggggtacaatggtgcctgtcctcctggagcttatgttctcatgtggaagacagacctgaaggaaactaacaaagggttaagatacagaatgccatggttctagttgagaaggattgatcatggagtagaatcagggttaggaagttgttacaatagctgcagttgagagataatgggaggccagtggagctaaagagccgagatatatttgtaaatagagttaataggattttctgatgatgtgggtctggggatcaggtaagagggacaatctactgctactggattactggtttaagtaactaggtagcctttattggg

SEQ ID NO: 216016 - DNA, 168 bp, Homo sapiens
agcacaggtctcaggtggcagccaatatttactagcagacatgtgattgagtgagccttcagatgatcctagcctcctgcctttaagcaaccccagtggaatccaagagaagcagagattagctattcctaaaaagccctacccaaattccatatttgacagcattgt

SEQ ID NO: 216017 - DNA, 348 bp, Homo sapiens
gtctcactctctcacctagactggagtgcagtgatgcagtcaggctcgctgcagcctcaacctcccaggttcaagtgatgctccctcctcagcctcctgagtagctgggaccatacgggtgtgtgtatgcaccaaatctggctattttttaaaatttttttgtagagatgaggtctcaccatgttgcccaggctggatttttttctttcctttttatttgtaaaagtacttaaggctatagtttcccttacctcactgtgttaaataaatcctgtatatacgtagtgttttttattactgttatttttaagtagttctataatttcattttgtgtattccctttaatt

SEQ ID NO: 216018 - DNA, 512 bp, Homo sapiens
agttaatccaacttcaagccctgacccctcccatcgcagaaatccaccctcccagggcttccgtcagccgatatccataggccccctctggggtacttcttcagtctcggtgatcaaggccagaaaatcaggtcagccaacccagcgtcaccaccataacttaggcagtttgagccactgggatcatggtgtcgcctgactggctgctccctgcaccaggcctggagtcaggaggggctggtgccagccatgcacgtgcccagaggcagctcctacgcctgtccaccttttccagcaagaacaaatttctcctggctgccctgggacaaagctaaaggcacctccagggcctggagagggtgctcagggagagccatagaccattccccaaactctctctgtctcagcccttgggtcgtctagaacctcacggaaggaggggccacagggcctggagcccatgacacctttagaggcccacaaaatgttttgatttttttaaaatcagtaag

SEQ ID NO: 216019 - DNA, 143 bp, Homo sapiens
gacatggccagggttgcagcagcatctgcccacgctgcagaggttcatgtaaggagtgaagggcagaggtgagcagggagaggctcagagagacaggccccaaccaagagttgcacccctggatccaatcgtacttcccaatc

SEQ ID NO: 216020 - DNA, 469 bp, Homo sapiens
ctcctagactctacacatactggatttaccactgttcagggaaaaagcaagatcatctcagcatgtggagcaagacctgtgatgccatcttcttggaccatctcattttttagtttacttttcaccatttttatagagaaaacctgagttggctagtggcagaatggttggagctgataactgcaaagagtacatgtgaaatgctaatatccatgcctctgaaacaggatcattacacagagggttggggaactccagttattagtatatgtaactcccattccttaataatgatatttttaataaactcttttttctgagagcaagtttccaaaaagtgtagtctactaaaaaatattctttcagaaacatgtggcttgctgaattacctatcaaatgctttgatacagttcatcctctacatgaggtctggtgtctgtgcatatcattcggtttcagttcttcctca

SEQ ID NO: 216021 - DNA, 451 bp, Homo sapiens
agatattaagacagtgtttaagtgccctcccatatgtagttctgagttagacattaaacaaattaaggtaaaagtcaattccttaaaccaggtaatcaaagttaacatcaacagtgatgtcctgttgatagtatgtattggtgatacaatatgatgattgtagcactctgtgtggtcttcttcacaaagactcataaccctagtctactcatgagaaaaacatctgacaaatctcagtggaaggacattctaaaaaatacttgaccagtattcctcaaacttgtcaaggtcatcaaaaacaaggaaaattggaaaatctttcatggccaagagaagcttaaggagacatgatgattaaatgtatcctggatgggatcctggaacacgaaaaggacattaggtaaaaactaaggaaatctgaataaagtatggatgttagttaataataata

SEQ ID NO: 216022 - DNA, 521 bp, Homo sapiens
atgaataactgaatgacataatatgacaaaaatattttcttcttcttgggaaggcctggacatctttgaacatacattggctcacatatatcacttatcacatacattggctcattttttttcagggggtttttagcattagaaaggtactcaactgattcagtactgccagaaatattctaaacaaatagtagagcaagcttctgcaggtgcactcagttctccaggtacactcagtcctgcccttcatttctaaacgtggtctagaattaagagagatgataatctcagcattattctaaaccattcttcttatagctcagagtctgttgtaagcctcatttttattgaattctattaccaattagattagaaattataaaaaatcttacaagatatttatcattggctaaaaaaaaactaaccttaaaataaattgtatatttttaggttaaagtttgattatacctttccccgttgctttcaagtctaaaaagagttaggttaagaagttatctaca

SEQ ID NO: 216023 - DNA, 430 bp, Homo sapiens
gactctagaagcatctatattgacatgttgtattagttgaatctgaacaggtttaagggtgttttttaagggctcattttgcctatatgttctaatagaagactgttttagaaaatttaaggtgaattgaacatatttactcagagttagacatgaataatttgcttcccccctgccaaaaggatggctaggttcagacaaaaaattatcgaatattaggattcacatgctcagatgccacataaatcagcagtcactgttgctcctaaccctttattattattttatcaccttcagagcactcatcaccaaccacttcatatgttttggttacttgattgcactctgaagccccactaggaaactataagttcctgagagtagggactttgatctgttcactttcttgcaaagaatatatgcttagtac

SEQ ID NO: 216024 - DNA, 477 bp, Homo sapiens
gaaagagtacaaagacgatattatgaaaagctgacggaatttgtggcagatatgaccaaaatttttgataactgtcgttactacaatccaagtgactccccattttaccagtgtgcagaagttctcgaatcattctttgtacagaaattgaaaggcttcaaagctagcagattgtgatatctttagtctgaatttttaactggaatcagaactggatgttggggtcactctttgttttattgtacctcgtgattacctaattcaaaattgccccccaaaaagtcagattagttaatataattttttaatgttaaagatgtatcgtggtaaaaaatttactctagcagccatgttgaacaatgtatttaaaaattgtaaactcttggaatactgtatttatctgctatttcaatataaagtcctttgacttagtcctggtaactgtacagtaatttggtttactaatgaaagttgtga

SEQ ID NO: 216025 - DNA, 555 bp, Homo sapiens
ggctagaagcatttgcgaggcacccagtacctccattagtgtctggagaccacagtcaggctgggtaaggcaagctgaaagaggaatgacttccagaggagacgaacccaggagagtagctgggccaggcaaggggagggaggggcgtggggagccggaaccactcctggttcagagaggcagctcccagaaccctgggaagagagccctgcctggggagctgtgccagctcacagagaaggagccagaaatctggaccagcctctcccacccacgtccgggaagcctctgggctggtagccacagtgtttggaagcaggcttcctccggagtctccgcaggctggaggtggcgcgggtggcctggaagagcctgcagagcccggcggcaccgagtgcacagtggacggggaggacctggttccgccatagccacggagccccacctggacactcaccattggctgtgacgaagcagcttcagcagtgcccggcgggcatctgtgcactgtgggcatctgtggcactgggagggagcccggctgagggcggccgc

SEQ ID NO: 216026 - DNA, 540 bp, Homo sapiens
gtggccctgacgcgggcccggcccggccaggtgagcagctatatggccacggtgtcggggctcctcaagatcgtccaggccttcgtggcctgcatcatcttcggggcgctggtccatgacagccgctacgggcgctacgtggccacccagtggtgcgtggccgtctacagcctgtgcttcctggccacagtggccgtggtggccctgagtgtgatgggccacacagggggcctgggctgcccctttgaccggctggtggtggtgtacaccttcctggctgtgctcctgtacctcagcgccgccgtgatctggccagtcttctgtttcgatcccaagtacggtgagcccaaacggccccccaactgtgctcggggcagctgtccctgggacagccagctggtggtggccatcttcacctacgtcaacctgctcctgtacgtcgttgacctcgcctactcccagcttcagcagtgcccggcgggcatctgtgcactgtgggcatctgtggcactgggagggagcccggctgagggcggccgc

SEQ ID NO: 216027 - DNA, 299 bp, Homo sapiens
gctaacccatacatactatgtactacagttttatcagaaaaaaatgatcaggagatcaaactgataaaaagttatccttcaacatttcccaaaggttttttcctctaagtaaaacaattattattatagtctgtcttatcttttcaactaccacccataataaaatgtcattttattatttcaacatagttcatcaattgatcatctttacctgcggtagtatactctgtacattatattaattcatcataattgagaaattgtaagtgcccgcctatcgaagtagttctttagaccat

SEQ ID NO: 216028 - DNA, 284 bp, Homo sapiens
ctccagaggattacgcactgtgtcgtggtgttggggcaggaggaaaagattcaggagcaaaaagtgaaagttgttgctcaggggagataaagactgtgatgtgtgggaggatttggtcatcaggtcattaatgagggacagaaaccaaatatcagaataaagtctctgaagtattaaaatgggttatgggttaacctataggagctcttcatagacttcttgtcctgatattcataaagccccaaaccaaaacagttggcagaaatggtttcttgacaaatctg

SEQ ID NO: 216029 - DNA, 138 bp, Homo sapiens
cagctaccaatgatttcccccttttcccatcataatcaaaaccctgtgtggtggaaagggatgactgatgagtgagtagctgaagatagctcctggttaatacaaaggcaatccgattggactaattaacactaatat

SEQ ID NO: 216030 - DNA, 151 bp, Homo sapiens
ggagcctgaagctcctatccctgatttgagacggccacctagtgacgtctctagccctggtctgctgatgcccagggggtcttcgtgttaggaagggaggattcttccagaagcacagttctctgccttcaggaaaaaggggctgagaagg

SEQ ID NO: 216031 - DNA, 407 bp, Homo sapiens
tgcaaagactggaacaagtctcagcttcttcaaatgtgcaggtgccaacacatgactacagggatcaagaacagtcagggaaacgtgacaccagtcaaaggaacacaataaggcacctgaaccaaccataaagaaatggagatatatgaactgcctgacaaagaattcaaagtaattgtttaaggaagctcaatgaatttcaagaaaatgcagataaacaattcaacaaaatcaggaaaacagcaatcaaaatgagaaattttgagattgaaattattttttaacaaattctgaagctgaaaatgcaataaatggaatgaaaaatgcaaaagagcattaaaagcagaattgagcaagcagacaaaagaatctgaactcaaaagacaggttatttggctagactaagg

SEQ ID NO: 216032 - DNA, 290 bp, Homo sapiens
ttcattccacagtgagtgaggcattgcatttagaaatcatgcccttctatcttctgttcacattaatttatttaacacaattattctttgtgcctgtttcagcagttgacttttaaagatgaaaacttttcaggaatttagaagaggaccatagactgttttaatggttcagttatttgtttgcagtgccctaatgcacactaggtcagtttcccaaatatcgtgctatacacttggtccctatattagtttgctagggctgggtggcttaaacaatagacatttatttt

SEQ ID NO: 216033 - DNA, 358 bp, Homo sapiens
caggtgtcattgttctgttgcagcatatggtgttcctgacagatcccttgtctttctggttcttggttttctcatatgcagaatcttgttatgaacaagttgtgttgaaagttcacattctttaagtatgtatgttggtcatctctgttgaaaatgatagaaaaatcaccttcggtagaaaatttacaaacaggccgggtgcagtgtctcatgcttgtaatcccagcacttcaggaggtggaggcggttggatttttgagcccaagactttgagaccagccttggcaacacagtgaaaccccatctctaccaaaaatacaaaaattagccaatctcacagcccagtctcaaaataaat

SEQ ID NO: 216034 - DNA, 314 bp, Homo sapiens
ccattagtcaactgtgcacctggtacaggcctgtatccagactgttttctaatttgcacaaaggtgcttgtgtgacaccagtgggccctgtgtatcccctgtgcttgttatagagttggcacacagtattacaataggtgctcattaaatgttgagtaaagatggacggatgttctaggcaaaggtaccaggggtagagatggggggaaatctggcctaatagggtggtattggatactcagtattgacttagggtggttgcagctagtttgtagagggtccgttatgttgggctgagggactaactctttaat

SEQ ID NO: 216035 - DNA, 557 bp, Homo sapiens
atcagcaagatgaagccctctcctgctcccaggcacccctctaccaacagcctcctgtgagagcagattagtctctatccagaaattaagggagagattgctcataaagatgacaagctgctgccatttctaaaagatgtgtatgttgattccaaagatcttgtgtcttccgcgcaggtaaaagctgctgaaacacatcaagagccaaaggaattcagattgctgaaaggtcatcactttgatatgataaatattaagagcattcccaaaggcaaaatttccattgtagaagcactgacacttcttaacaatcataaactttatccagaaacatggactgctgagaaaatagcgcaagaataccaattagaacagaaagatgtgaattcccttcttaaatattttgttacttttgaagtcaaaatcttccctcctgaagacaagaaagcaatacaatcaaaatgaagaaaatcacaaaaatttcctatgtgtactcctcatccctcatcctgactattttctcatttttggcatattaaattatgttaattaccaaa

SEQ ID NO: 216036 - DNA, 439 bp, Homo sapiens
  misc_feature (133)..(133): n is a, c, g, or t
acctctgcaaacgaggagctggtgtctttctttgctccgtcccgtcacttttcacgctatcctccacgtggctgctgtacctagatggctcccacaggagtcagtgaggcctgggtggggggtggggcggcanccccttcgtgggggggccagtgcctggtgcgcccgcactggcctcacgtggctcccctgctcactcggcctacctggcctgtcacctctgcctctggcccatcctcctctgtggaccctcagttgcctccgttcctcaccctcctactttcacaacaccgtttccccatagggcaccttcaagagaaatctgtggtcaaattccccaccttgccccgcacccacccgtctgggatccttgtctactcgctggccccaccaaatcagccagcagaaactcaaccaccaaactctgccagcagaaacc

SEQ ID NO: 216037 - DNA, 448 bp, Homo sapiens
aaaaaaaaatcacccaagactaagcctcaacctcccccttaccacttgcaaatacagtctgcagaaaagcagcctcgggtccccactcgggggtccctcgcggggtgcgtcatatgggctctcccctctgcgacccgctatttccctgctagacccccagcgcccagcggattccaaggctgcgctcccgccggctggtcccgggaggtagaaagtaggcagaggggcgtggcgtccctgtcgcccccacatgccagccctcctccaacgcctgacaccaccacaagccacggctgggaacactgggggcctcccaacccggcgcggggcgcacggccgcaggctggcgaggaggcaagcgagctcaaggggagacctttccttccacccccagccctagccccagccacagccgtgggggcggcttcccgcaacctcgggcggccgc

SEQ ID NO: 216038 - DNA, 426 bp, Homo sapiens
tagatatctatggctgttcattgctgtgcactcaccgcccactcccagcactgcgcctcactgcttactttccagcacagattagttaagagcacacgctcagcaggctcactgtccattggtacctttcacccttcacaccttctagaaggagttgcctctcaacaggctttggaatcagtcagtctctccctcttaatttttcagttgacaaagtatacttcatcaatgtgtagttgtttcaacttacatacaaattcaatcagtaactgataatattaaagggaactttcttatagaaaaataaaggtgatttattctcattataaaaaaagtacattcttggtatagacaaatctgagaaaaaagacacagagagcaaagaaagaacagttgcccatagtgttatcatctgcacaccaccat

SEQ ID NO: 216039 - DNA, 407 bp, Homo sapiens
tgtgcttttactgttttgcctatgctgccagaaagttaaaaacattttgtttcaaataactgtgtatgtttaaaagtcaaacctattatttgctatattatttgtcatgtgctataatttgacagaggggcaatatttctccaaaaagtaaaattttataaccaaaggccatcaattgtacaaacgactaagagaattaaattttattaagttggaaatgtaatttattcattgtaactgttttaagagaaattaagtgagcactttgtatgtagttatcttaaatgttacgtgtattcttttagaaactctttcttgttttccttcttttcaccttcagtgtcctggcacgcgactagcacaaatcaaaccttatctgtcataataaactatagcgttggaaattc

SEQ ID NO: 216040 - DNA, 400 bp, Homo sapiens
taaggaagagctgaggggagcaaataaagtgaagggagataagcatttttaagatgcataaatttcagggcatgttggtgcttgtgaaaaatagaagggaagaattaaagacagtaaatatccctgatgctaatttgggctaatctgtagattgtgatgccttttgttaaaataaggaatctcagaagagtagagtttaaggagaaggtgagctcaattttgaacaggttaaggtggatgtgagtcatccaaatatgaaagtcttctaggcagctgtgacacataggccagaagctccagggagacagtggctgtaaatatgtattggtgtggggggaattacttaccgatggtaattgaagctgaagacattggagacaccgattaaggagaaaaccag

SEQ ID NO: 216041 - DNA, 365 bp, Homo sapiens
ccccaaaatctagccagggaaaggaagaacttaaggctgggaacagtttccccatttctcccccctttccttctgaaatgctcatggctgaggaaggatggggaaggaaggaactttcaccttgggtctttctcacccatgagagaatcaggacaaagaggaggagagccaggtagctccagagtgggccaggagggagagcaagggaatcaggacaaagaggaggacagacaggtagctccagagcaggcagggagggagagtgagagctttaagggggctcttccgcagtggccccggcactcagttcctccatgcgtctgctctctggctgggctagacccaagtcaggcaaatttcaaccc

SEQ ID NO: 216042 - DNA, 165 bp, Homo sapiens
atctttttatttctgtgtgatttaaaatgccatattaacgtatgttaaatatatttactcggttgctgtgtcttttccactaatatgtctctattcctactcagtaccataatattttaattactataatgtatacactaagcgttttattcatgcctgaatcat

SEQ ID NO: 216043 - DNA, 482 bp, Homo sapiens
gaatgctgttatgggagttgtgggttcatttttaggtgtctgaagaagtttcaggacttttgaaatgatagtggagcccattgaactcagaattatccctttctggtctagtaggagtatagtggcatacggaaaatgaagcaaacatcaaagacagatgtactggcacaagattaaaagtatgtctcagctgacatagttgccattttaagactgcttagtttagctgaatatgcctggattttttttttttttagcattttttttctttttagcattggcataccatatgaaatgtgggcagttgccagtactctacagagtaccaaggcagaattggcaatgactaaatcaattcattcaaacaaaaattcatcatgtgcctactgtgcgcataatttgtggaatcaaagtctcttgtttccaggggctttacagtgtaataagtgctatagtaaatatatatacggagtggtaaccat

SEQ ID NO: 216044 - DNA, 167 bp, Homo sapiens
acttccactgggctcttttcaaatacttcctatctttttattgttattctctatttaacgacacattatcaaatagtcctttacttcttcaagcatagttttagttctttgatcttttttttttttttttttttttgagacagagtctcgcactgtcgcccaggctg

SEQ ID NO: 216045 - DNA, 242 bp, Homo sapiens
aaacaccaagtacaaaagaatatatgtaatatcttaccttttgcacaagaaaaagaattaagaacattaatgtgtttatttaaaaaataagaagaagaaaaggccaggaacaaatgatataagggtagggaaatgaggtggaaagaataggagaggcgctgggcgcagtggctcacacctataaccccagcactttgggaggccaaggaaggctcctgggttgagcccaagagttcaagact

SEQ ID NO: 216046 - DNA, 322 bp, Homo sapiens
ctgttggttttgtagctagccttgtaaaattttgtacctcttttgtgtgttttgtatttacataagtgctataagtgctactttgctctatcatttactttctttttcttttcttttcttttttttttttttttttttttgagacagtttgacagtttgactcttgtcacccaggctggagtgtaaaggcgcgatatcagctcactgcaacctctgtctcccaggttcaagtgattctcccgcttcagcctcccaagtagctgggattacaggcacacaccgccatgcctggctgatttttgtatttttagtaaagatgggg

SEQ ID NO: 216047 - DNA, 175 bp, Homo sapiens
ttgaggctattttcttcaattttcctcttatggttagccttttagatatatatatattttttcctctacaaatcttgcagagagggcatgaacagaaaaattcagcttaattagtttggctactgattaaggggaaaacatacttaattctagtagaaggttaaacttactattt

SEQ ID NO: 216048 - DNA, 403 bp, Homo sapiens
ggcctcactccatacggagctatgtgaccttatattatattgggactctagattattacataagactgggcgttctaaggacagtgggagaatgtatgagtcaggattctccaaagaaacagagccaacaggagtatgtatgtgtatatatagagagaaagagggaaggagagggagattttaaggaattggctcacatgattgtggaggctaacaagtccaaaatctgcagggcaggacagcaggctggagacccagggaagagttgacattgcagcttaaggctgaaagcagactgctggcagtgtctcctcttcctcagaggaaatcggtcttttttccattaaggccatcaattgactggctgaggcccacccacattgtgaaaggtaatctgctttac

SEQ ID NO: 216049 - DNA, 786 bp, Homo sapiens
cactcacaagggagtttaccaggcagacactgggtctctcacacttagtccacagagtcacagggacagcttttccttccgtgtcccatgtccccgctctctgtatgcagccttccttctttggggcatccctctatgatgacagaggaaagcatggcccttgctggcttgccagaagaggcctgatgtctcctgtctcctacctgcccttgatcccgttgccgtaactagggagatggggtactgtggttgtgactcagactgggtcatgtgcccaccaaaccatgcgatagagtcaaggagcaagaattccccagaagggagggagtcgtgtgcttctctgggcagatgaaacggtcggatctgtacccaactttaatctgctaactgtgctactttgggtgaacggcttggttctgcaagcttggttctgtctgctgcagacaaatagctgtaatgcttctgcctcacagagcagctaggatgaaaggggaacacatggaaagcttgggcagcccccgtgacaaagttgtcagtgtcctcggaagtggccagaaagagacaagcctccaagatttctcagaatgcttaccagggggacgcctcaatgcagccttctttcttcatattcgtacgggacttattctaattctcgctccagactctgatatcttgaggttacttaacttttttttgagacagagtctttctctgtcgccaggctggagtgcagtggcgtaatctcggctcactgcaacctcccaggttcaagtaattctcctgcct

SEQ ID NO: 216050 - DNA, 552 bp, Homo sapiens
catctgtgcttatgcatgagtagagtgttgactcatgatagtgggatccttattaaagagtggtggatggcttatggtgaaagtggctcctggaccatgtcattctcagattcatcacccttttagccacatagcctttggataaacccttgcatgggtaagttaaaaattacttgaattgccttttaaaatgagcatgcctgaaattgtatcttggtatatctaaatgtgaccttccaccagcgaatgcaactggttgaacccggtgtgagcagatacctgctgccagagctagttattgaaagttgggttattttgatttgtaaggtccaaggagggttatgtgtgcgtaagaggctaggacaatcatttgttcgttttccagtttggcactcactatattatttatgggacagggtgacgaaggatgagcatagtcctcgaagagccatagaagcaaggaaaccttagcttttgcagcttgacccacatgttagtctctgcatcctcacaggagtgattccagttttggaatataggaagatcagtgta

SEQ ID NO: 216051 - DNA, 436 bp, Homo sapiens
tcatcacttctctctctctgcactccacaaagacgcatgcattcagttcctctgaacacatgtgaattgttatcccagacttttctctcctaacctcaggacaagcatttcaaaaagtcttcttcagaacagtaatctccccagatactttgggggaaagggaaggaagaaagccaggttcatagtcaaataattttgggaaatacacttcttcacttggaaattcacagtgtacaataacatgttaaaggcttttgtttaattgtgcttagccaaatgtctctgcaacgtctttttcccgggagtctttgattttgccctttcacagtccctgtggccctagtggaacatactttgggaacgactgcttctgaccctttcagcctcccatctcatggacaccttcctcttccctactcaactggctccctcaccc

SEQ ID NO: 216052 - DNA, 591 bp, Homo sapiens
caactatttttatgattattactactgtttatttatgttaatggtatgcaagtctgtgtagcatcataaagagtccctgattgaatgctttcaatgtgaatttagagggtcaaatgaagggcagggggaaactaaaaccaaccaaccaacaaaaactctacaaggggtggagaaatggcatataatactgacctggacaggtagatggtgatagctcaacaagaggacttcaaaccagtggggtctcataaattccagacaaagaaaactctcccagccaggcgctgtggctcacacctgtaatcccagcaccagccgggcgctgtggctcatgcctgtaatcccagcactttgggaggttgaggtgggcggattacttgaggtcaggagttggagaccagcctggtcaacacggtgaaacccccgtctctactaaaaatacaaaaatacaaaaattagctgggcttggtggcaggcgcctgtaatcccagcttcttggggggccggggcaggagaatcgcttgaacccaggaggtggaggttgcagtgacctgagatcacgccattgcactccaacctgaaaaacaagag

SEQ ID NO: 216053 - DNA, 415 bp, Homo sapiens
cagaggttgcagtgagctgagatcactgcactgggcaacagaatgagactctgtctcaaacaaagaggcctaaacaagtatttgagaaggcagataatgttgaatttggtgcattattttgttactttgtagaagagataattattcttactgtaaaattgcatgacataatgttggtcacttactgcagtgataatctgagagaaaaggccgaaccagaaacgtatttttcttcctttgcttatttggagttaagaccatacccttcagtccacaaggtggcagcatttgtttactttgacagtatctcgactattaaacaatagacaaggtacggaattggtgacatacagtgaagttcactctcataagtagaagatggtcctaggttagcaatggcaaggaacaggaaaga

SEQ ID NO: 216054 - DNA, 384 bp, Homo sapiens
gatttgtttccatgctgtgacggttttgtttttttgcttattgtaatagcttttgctgttgtactcttttctggtctacactgcgtttatgagttgtaacagtcgtcacaaaggcctgcagctttcactttctgcctcagccagcgagactgcaaacccaccaaaaaaaaaacttaactgtcacacccaccctaagggtctgcagctgggtttttgaaatcagaccaagaacccaccaattcgggacacaccatgtgggcagctgaatcaagactttgtggaggagctccaaagtgggtagaaaagtacgttcacccttacagggagactggcaggcagcctttttccttctcggtagaaaaataaactcctgttccatagagt

SEQ ID NO: 216055 - DNA, 399 bp, Homo sapiens
gatttgtttccatgctgtgacggttttgtttttttgcttattgtaatagcttttgctgttgtactcttttctggtctacactgcgtttatgagttgtaacagtcgtcacaaaggcctgcagctttcactttctgcctcagccagcgagactgcaaacccaccaaaaaaaaaacttaactgtcacacccaccctaagggtctgcagctgggtttttgaaatcagaccaagaacccaccaattcagaacccaccaattcgggacacaccatgtgggcagctgaatcaagactttgtggaggagctccaaagtgggtagaaaagtacgttcacccttacagggagactggcaggcagcctttttccttctcggtagaaaaataaactcctgttccatagagt

SEQ ID NO: 216056 - DNA, 657 bp, Homo sapiens
cgcagtggcacacgcctctaatcccagcactttgggaggctgaagcaggagatcacttgaggccagagttcaagaccagcctggccaacatgctgaaaccccacctccactaaaaatacaaaaattagccgggcatggtggcgcatgcctgtaatcccagctactcgggaggcagagaaggaaaatcgcctgaattcgggtggcaggggttgcagtgagccaagatcatgccactgcacttcagactgggcaacagagtgatactctgtctcaaataaataaataaagccagaaaacaataaaatgaaaacttcatagtactgaaagggggaaaaaaacccagcctataattttatatccagaaaaaaaaaaaccttcaaaaaaaaaaaagcaaaataaagatgttttcaggcaaataaaaactgagacgggttgttgacagcagatctgcactataaaaattattaaaagttcactaagctgaaggaaaatctctcagataaaagtaccacttcaggaagaaatgagaaacactgttaaggaaaatatgtggttaaaatcaaaagaataatatttgtgacacataaaaactatataaaactcaataaataaagttttattggaaaacaaccatactcattcatttataacttatct

SEQ ID NO: 216057 - DNA, 910 bp, Homo sapiens
gttgtgctgtgcccaaagtgttgcttcttctatgacctgaatcaagtgttctgcattattccaatgtcagacctgccagagggcaaattaccaaatcaacagtctccttggatgataaatctcgagctcttcagcagaacagcaaaccagctgctattctctgagctgcctcatggaagggcccaactggcaagcaactgagacaagcaatcgtcagagaagaatggatgtaccccatccaaagtcctgcaatgaacttgaatgatcctgcaatctcagaattgaaagaatcctatcaaaaacaaagaacttatgagcacatactgtacagtagaacttgagatgactgcagctcttgtctgcaccttgaagatttgcaagagtccctgaactggaagaccgcactaagctatgctcagtttcctaacccactgtaactgtaagataataaatgttattcttttaagcttctaagttttagggcatttattacacagcaatagataaattatacacaggccataaaatgtcccttgtggatattaatatcttccatctctgaatgataccactcgttttgtaagttaatcattaattgtcttgcattgtttacttagtgttaattggtcatgttcaaatgatgttctacagggccctaaggaatatatgtgtatgaatatgtttgctttttgtatgcagtgtgagtgtgtgattggggtgaaagtttaaataaagaagttaggtagacagggctctgagtgcattttttctaccttagcaagaacagtttctcttttatctgctaaatgtattaggttggtgcaacagtaattgtgatttttgcattgttgaaatttgcagattgatatcggaatatgttcttaaataaatgtggttatgctatacatca

SEQ ID NO: 216058 - DNA, 363 bp, Homo sapiens
ctccagcctgggtgacagagtgagactccatctcaaaaaatgaaaaaaataatttgctttttcctagatgccatatcacacattaaatcatctaatgttaatatcaaaaaagacccaggagttttgcccaagtgttgctgtgaggccacatgtgtttcatatgcggtaatacagtctaggggttaaacacagtcttaggattgttaagatttggaccttggctctattcactaccagttgtgcaagtctagacaactaattaagtctttgacccttagtttttgaaatttgaaaataaaatgaaaaatctacctatttctttggatattgtgaggattcatgcatgataagtcctgagaccag

SEQ ID NO: 216059 - DNA, 261 bp, Homo sapiens
tctcattttgttatttgtaaaatgggctataatctctgtccaagcttccttcaatctccatttcatagtttacagagaaaggagacactgtggagcacagacttcccctgggaatacattgggcttaatgagcttgatagtctggtgggctcaataaatcaaataaagcaaaacatttctcatttttgaataaaagcatttatcacacagtgtttgttcactcatggtcacaagattgattggttcccagtatcatagcat

SEQ ID NO: 216060 - DNA, 471 bp, Homo sapiens
agagtcttctctgcccactagaccccgacacaaccaacgccaatcacaccccgagcatagctgccccactatatacatttaatggatatttaactccctttctactgtttttttgtgtgattataaacatccttgtatatatttaaatcattaatttgtgccatagcaactaaaccaagcttgtttccagactgtaaaggtttgcaaattccagcttcctaagtctttactgaaataattcagcatgatttttaaatttacttatagtgcctaccttatagcctgcattgtggtaaaaaccaaagcagctgaagaatgatccctgcttatgatgtaaaaatggaggcagaagacctaaatctaaggcaatatacaatttaatgtgacaaaattatgatatagagggtatgtaattgctgaaggaattccaaagaaaaaataaataaattctgacttagctaatgttggcat

SEQ ID NO: 216061 - DNA, 285 bp, Homo sapiens
tgtagctatgcatggccataagtccaagctttggtcaatggaatctaggtagaaaatcaagtcagaatttccaggatactccctgaagttgttacgcactttttatttctcctttttgttttctttctccatcctgttgcctggagtacagacatcacgatttcaggctgtaagattaaggccagtacaagggagggagcaagaaggcgggaagaacagggtctctgaggactttcaggagcagagctgccaaagagccttggactgcttaccttgggacttgac

SEQ ID NO: 216062 - DNA, 147 bp, Homo sapiens
tgccagggtcactactgtttacctctctctttctttttcctttttctgtcttactttgtttcctccctgacacttcaccctttgcttgtcttaggctgtttcttagttttcccttcatcttgacccccttctgtcgtcttctcgagc

SEQ ID NO: 216063 - DNA, 481 bp, Homo sapiens
gagtgggccgggcgcggtggctcacgcctgtaatcccagcaactttgggaggccaagacaggcagatcttgaggtcaggagatcgagactatcctggctaacacggtgaaaccccgtctctactaaaaatacaaaaaattagccaggcgtggtggcaggctactcaggctactcaggaggcagaggcaggagaatggcgtgaactcgggaggcggagcttgcagtgagacgagatcgcaccacggcattccagcctgggcaacagagcaagactctgtctcaaaaaaaaaaaaaaaaaaaaagattagagtgaagattaatgaaatagtgaataggaaaacaatagaaaaatcaatgaaaccaaaagttggttatttgaaaagattaacaaaattggcaaatctgtagctatatttactaagaaaaaaataggataaattactgaaatcataaacgaaagaagagacattgttcctgataa

SEQ ID NO: 216064 - DNA, 399 bp, Homo sapiens
aagaaggcagtggggtgtgtgggtggttgcagggaccagctagcgacttggcttgggcaaatatggcatgaattttgaaagccacatttccccaaggcctactcccttttcttgattcgagagtaaggctcgagtatcacctccttccctcctcttggcaggtgggttggctttgaggatttttttttttttttttttttttttgagacggagttttactcttgttgcccaggctggagtgcaatggcgtgatctcggctcaccgcaacctcctcctcccgggttcaagcgattctcctctgtcagcctccagagtagctgggattacaggcatgcgccaccacgccgggctaattttatatttttagtagagactgggcttctccacattggtcagtc

SEQ ID NO: 216065 - DNA, 405 bp, Homo sapiens
atgctaggcttggtctttcctaatgaaggagaggctgctgactagtggggctcaggtcagacttcctgtcaccagctgggcttgcacacgtagggaacactgacgaatggcttgggctttgtgccccatcagcactgggccctcatggcccagtcacaggaatatggctagcaaggcagcacgactgctttacaccagagttcagggaaaggcatcacatccctcaagccacccaagcaagaagtctggtggtcgtcctagcctcttgctctgcctcatacctcacagacgatttgtttaccacgtcataaagattttacttcttaaatacctctcaaatccatcccctttcctctcaatggctctggccactgacttaattcaggtcctcatcattgatcatca

SEQ ID NO: 216066 - DNA, 392 bp, Homo sapiens
gatgtaccatttccgatttgattgtgaaatgtccctcccttgggcttcatcttctttcactgtatcagtgccaacaatttaacctgccaactcaattaaggttcattcctatagaagtctgtcatgtttttacttgaaattcttgagttctccttgcttgtttggttaagggacatatacggctctgttttcaatgggatgttttagagccacctcaattagaaatctagatattctgatcttattccagtgatctaagtagagcagtacttagttaaatggcctggaaacttgttgaaattattttatttgcttactgaaagcattcatttatatgtgggttactatggctagattttcctggtaactgctctttattataataatgggaa

SEQ ID NO: 216067 - DNA, 167 bp, Homo sapiens
aatcccagctgcttggagactgaggcaggagaattgctgtaacccaggaggcggaggttgcagtgagctgagatctcgccacttcactgcatactccagcctgggcaacagagcgagactccaactcaaaaaaacagacaaacacacagaaaaccaaaaatctaata

SEQ ID NO: 216068 - DNA, 234 bp, Homo sapiens
ctgcttcctcctctgattttggactcagacatacctaaacttgaatcttgactctaatcttactgctggatcttctctgagcctcggtctcctcttctgtaaaggggcacaacacagcactcccacctcctttggtggttgtgggagcaatggttcccgcctgtaaaccacctcgcagaagcctgggcccaggcagcacagcccggctgctggagcgttactgcttgccttcct

SEQ ID NO: 216069 - DNA, 695 bp, Homo sapiens
tggtgcaacctcggctcactgcaacctccccctcctgggttcaagtgattctcttgtctcagccacccaagtagcttgggactacagatgtgcaccaccacacccagctaatttttgtatttttcacagatacagggtttcaccatgttggccaagctggtctcaaactcctgacctcaagttatccacccaccttggcctctcaaagggctgatattataggcgtgagccactgcacccgaccattaatcacttacttatatatctttatggcttaagtgcctactcctagacattatagtttaatttgcttatgttttttgatatgcatcttaaaattcttaatttacagttccccccaccatctttttttttccatataatttatctttgaacaatctgagctttttgacttagagagtttcccacagtttggattttattcatacagtcctgttgtctgtttccttcagatttgcagctggattcagaggcttaattaattactcagacttgatctctttggtaaattgtgcccttatagtgttgtgttctttcattgaggaggcataaatatctagttgtctctttttttgtgacatataagaaaagataaaaggataaattcttgattatttttcccctccatttatttaccagtttttaagaccatgaacatcttctgaaagtgaccc

SEQ ID NO: 216070 - DNA, 410 bp, Homo sapiens
gagcacttcatgatttgtttctctcgggtctttaagtcttatctcatatttccaatcatgttcttccaccccaaacataaagtactacccttggtaacttgaatcttctcagctttctcaagctgtaatgcttttgccttgccctgtcctctgtatctgaaatgatgcttctatacaacatctgtgtatcttttaatgtttaacttagcacattttctaaaaaaagcttccttggatttcaggcttgggcaggtatgcattatccacccgtgtaaggatgaagtactttcctctattcgttgttcttattgacagttattttttgctttttaaaaatcgtgttttagtttttttaaaacgtctttctcctactagattttaaattctttcgggacagaactgtaacttta

SEQ ID NO: 216071 - DNA, 499 bp, Homo sapiens
gcactcttagatatgtaggccaatttattcattatttgagttctttagtacacatagtacattcctctgagatatgaaatggcaatgatatgtactcgtcttattacaaagtgaagatgggatagattttagatatttcaaaaaatgagtgtactttatttctgtttgtacagtagtcccccccttatccatggtttcacttttcatggtttcaattgcccaacatacaatacaataagatattttgagagagagaccacattaacctttattacagcctattgctataattgttctattttgttattgttattgttaacttcttactatgcctagtttataaattaaactttatcaaaaagttatgcatgtatagcagaaaacagtatctatagggttctgtactatttgccgtttaggcgcccagtgggggtcttgaaatatatcccccacgggtaagggggaaccacatacttcaatacaaagttgaaaaagctct

SEQ ID NO: 216072 - DNA, 603 bp, Homo sapiens
aagtgggtttcatacaagggatgcagggatggtttaacatatgtgagtcaataaatatgatacattacataaatagaattaaaaacaaaaatcgtatgattatctcaacagatgcagaaaaagcacttggcaaaatccagcatccttttatgattaaaattctcagcacaatcggcatagaagggacatacctcaaggtaataaaagccatttataacaaacccacagccaacattatactgaaagtgaaaaagttgaaagaattcccccagagaactggaacaagacaacaatgcccactttcaccacctctattcaacattgtactggaagtcctagacagagcaatcagacaagagaaagaaataatgggcatacaaataggttaaaaggaaatcaaactattgttatttgccagtgatatgatcataaacctagaaaaccctaaagacatccaaaaagcttctagatctgataaataaattcagtagtttcaggatacaaaatcaatatatacaaatcagtagtactgccatacaccaatagcaactaagctgagaatcaaattaagaactcaacccatttccaaaagttgcaaataaa

SEQ ID NO: 216073 - DNA, 220 bp, Homo sapiens
tagccagggtcatactctgtcacccaggctgcagtgcagtggtgcaatcatgactcactgcagccttgacctcccaggctctagctattctcactccactgcctctgtaatcttttttcttttcttttctttttttctttctttctctttctttctctttctttcttctttctttcctttctttctttcttttctttcttttcccttctgtcgtcttctc

SEQ ID NO: 216074 - DNA, 456 bp, Homo sapiens
tgtgatatagaaagatggtctcattactttgggagtagttataaatctccctataatgcctgtatataatactcatatgtgatataaaatgatggtcccattactttaggggtacttggaaatctctgtataatgccgacatataattctcatgtgtgatgtagaaagatggtcccgttactttaggggtagttacagatctctgtagagctcctgtgtgtaatacccatatactatgcctctgttgattcagatagatcaattacttcatagaatgaatctgcgtgtctatttttaggtggatgagttgctatgttttaccattactattcttgctacattagttcagcttctacaggtaaccaaatgattttcattatcgtatatttataatgtctcatccagttattttctggaatgagagtacaaataaatgtatttctcaagctgaaaaca

SEQ ID NO: 216075 - DNA, 498 bp, Homo sapiens
catgtgattggatgatcaggtgtagaggagagaattccagcaagtgttaataaggcacctgtcagttgcagacactgatacaggcacgggggtacagcagtcagtaagataaccccttggaacttatattctaatggggataaatagacagtaaacacaaataagctctcatagggctgtgacaaagataaactcgagtaacatggcagaatgatttgtgcgagaggtactgcttttagccaggatcttcaaaacattccacgcagaaagaagaacaatgcaaaggcctgagagagataaattcaacatagaagaaaggggtagaagaaagtccagcatggctggagataatgaataaaatggggattggaagaagttggggtgagagagatggcaaaggccagttgcacgtggttaggatgtgggatttcatttaggttccagtgggcactgagttggagcagcgtgggcagcagtagaatgcacaaggtctatttg

SEQ ID NO: 216076 - DNA, 578 bp, Homo sapiens
ctcgaactcctgacctcaggtgatccacctgcctcggcctcccaaagtgctggaattacaggcgtgagccaccatgcccggccaatatattataaaacaagactcactgaacaatacttaccctggccacagttgatatacttttgatgttttaaaattctattttgctgtttcatttttaaaacgtgctggtcatgattagcttcatgacttcatgaacagtaaaacgacttgccatttaaaaagcactaagttggggaggcatcactctcaaagttctattatcagcagaagtggactgactaatataaggcaaagggaatgtattagaagaaggtcagaaactcatagactcactaggaaagctgcagaaccaggcttggaaatggacaaagtgccaggggctcgaaagagagaactacaggaagatgagggcagctggctgttacctctgccagtctgcacatcgtggaaatgggtaggtttctgtggtacaggtcaggcagcctggctcctggatttacaataggggaaacggaactcccagagggaagtggctgtgctgtcagggagggggc

SEQ ID NO: 216077 - DNA, 668 bp, Homo sapiens
ctcatttatggtgcctgaaaggtgctatttctggttcttgtagcagatgaactcatttcaggccattgataatattaatatgtcttgtttttcagcctgccattcatctcacatcttttgggaagtgagtaggctcaaatctcatatactcaagatgaaatggaataaaaaggaaaattattgattagaaagaaacatgaggttctaagataggttttcaaggtggattggaggatttctatcacttaaaatgaccaataatggagggccagccatttgactcaatattcttggccatcattagtcacctgtacttgtgtggtaatattcgggtctctatattgttgtcccctcctcccacaatccatggttttactttccatggtttgttacttgcagttaattgtggtccaaaaatattaaatggaaaatccacagataaataattcataagttttaaattgtgttctgttctgagtcatgtgatgaaatcctactctctttgcctaggatgtgaatcatccctttgtccagtatattcacactgtacaggtatgcatgcataggaaaaaatcatagtatatatagggttcagtataggctatgaactgaatatatatactagggttcatagtatatataggttcactatccatggagtcttggaa

SEQ ID NO: 216078 - DNA, 421 bp, Homo sapiens
cgccagggacattttaatatgcatattgttgctttcacatataatacagtaagggagtatcagaaaacctgaatctgcctgactaaaacataccctgttccacaaagctatatatatgagagtattgaaggtggtttaataccaaattcaaaaattcagcctcagtgtagcaaacttttaaattttccatgatataaagtaagttttaaccaacaatggaagtcacagcactaaagtacattactattatatgattctctgatggtaatagaaactgtgctgcaggacacgttttgattcaggaagaaatgtggagtaactccacagaggaattcatcctttctaagtttaaatctgaacggaacccatatgcccataccctgaagatgcatgtaagggaacaacatggcttggtctgttg

SEQ ID NO: 216079 - DNA, 489 bp, Homo sapiens
ggagtgttgacatttagggatgtggccttagaattctctctggaggagtggcaatgcctggacaccgcacagcagaatttatataggaatgtgatgttagagaactacagaaacctggtctttgtgggtattgctgcctctaagccagacctgatcacctgtctggagcaaggaaaagaaccttggaatgtgaagagacatgagatggtaactgaacccccaggtttacagtgacagccaagacagccctcttcatggcacataagagactgtgaaatctgactgctttttcattgtttttgaaaacacatagataatctgcataattttgagaaactctatgttaaactgtttttcaagttctgtttttacatcatgtcctaaatgtgtgagagcagtggtttctgttccattggttttttattgctaatttttctgcacattgcattctgtcttattatagtcttgaagtatagtttgaaattataa

SEQ ID NO: 216080 - DNA, 376 bp, Homo sapiens
acatttttccttccagcattatggtagactcgatgccctgaccaagcaccctttagcatgctcaagtaattattctcagtctagaattgtagagttccttaagttagctttcaagaatgagagtgaaatagatatttttagaagaatttgagaaaccaacagaatttggtatcagcaaaggccatgtgaagatggagcagaaatcagagggatgcagccccaagccaagaagccagaggaacaagaagctgcaagaggcaaggaaggatttggccctgggggcttccagagggagcacttccttgtcaagccctgattttggacttccagccttcagaactttgagagaataaatttctgttgttttaagccacta

SEQ ID NO: 216081 - DNA, 464 bp, Homo sapiens
tctttactcctctatcccacacatatatttgaacttttttttggtttttattactgacctggtccatttggaagttattcccagaagtttttcctcggtacaaggtttgtttctggtgggggtttggtattcgggtgttttaagggcccagagcttactacatcatgatccctttgtaatcatctgcaaattagatcctgtagaactttttaaaactttaagccctgttttcagattggcctgtgctttccagtgggttggcagtgttctcagggctgtcagaaacccagtcagttaccttgcatctgcttccttactaaccagtcttgtagttgtcagagctttgtttctgtccaattatatgcaatggttcatggttttgttgtagataatgtctctgggtctttggttttctcattcagtttgctgtttttgtaggggaggttgggagggaataaaacaaa

SEQ ID NO: 216082 - DNA, 277 bp, Homo sapiens
tcgagggatgtatgtggacaggacacctgtgctggcgctgaggttcacggcacaggatccagtggagaggacacagcactcaccatcaccttcccctttccagcaaatatgctcttgcccactgtgctagtggtgggctgtaccctacagggcttggtgcccctagggctaggcgtggagcattaacttcatatttgttaaatggatcagctattaagtaaatgaataaaaaggtataattcttttaaaagtccatgaataaattttactttaaagg

SEQ ID NO: 216083 - DNA, 404 bp, Homo sapiens
atcatagctctctgcagcctcaaacaactaggctcaagagattttctcaccttagcctctggagtagctgggactacagatacataccatcatgcctaactgattagatagttttaaaagttacctttctaggccaggcacagtggctcacgcctgtaattccagcactttgaaaggctgaggtgggaggatcgcttgagcccaggaatttgtgactaacctgagcaacatggtaaaaccatgtctctacaaaaaatcaaaaataattagctgggtgctgtggcgtgacctgtagtcccagctgctcaggagactgaggtgggagaattgcttgtgcctggaaggttgaggctgcagtgagccatggttgtccatcctggccaacggagcaagaccctgtctca

SEQ ID NO: 216084 - DNA, 467 bp, Homo sapiens
atagatgggaatctattaggagttgtcatgagggagccttctggggtgccagaaatggtttattggtgtgggtggtggttacatggataggtacatatgtacaaatttgttgtgccacacgtgtaagattagcacactttcttatatatatgtatacatcagttaaaacttcctctgagcagaagatactttttaggtccctttgagatctgacttcccaactgacacaaataaatatctggctgcctccccttggattcctcggttagagactgaggcacagctctcatctggagctcttagagactccacttagagtttgtactgcagagagaaagtaaccctgaaaagtggggtgattttctagtagctgattgagcagggcagatgtcattttatagcaagaccctccccagtcccaaaatctatccctctcctcccatatctatgggaaatgctctccctca

SEQ ID NO: 216085 - DNA, 320 bp, Homo sapiens
caagaaataaggctttttttggcataatttctactacattgttacactatcatcaagtacaatgttttctggcttaaatatgttggtttctttggcttcatagttatatatacacacatgtgtacgtacatatctgtgggtgtgtgtaaacatattgccatacaaaaaaaaagaatgtgagtcttggactcttccaacataaaataaataccttatatttttgcacccagactaaaatttaaacacaaaatcagaacgccaaatgaaatgcattttcctttggtccaaatgaacaaagacaattctgcttctttctcaaa

SEQ ID NO: 216086 - DNA, 497 bp, Homo sapiens
ccataagagaacttggcacatccagggaactgtgagtagtttgctactcaccgagaagtaaaatgaaatgcataagcaatcatgggcaaatatacagttaagatgtaaaccttaagcagaaagaaattattaatattgatttaattattattgagttatcatttacctgttgcaaaatgcagattttaggggttacagtatgattatatttggctattgaatttgcttacataacccatatcccaacaagatacagtcaattctaccctaatatgaaatatgcattcctaaaaatcgccattgccacataaaatcatgcaataaaagtcacatcataaggtttagcacaaaaatgagactgggcaaaacattcaaacacttcatcagtgacacataaaaatatgtaggagcctaataaaaacactagtgcagttttacacatgttatgcgattaggaagttcataaatgctacaataaatatggcactttaccttga

SEQ ID NO: 216087 - DNA, 393 bp, Homo sapiens
gaaataaagtccgatagaaatactacaaagatgtacctgatgagaacaagtgacttgtctcccccacctgaaagtggaatggctggctcaagcatagttctgccatctcacagtcagagtcccaaacattctcatgaactccaggggcatttcatgttccaaagacttctgtttgctcgcccttctttggagagtatatatggatgttccccaagtgcttgttctcctaagtgatttccaggacctaacacactctccatttacaatgccaagttattctctcctaattgctgtattcctcccctcccatttgaaaaccctgaaggtagatgtgacccgcacttagggttagctgagctttcaaataaaactcaatccaaagatccaaaacca

SEQ ID NO: 216088 - DNA, 531 bp, Homo sapiens
cagaaagcattaataacagccaagaacagccttcaaagaacatacaagcagcattcgaaccatgaaaacagactgcagttttactccaaagttcagtagttaattaaagaccagcagaaaaagaagacaatttttgttattggcaggaggaagaaattttcctttaagcatatattttacattaagggaaatgtatttatgtgtgtgtcttcatggagtgtcaattaacagatgggtggcctttcaagaggtgccagaaggtccccctaatggctatgagggttgtagagggcaagaatcaccagcagcaatgtcttatgctggaagactgtggtttgaagatacataggtctgtatagggaaagtgcatatctaagattatatctagataattttagattggggaatcatatgacgtcacaagacaactttttattaaaataagaataatatgtttctgccagtttatttcagcttttaaagaaactgatatttttaaaattaagtaacattgtgtcaattcatagaaaa

SEQ ID NO: 216089 - DNA, 498 bp, Homo sapiens
cctaattaaaacaattgtccttaactcttcctgcattaaggacttctttgagaatcagataaaaactatggattcctccttctagaaaaattcatacatgtaatatttttcatataattccaggaagcttatggtctggtccatctaaagtctccacatgtacccctaaacataagaacccctgattaaagactctggcatggctcctggtataaaatgggtgcttaaaaataattgctgggacaccatccaccatctgattattgcccagttctggactcagccatgttgcaagctataaccgtttttgccccctggactagggacaccctgctgttcttcccccactgagtctgggtgctagggagataaagttaaaaaaaaaaaaaaattttttttggctttctcaaaaaaaagagcaattattagagcacttatgctctaattatgctctttctcacctagagaaagctgtcattctaaggaaaaaagggaaag

SEQ ID NO: 216090 - DNA, 420 bp, Homo sapiens
tgttcccagatcgccaattcctggtgataaaaccagaaggtttggggctgcattagccttaaatgcaccaagtagcagcctccatcgaggtgctctgcttacaccccttcacatggccctggtctggggtggtggcccaggtgggaggaggggtgagcagggagaggctctgctggggacctcttgttttctgctgggagcttccagtgacatcttttcatctgagttgagccgagacaaggccagtattttcagaaaggcaacctactaggaagggaagggaaaagcaaaacagagaagcaaaataggtgagctatagaccttgtttaccatcctttactcagctagctggtgtcaacaggtggggagcatttcctgagaattccagcccttccttcctcaacctagtctgtagaactc

SEQ ID NO: 216091 - DNA, 361 bp, Homo sapiens
cctcctgtttttccatagacttttaaatgtggatgaggttaggcgaaatctggcaaactgcaaagaggcagtatgctggcccaatagggaaatgtaataatggcaagccattcaggtccacaactattttttttctggaccacatagcttcccttactatttcccatcatttccagtctcagagattctgaaagcggacaccagttgcttctggaaacaaaggatgaagctgtggatcattagttccattttcatgctgcttgttacttgcctctcagaggtttcagcacctctgtggactggtgtaagtttgcagggcagccagggaaggcttgaggcagatccagtgtttgctgccatc

SEQ ID NO: 216092 - DNA, 278 bp, Homo sapiens
gtgtaagggaggaactctgggatttccaagcagagagaagtatgagaaactgacagtaggacaaggttagtaggagaaaagctctaacatgttgggcaggggacttgatacttgagtggtgaggaaccatcaaagactttcaaacacgactaacaggttggacgtgagtgactcagtgattcactgttttttgttgctctcaatctgtgcacaatttcagctctggtttaaaaatataaccttagaaagtgggattttgattttaaaaagtaaatata

SEQ ID NO: 216093 - DNA, 463 bp, Homo sapiens
ctgaggctgcgtcttgggtgcgcagctccggcccagcctcacccaggggaacgcctcgcaggtgctcacggacgatggagaggtccgcgcccagggtgggagtccgcgcttccgggtgtgtctgcagctcggggcgctggagggtgggatgtgaccccgagacggcggcggcctggcacgtgatgtatgtgtgtccttgtctgatgtgtcggtgtccccgatggaccgggttccagtcccagctttgccactccccggcttgtgtgccttggggcaggtgactaccccgcgctgtgcctcagttgcctcatctgtacaatgggcatgattaaaaaatacctgtctcagagggcggttgtgaggattgagaggtaattctgtacgtgtaaaacgctgcggacgatacctggcacagactaaatactcataagaataaatacattaaataaactatgatcatgta

SEQ ID NO: 216094 - DNA, 1080 bp, Homo sapiens
ctgtgccttatgcagagccgactcctggcagtttgcacaggctggaggtggagctgcaaactccctctccctctcggccttgcctctgtaaatgggaaagccgttgacattcacaaaagaggggcagggaactgctacacaagagcagctacacaagagggtcctttggtccacacaggaaacaagccatagtgatgacatattttgaagctgttagatgttttgtttccctagctggctattatttttgtatggcttgtctttctcttttgagtatgtgtgagaacaggatgggttaacattagggaagagcacagaagaggaaggaaggaaagaaggaagggagggagggaaaggagagagaatagggatgagaagctcagcttgtagaattggcaggtgatgtttgcagtcattaatcatttgagaagtagagagagaagccaagcaggaaatcttcagactggaaaagaagtgctcaccattaaaaaaaaaaaaaaaaaaaatccagtgtggttcacagctgtaatcccatcacttggaggctgaggcaggagaaatacgtgaagccaggagtttgagaccagcctgggcaatataacaagacccacatctctacaaagagaaaaaaaatgtaaaaaaaagaagctttaaacctaagacggcagaattcaagactgttgtccttgagaacttcctggctctggaaaaagctcagtgagttagtctcatcctgtcgttagctctgttttttaggggctcactttgtcttcacgacagtaccttgcaccattctcatgggtatcccagggtggtgcaaggcagttttctgcacttcccagaatgccctgtcagctggcttctgggtaggttctgcaaattggaggcccctgtgaaagatcgctgtggggtgggaggaagaagctttatctgcctgctggctgcagggtagaggactgcagtggggttatagggatcaccacctgcacatgtggagctttgagcggcttcactctaagtttctgctcaacagtggcagccctggagtccttcgggggcgagtgtgggctcctgggctcc

SEQ ID NO: 216095 - DNA, 299 bp, Homo sapiens
gaagattgagtgtttagttttgaaaatgttaaatttgatatttttattaaacatctatatggagatgttgagtagacaaaattgtgaagagagatctgaattgaaaatatgaatttgggagttatggacatacagatgatatttaaagccatgagactgaatgagactaccatgggaatgactgaagacagagacaagaagaataaccaagagctgagcctctaggtacatgaacgccaaaaacaaaatagaataaaacacacatacattaaaaatgctcaattttatgagtaacaata

SEQ ID NO: 216096 - DNA, 269 bp, Homo sapiens
tggcttgcaacgccattgtaactcactaatcccaattatcagtatgtagcttggatcaattccgtgaaccagggtttctgtcgaatctcaaacgttaagggtccaaagccatgctccctgtttcccctctaacctgctccttcaccaccgttccctatttgatgtaaacggtaccatttttactcagctgctcagactaaaagccgtgagtcagccttgccctgtcttgcttccacatctgttctgactacacctctccgttatgtata

SEQ ID NO: 216097 - DNA, 630 bp, Homo sapiens
taccggattttgacgcgtctcctaacggaagtaaaatggccgtgtgcgcatcgctggcatcgggaatgtataaagccacagtgcctgcttgtggcactcacacccagtcaagtcatcgtaatagagtgttagtggccttctatcatggggggaaagtctggcacaggaagaagcaggtcttgactgacaggggaattacctgggaagacagctaacgaaggggcaggggagggacagaggacccgagtgttcaaggaggagagcagccagaaaaccacccaggcacctcccgagcaggaaggcagcagggggagctgcggggactcgtgtgatttcaatagtagcgcttctgcggagagacacagcgaggaaaccttctctatggagaggaggccgtcgttcttctcaggccagacatccttgccctccagttcatagaagagaaaattgagggccgggcgcggtgtctcatgcctgtaatcccagcactttgggaggcaaaggtgggcggaccacctgaggtcaggagttcaagaccagcctggccaacatggtgaaacctcgtctctactaaaaacacaaaaattagccaagcgtgatggtgggttcctataatcccagctactcggg

SEQ ID NO: 216098 - DNA, 647 bp, Homo sapiens
ttgcacctcctccctcctcctcagccctgagatttatgacatggccgtgtgcgcatcgctggcatcgggaatgtataaagccacagtgcctgcttgtggcactcacacccagtcaagtcatcgtaatagagtgttagtggccttctatcatggggggaaagtctggcacaggaagaagcaggtcttgactgacaggggaattacctgggaagacagctaacgaaggggcaggggagggacagaggacccgagtgttcaaggaggagagcagccagaaaaccacccaggcacctcccgagcaggaaggcagcagggggagctgcggggactcgtgtgatttcaatagtagcgcttctgcggagagacacagcgaggaaaccttctctatggagaggaggccgtcgttcttctcaggccagacatccttgccctccagttcatagaagagaaaattgagggccgggcgcggtgtctcatgcctgtaatcccagcactttgggaggcaaaggtgggcggaccacctgaggtcaggagttcaagaccagcctggccaacatggtgaaacctcgtctctactaaaaacacaaaaattagccaagcgtgatggtgggttcctataatcccagctactcgggaggctgaagcag

SEQ ID NO: 216099 - DNA, 420 bp, Homo sapiens
accctgaggagctgggcaaactagcagaaaagatggcgctgggagaaaggaaagttagactctggacgggaaatctggaaagaagtggttcccagctgggccaaaaagcctcatcctacgccgtctcatcgacctgggctccaccctgagtgcctccagtgtgaggtgctggactggctctgtgctgcctgtttgggttgagggtttgctcctaggagaggcatgtatttctcgtacagctgtcacaagcgagtgagggctccggaggtggagggcccaagagggtggggagctcaggcgtcagtgatagccagatttccatccatcggtccgtccgtccgtccatccatccatccatctatccaatcaacaagccattccggattcttcaggaatccagtcattcatttatatttaggt

SEQ ID NO: 216100 - DNA, 466 bp, Homo sapiens
agacaggcaccaatttgaagcttaatgacagcagaaacagagaacaactactaactaagagtatttttaatacagtgctgaagagccagctgaactggctttgtagatcatcctcaggaaactgacggtcaggcctcctgtatgacaccagggagctgaggctttatggattggatcactgcacccaatgagacacacctgctgcctgtcgaaccaaccctcttcctagctcctccataattcctttttttcctgcacgtgattacagtgagatgctagatccctcattcagctacctgctgcctgttgaccagctcctcttcctctcccccggccctggttcttcttccaagctattaggtgaaagcaaaagtaattgcggtttttgcattgttgaaatttgccatttgatattgggatacatttttaaataaatgtggttatgttatacataattttaaaaaaa

SEQ ID NO: 216101 - DNA, 457 bp, Homo sapiens
caacagtttatagtgaccagaataggaatatttttctgtttccagagtacttaaaatgtttaaattaataattcttaatgttttgaggtgaaagaatttggagcagaggtcacaaatttgtgaccttctggctaaaactactcccagatgctttgattagacagtacagtattttttaaaggaattgggattaattactaacatttataattcaggagataacaccaagtaatccagattattatatttttaagatctgaactttagctggctttgggggcctgtatttccacataagtaaaaaccacctggccatattgtcaccacatttaggtggggtatactttttttacgacagccttcacgcctggcctctgtgtatgcatttgagtttattacccatggtctaggaagatgtaataaaccaagccagggaaaggtttggctatctctcttt

SEQ ID NO: 216102 - DNA, 374 bp, Homo sapiens
tggcggcggttagggggctgcgcgccggccgcggatggcgtcgcaggcgcgggcgggcgaggctttggggatctgtaggcaggtcttcgggggcttggcgaccagcgccccggttttttcttctccagtccttctctctggtctgtaatggggcgaggggaccccgggatggagcctcggcaccgctgttccggaccgaggctaacggacggcggcgcctctgctcctactagttttctcccggaccaaccgaaaagccgaggcggagcgcgggggtgtgaagatctcggcctgctgggggtccctggagctgagggtgagggtggggccgggtcggtgggacaggccgggtgggccggaggtggcgcggccgc

SEQ ID NO: 216103 - DNA, 323 bp, Homo sapiens
cagtatgtaggcccggtttcttagacatgatgtctgctgaaatggtgataaggtatcccacattatcggtgtttttttgaagacagcctttagggtttcagtgtcatcatctttatgccttttgctaaaacagtttatgttctgccttttagtaagcctttatgttaaaaacgtttcatattaaaaaaagttatcatttggaatacataggtcaactatctaggaatgggacaaagtacagaaacaatgagacaggatttgtgggatgagaaattaaaaaagcagtcccttcagctgaagaagctgcttagaaatttaagccg

SEQ ID NO: 216104 - DNA, 544 bp, Homo sapiens
ttttaaaaccagtttgtcaacttttatctaaaacacctgctgagaatattattagggttacattgaattcatgaattaatttcagagaaataaggatcttatatattgaaccttataatccatagacatgatatatatctttactaatttaggttttctttaatttacctcagtgattatttgtagtgttctatgtagatcattctctctcagtgaggttttacaagagaagtaatccataatgctcgaatgcatccttcatatgtaatgaattaacttattgcttatgcatctggaaatgtattagcttgttagacttctttggtagaatcaagagtagagtcacaggttggatgtggtgacttgtgcctgtaatcccagcaacttgggaggctggggtgggaggattgcttgagtccaggagttcaaagaccagcttggacaacatagtgagaccccatctgaaaaaaaacaaagaatagaatcattaaaataactttttgcttaattctctcatggattggggcaacatcttgcaatactg

SEQ ID NO: 216105 - DNA, 469 bp, Homo sapiens
ttaaaattttttatttttttgatacagcatctcgctctgttgcccaggctggatgagtggagatcacgccactgcactgcagcctgggcgacagtgtgagactcggtctcaaaaaaatatatatatatagatagatttaaagatatatatctttgtatgtgtagaaaatttttgcaaagaagttcaaatgcacaacataatagttaagtgccacctattttttccctctaagttgatgtctaatatagtggtgttgagatcacatatcatccaaaggctatttctcaagagtggtagagtaatcctaattccagaagagactttaataagaaaatcaattgttcaaaaattcaaaggcttctaataaagggtagcttattgtcctgtaagagtggtataatttgttaattagccaggtatgtacttatccagtgggaaatgattaaaagtaatttggaacagtttgtaa

SEQ ID NO: 216106 - DNA, 361 bp, Homo sapiens
tgtggtgtggtcgcctgtctttcagctcctacagtcggggcctgggccaccatcgctgctctcgcatggctgatgagccttatagagcctacatcacatctcttggacctggaaggggaaggaagaggaaaggcctggagactcaccaaaaggaaggaattcagcaatggcagaagtgagccccgaagtcccaaagtctctggattattctttccaccaagccatgttacgcccctaattcaacacttgtcatttctctttctctctttttttttttttttttaaagcgacggggtctcattatgttgctcaggcctcaagcgatcctcccacttcagcttcccgaatagctgggactaca

SEQ ID NO: 216107 - DNA, 654 bp, Homo sapiens
tgtggtgtggtcgcctgtctttcagctcctacagtcggggcctgggccaccatcgctgctctcgcatggctgatgagccttatagagcctacatcacatctcttggacctggaaggggaaggaagaggaaaggcctggagactcaccaaaaggaaggaattcagcaatggcagaagtgagccccgaagtcccaaagtctctggattattctttccaccaagccatgttacgcccctaattcaacacttgtcatttctctttctctctttttttttttttttttgggtaatttctgccacattaaatgtgggtgagagagtgatctactcataatgacttttcacgtgtaaaaaaagttccctacccatgaagccctgctactgattaaaacaaggtataatggtcataactttgtacccctatctttccaagcacttcgtgtacttcagctgttaataacgtgatccaccaacaccaaaagaggctatgctacagtctctagctaattggaagacacattcatccttctccctcgtacgtgcttgaccatcattaatggcttctcatacctaatttcaaaagttggaatgggaactttaaggcccttttgggagggcaaaggaattccagcttctcggggaaacttgttttaaa

SEQ ID NO: 216108 - DNA, 594 bp, Homo sapiens
gacttgtacatgaatgttcatatcaggtttatttgtaatagccaaaacagtatacacctgaatgcccaccaacaagtgactagataagcaaagtacggtacatggatatgatggactacctcagagcaataaaaaagaatggactattgatacatgctacaacatggatgattctcaaaggaatgacgttgagttcagaaagcaagacaaaaaagtacattctatatgattccattaatataaaggaatatattatattcaaggaatagtatataaatataaaggaatattttatattcaaggaatataaatgaatataaatgatataaagcagatcagtgattgccaggagatgaggtggagaagtagagaggggaggaaagaagggattactaaaggacatgaagaaacttttggggataatgtttatgttcactattttgattgggctgatggttttacatatgtatacatatatcaaaatgtatcaatctttatactataaatatgtgcagtttgttgtaagtcaattatacctcaatgaaactcattaaaattaccatattttggggatctatttctagaatctctatt

SEQ ID NO: 216109 - DNA, 537 bp, Homo sapiens
acatagctctaaacatcatattgtgccctacaaatatacacaactagtatttgtctattaaaataaattttaaaaaacacttgtacaaaaagaaagcaatgtaagtcttacccaaaagataacagctgagccactgtggtcagagcagtggagagaaagactaccatggccccacctacgtgtcttaaatgacttctgaataaagctcattggcagagaaataaaaaactttacatctaaaaataatctattgatattgcccacaggttctgctttttgaaaattacctgccgaaaaagtacgtatggcttgcctacttttgagtcttctgggcataattgaagactgcatctttaatatttacaactttcttgaagttatattgttttgttaaaggatctgttctttgagtgtgtgggatctggtcgtgagaaatggacaagagtgtcctgatgtggtacacggcttcctgctggcaggactcgtgtgccgatggaggtcgcaaacggaacaccctgcttggtttatcctttctcc

SEQ ID NO: 216110 - DNA, 215 bp, Homo sapiens
aggggcgtgtgagacactgtctggtctgcgaggtgtctggggctccgggcgtgtgtctggagtgttcgcggcgctgtgtctcgggctctgagtggatgtccgtgcgtctgtggagtgtgcgtggctgcgtggctctgtctgggtcttcggcgtctctcggggtgtctgggggtctgagtcgcggtcttgcccaagagtgcgtgtcaccgagtctt

SEQ ID NO: 216111 - DNA, 361 bp, Homo sapiens
gtgtatctttattattatgtttacaacttcccccaggtattaattacctttatttagtaaaaagagaggttcaaagagtttcatatattcagatgtcatacaaagtatcatacattagtaagtcaggtttcgtgtactgtcccagcagccattctggtctcaaaagcattgttcttctcactctgctgtgctgccttgtgtaaagggatatgagaggagataaaaagaaagtaaaaggaaaggccaggcactgagtcacatacctgtaatcccagcagtttgggaggccgagatggcagaccacttgaggtcaggagttcgagaccaacctggcgaatatggtgaaaccccgcctctacta

SEQ ID NO: 216112 - DNA, 448 bp, Homo sapiens
atgggcatggccatgtctgtcttgttcactgctgtatccccagcatttaaaacagtgcccggcacatagtaggctcaataaatattttatggccaatacataccttttatcttgaaatattcctgttgaaataggaagtgatggatcattcccatttcataaacagaaagggtgaggcacaaagaggggaagtaacttgtctaagtaaaagatagatctggtgttacaatcctggtcctgtgattttcagtccattgttcaaatctgtctgataaaattgcttttttaacattacaacaaggctgactcattgccaccactttcaggataacacattgtaaagcagaatcttgagaagtatctcctgacattgtctataaccttcaatcagttctagtgctgaaacaattttgctgtaaattgagaatcataaaaccacttaattcca

SEQ ID NO: 216113 - DNA, 587 bp, Homo sapiens
ggctctgccgatatgtatctttggggctacagtagttgaaaaatgaatctactaattaatcagttggataatactataaaagcaaggaatttaaggatctttagaagaaatgagacacttttccatacactctgagcatattgtgagcctttagtataatctcagggtgaaagtgacctggctattgtgtattgctgtagacgtaactgttgattaagtgttagagattgctgtactagaggcatgcatggtggtcctttaaaaacagaaaaggctgttaagctcagctagtaagacaatcgaacatatctgaacggcagagaatagctcatagagcttcctagcttccctgatgttgtttgcataaattgttgggggatgtttgtttgtttgtttgagacagagtctcactctgttgcctaggctggagtgcagtggcatgatctcagctcactgcaacctccgcctccagggttcaaattattctcctgccttagcctcctgagtagctcgaattataggcatgcgccaccatgcccagctaattttgtatttttagaagagacgaggtttcaccatgttggcta

SEQ ID NO: 216114 - DNA, 478 bp, Homo sapiens
gggatgaacaggcaagatgaaaaaaacaagataaaaaataggcaagataaaaagaaagcctggcaccacgaacttgctctggctttgcattcaactgtcacgtgacttgggatcccaaagatatttttttgtggattcttccagctacaaaagagaaatgtgtacatctcagctagcgtaccctaaaattccagtattctgtcacatgttctaatggatttattcctagttgtcaaactatgtgtcacaatttttggtctcagaaagtagtttatataagcccaaatgtctgcagagagtgaacttaagactgaatgttacagatgaaggaagaaaaggaaattaccatttacttgtgtatttggtattccttgtgtgccaggcactttgcgtatattcagtaagtgtgagaaggattatagcatataaaatgatctgattttaagtttgacttggtaatacttagttcatttaacgc

SEQ ID NO: 216115 - DNA, 433 bp, Homo sapiens
ttcaccaaatggttatttccttgggctgaattcagttttggaattaactccagcatttagctgttgatcttgttctctttatcctagtagataagtttttggcacgttctttctccttcccatcattatctctcctctttacccgtcactttctttctgttgtggtttgcatttattgatctctgcctttcctgatactactcaatttatgtttcacagaaataacggctgtacttaaatgaaactcagattcctatataaaaatgttgggataactttgttccttcagtaagggtcatacagacattatagatcttatcgggaagaaaaattatcacaatatttagacatgactgtcttattttaaaaatgttttcagtttactttcagattccatatatagttttaaaatacatgttttagctgaatagta

SEQ ID NO: 216116 - DNA, 131 bp, Homo sapiens
tgggcaggacctttctttttttcttttttggcttgacaaaggtcagaatatccccctaatccctcagaaaaaagagactgagaccctgatcccttcattctcccttttcctttccccttcttgcaaatttc

SEQ ID NO: 216117 - DNA, 571 bp, Homo sapiens
ttctaatgctttcccagatgatatgatgctgctggtccaaggactacatttcgagaaccccaaccacgcatggattgttgtcaactatgaatcacaagatttccagggttttgtctgctgccttccctgcaagccctgccatccactgagacccaacctcagccattcttggcacatcagcccatgagaagtctgccactctttcttcctaagcaaagcagcatccttcagggcctggagctcctggacacaaaagccatttttgggagaaaaatgtggataaagtcactcctgggccacctgtctgtgaggctgtatggaagctgcctactggtttgaggagaggctgctgggttctttcctttactaaggatttgcttaagtcagccctccaggatccaaaaaagagccagaaaaaagccagcaaaacagctgaggcacagactagatggtagtccaaggaccaagacctggccagccagagggaccaggtgtccagaccccggactgttttcaatacagttatacaatgaaatcaaataaatggatgtattgattgcttggcaattaa

SEQ ID NO: 216118 - DNA, 1080 bp, Homo sapiens
gtagaaaggaagaaacaaagaagaaaaagagaagacggaaaaaggagaagtgggagagaaatcaatggggaagaaggatagaggggaagagagttggtgagtccagagagcaagaaagttaagtagaaaagtcaacaagaaatgggcaaataagaattagaagcaaaggtttaaaaaaaaaaaaagggaagtgtaagaatatttgtcatggccatctccacagtaaccctgaaaatactggccattttcccccatgactttctcaaatgagaatcacagccatgaaggtttatgaacccatcgcccttggaattctggcagagtggaaaattaggaaaagctcttttaaaaaaatcaggtatccctgagtcatttgatatctaagttttttctaagaagcatatgttcaaaacaggcgacgttttgagagcgtttaatgagaattgtaaattccagtcagtagagtcattgcactacccttggttggaatctgacaaaactctgctctgtccacgccagtgctctcttctgagccaacaggagatttagatgggtgacaccctgcagaacagagcctggtccccgtgtgccccaactgagatttgccttctaaatggaaatcagtttgaatgtggcaaagtgttttcaaagctgtgaactacacgcaggacttagatacttaggtgcctgatgccagtgcccctgccccctgctgtcatcccagcaggaaagctggggagggcacagagagtaggttcattattactacaaaagcagtccctctatcaggggaaacacccatagctagacttagatagacagtcatcttttaagatgtttaaacaaatctgtgtagaagaggtgcttatcatcagataagtcagggttccaaagagtcatttggaaaacatttctgagtgacttctatatagattttttaaattaaatggcttacgggctaggcacggtggctcagacctgtaatcccagcactttgggaggccgaggaaggcagatcacttgaggtcaggagtttgagaccagcctggccaacacagtaaaacccccatctccactaaa

SEQ ID NO: 216119 - DNA, 465 bp, Homo sapiens
ctgttctattagtgcctacaggataagtgctacgtggccccaagatgtcattcatatatgacaatacaaaagctggttagataacatggcaacaataaaaagttgtggactattcagtgaagttatgggctattcaatacagtttaggatttttaaaaaatcattttaggcatgcaaaataactatcagattttattcatttgaaataataattttatgttatattgtgagtctcacagtgactttgtaaggcattatatcctcactttgtagatgaggttatgaaggcttagagaagttcagctgcatcctaaagacgccacagttaagtaagagagttaagtgacttggctgaaacctagatttgctgattgaaaggtcagagctcttttcctttataccacaaattgaagctgtcatttggggcatgaaactaataactgttttttgtgttttttttaattt

SEQ ID NO: 216120 - DNA, 438 bp, Homo sapiens
caaagaagaacaggtgtgtgcagagatcacatgatgagagaggaagaaagagagtggggaaggaggtgcctggctctttttttaaacaaatgttttccccaagaactaaacgagtgagaactcactcactcaagagagggggcattgatcttttcatgaaggatctgcccctataacacaaatacctcccattaggtcccacctccaacactggggataaatttcatcaggaaatttggtgaggggtaagcaaaccgtatccaaatgataccagggatatgtcaggattaagactggaggctgcaggtagatgttgtgaagacttggagaaagggaaactggattccagttcttcagtttcctaaaatgcaaaggtggtattataatagtcccatagtctctttctatgaacggggggagaaaaatctatttccccgt

SEQ ID NO: 216121 - DNA, 348 bp, Homo sapiens
gaggattaatcccactcttgacccacacagatggttttagtgactgtatcttttgtgcagctccatttcttctcaaaatgtgcagatgagatgtttcttccagcctctggatattgaggtgcctgggatacctgagtgagggaagaaaggagcaccaagaagtggcagctgaagccagattgcacaagagagaaaggaagaccatccaaggcagacagaaaaactcaagagagcagccgtctggggctatttatcacatgaacaaagtcagaagcctttcaatcttcctcctgtattacatcagggttcatttttaaaagatacgcaacttggtgatcacaagttatt

SEQ ID NO: 216122 - DNA, 313 bp, Homo sapiens
tagtttcgaagcatatggtgaagtgtgctataattttatatgcatatatattctttattctggacttccagaaagcaatgagtttcatctgtttttttccccacctctggttccttcttcctttcccttgctctctacaagtctgctgtggctttattaggaattccctttggtttagggggaaaaaaaataagagggagagagagagaggctggagggggaagaaacaaaactagctcttggctggccgcccacagcatgggcccaacagccttgtttgagcgcgttgccccgcccttctgtcgtcttctcg

SEQ ID NO: 216123 - DNA, 502 bp, Homo sapiens
  misc_feature (32)..(32): n is a, c, g, or t
atgggtactagaacatttagtgcatttcacanagtattgtctgaaaaagctcaaaatgaggaaattctgtatgttcttcgccattatattcagaaaccaagctcacggaaaatgtacttatctgggtatggtgtggagctagcaattaagagtacagaatacaaagcactggatgatacccaagttaaaactgtgactaatactactgtagaggatgagactgaaacaaatgaagttcaaggatttctctttgggaaactaaaagaaatatattcagatcttagagataatctgacagcattccaaaaatacctgattgagagtaacaaacaaatgatgcctttgaaagtctgggaactacaagatcttagttttcaagcagcttctcaaataatgtccgctccagtttatgatgccattaaattaatgaaagacatttcacagaacttccccataaaagccagatctctaaccagaattgctgtaaatcaacatatgagag

SEQ ID NO: 216124 - DNA, 450 bp, Homo sapiens
ctcccaccttccaccctcaagtaggttccagtgtctactgttcccctctttgtgtccatgtatactgaatgtttagtttccacttataagtgagaacatgtggtatttgtttttcttttccaacatagcaaaacttaagggaatcagctaaagcagtgcatagagtgaaacttatagctacaaatatctatatttaaaaaagagagagagaattgtcaaataaataacctaatgttccaccttaggaaaccaaaaaaagaagagtacactaaacctacagcaagcagaaggaaataaatagtaaatattagaatagaaagaaatggaatagagcagaaaaacaatagagaaaatcaatgaattgaaaagttggctctttgaaaacatcaacaaaattgactcacattcaggtaaatggatggtaggagaggagtagtgtgtgtttgtgtg

SEQ ID NO: 216125 - DNA, 471 bp, Homo sapiens
agctatgcccaaagtcacacaaagtagagaaatcaggaaaagaaaagtatattgacttcagaatatgcccccttaacctctacttttcgtcaaaacatttcatgaaattcttttctaaatccaccatcacatatgtagtgatgtttaaaatttatttaaaatcatgattattgccttgcctttattaatactgtattttattttttcctaaaagaataaagttgtgtattcaccttgagttaccaaactttaggtgctttaattttgtttggtttgatgttaaatagtggttgcttctaatatttttatgttcatttttgggaatgataaactgttttccaagtatatgccaatatggaaaatttgctttatcgtatatttgataattgtgtttacatgttgaatgcactattcttgaatgtttatgaattatattttcatcaataaacagaacacatctcaaaaccagta

SEQ ID NO: 216126 - DNA, 433 bp, Homo sapiens
ttatggtaatttttggataacagactgtaatagcaattcccttttcatcaagaaaaaaatagagcactctgcctattcagatgctatatccaccaacctaaatgaatacaagaaataaataaataaaaattttaaaagacagaactgagacagagaacagtaagtagggcaaattcatgaattcatttatgcctttggctaaaatacatccctcaaatcagtttgaagctgtttgcacggtagggtgtttcacctactaatgatttcacagctggcacgcgcatggcatcaatgtttattggcatcctcaatgtcagttatttttaaaaagctttcttccaggactctgaataaattatctatcaagtgcagcagtgcatggcaacatccaagacacaatttgcagtcctgcaccggcttcattatttggtgg

SEQ ID NO: 216127 - DNA, 636 bp, Homo sapiens
tcccgtcaataggcgcagtgcatatttagttgccctcctagggtaaactagatttaaagcctcaggaggctcggctgtttgcactgatgatgaacggacgcgaaggtggttgtgtgtatatgcttggtacacagtggtcactctctttgcttgttgagcgatgatgggtggtgcagccatatcccaccttaaaaggttttgccttgaaggtgcttgtggtggggtaggagaataggggcccatacagaaaaaacaagtgtatgtgtggacagatgtgagagagagccacaggcgggcgcatttcgtctaataagtgcgcagggcacgaggctatgttggggagaggctggaggaggtgaagtggagaattgtggagagattaatgagagccgaagggagtgaatacttcccgaatgccaactggatgccaaacattggtcctttaatccccctagtaatttggagatgggtagtttcccagttttgcagataaggagactgaagtgcagagaactggaataacttgcccaaggtcgcagctggcaggccgcacagctgggattcagacccaggactgcctaaggttggagccctgtgtcaagggcttagacacacctgcactggctcccaaggggg

SEQ ID NO: 216128 - DNA, 453 bp, Homo sapiens
cagtgagccgagagcgcgccactgcactccagcctggcgacagagcgagactctgtctcaaaaaaaaaaaaaaaaaaaaaaaaagaaaaaaaaaaaaaacgtgaaatcactgttgagcctgccagctcaaatcatgctaaattaatttggcgtagaaatatctcctaaacggctgagtgcagtgtctcatgtctgttatcccagcacattgggaggccaaggcaggcggatcacaggagcccaagagtttgacaagaccagcctggggaacatgacaaaccacgtctctacaaaatatacgaaagttagctgggtgtagtggtgcatacctgtagtcctagctactcaggaggctgaggtgggaggatcacttgagcctggtaagttgtggatgcagtgagccgtgattgtgccactgcactccagcctgggtgacagagtgagaccctatct

SEQ ID NO: 216129 - DNA, 470 bp, Homo sapiens
gctcacgcctgtaatcccagctctcagggaggctaagaggcgggaggatagcttgagcccaggagtttgagacctgcctgggcaatatagtgagaccccgttctccagaaaaaggaaaaaaaaaaaagccaaaaaaaaaaaaaaagaaaaaaagcgtaaggtaagggactcttcatatttttcttaaatcatatggagcaggctgggtgtggtggcttatgcctataatcagagcactttgggaggccagggtgggttgattacttgaggtcaggagttccagattagcccggccaacatggtgaaacctcatctctaaaattagctgggcgtggtggcgggcacctgtaatcccagctacccaggaagctgaggcaggagaatcgcttgaacctgggaggcagaggttgcagcgagacgagaccatgccatggcactccagcctgggtgacacagcaagtctctgtctc

SEQ ID NO: 216130 - DNA, 449 bp, Homo sapiens
atcctgatctttaaatccagatgctgacttggtaatttgaatttgacctcaatttctggttattctctttgctgctagtggggttcaactttaactgaaactggccctgtactctgtggtatactgatctccttaccctacaagccaagtattttatctagactaatccccccaaaaagctcattagaatgagatttttgccttgaaaagaatctcttatgaacaataaaatagcacaaagattgatttgttcaatattttatattagaatgagctgccaaggagcccagtgctgcctttggttttctcattttcattaatcttaaaagagatacatcttattaattaaatctgctcttctaaattggatggcattataaactggagagaaatgacccaaagaaggaaattgaaaatgggtggtggtgattaacaataaacacaagatt

SEQ ID NO: 216131 - DNA, 256 bp, Homo sapiens
gaccacaaccagcaatattatttaaaagtaaggtcacacttttaataataagtcacattttaagttattatcaatttataaaacacactgttggtataatgatagcttttcaagaaggatataaaaaggcatgttgggctgggtgcagtgactcacgcctataatcccagcactttgagaggctgaggtcggcggatcacttcaagccaggagtttgagaccagcctggccaacatggtgaaaccctgtctctgct

SEQ ID NO: 216132 - DNA, 865 bp, Homo sapiens
ttcaggtggattaagaaaccaaccgtagagaagttacatgttggagattcctttcccagttttatagcacagtgcccagaatgctatccatgcctgagtgtggcttggcttctcctacccactcaatgtggatgttttctcagttgcccagtgggtgtctctcgactggtccctgattttctctcaaagggaattgatctgtaaatagatgttgatttcatgtatctgtgagtggaggagagtctggaaattcctattccaccctgttgctgacatcattccttcctgtatatctaattgatcaccaagttcggtcagcagtacccctcttaaatctcttcctcatgtctccatctcctttggtgtaatttggagcattatcatatatatttccccaactctggttcttccccatcaccagtaagtcctccctcaccatggggacaccttgttaaagaggaaactcagtcacattccctggtctgtttaaatcccttgagcatccaccccttagccacttcaacagctttcctactgccatccctccttataacccccacttcagcctaaacataccttataactacactcatgcttctaactggattaccactttccctctacaactactcatatttaaagatgctgttcaaaagtcaggtcatctgtaatgttttattctgtaatacccaggcaattagttgctgcttcatccgtttttctctcatagtacattgcatatttccttatcatagtttatgcaattgtattgtatcatataactgtttattaatgtatatgtcttcttctaaggcagaattatctactgccacatagtagatgctaaataaatgtttgctcaatg

SEQ ID NO: 216133 - DNA, 170 bp, Homo sapiens
cctcggcctcccaaagtgctgggattacaggtgtgagccaccatgcccagctgcagagtgcatttttaagcaaacacatcatatgtcaattcttcatatagtgttctttaatttatcttgggaagccaaatatcccatttagaattctgtaagaactgatttttcaaatg

SEQ ID NO: 216134 - DNA, 170 bp, Homo sapiens
cttgttcccttattacctattatccacacagtaagatagtgaactttctaaaatgtaaatcacaccatgtcactcccctgcttaaaaccctacattggcttcccattataacaagaataaaatcttttcattggagcctattaaggtctagtcccagcactttgactgtg

SEQ ID NO: 216135 - DNA, 190 bp, Homo sapiens
gcatcgagcctgccagtccacataactgaaacctgaagctctgcccctgcccagctctgtgacttccagcaagttgtttagcttctttaagcattgattttctcacctggaagatgagggttgcattcacactctcttcatagctgtgacctaaggatgatatgaaacgacgcccttggcagatctatca

SEQ ID NO: 216136 - DNA, 507 bp, Homo sapiens
ttggccacctaaactggtaccctccactgaccaggccaacataaacatggctgggaaaagggcaatgtttttatggtccttagtccctggagaccctgtttcactgggaaagatactctcactatagtgaccacttgcctgagactcccaattctggaagcctctcacggaagaagctgtctaggaccacctcagtgaattgattcagctcccaaaacacccaggaagcccttccagattaatgagaacaggaaggcaaacacactcccaggacgctgatccttgtgaacaagaaataagcagtggccataacccctcccttttaattcaccaccttttaaacttcaatcatattttcctgagacaacattggaaactggcctttctgttggcattccttcttcagtgcatagatcagtcattttaggctcacttcaaacctatttgaatcccacgtcccctgctcaccatgctacctttctttttactgtcctccaatcttagtct

SEQ ID NO: 216137 - DNA, 517 bp, Homo sapiens
agtccatccaagaaaggctaaaaaatgttctgtgtgattctggacttaagaagtctttttcactgaattctggccctagatgctcactcaactagtaaccataatgccctgtttttcccaaatgctgaaatggaacatttactgcattggcaatgttttctagtgggattggttacagaaactgtcattcattcttactgtgcaatattacacagccataattaatgatgtagttaaaaacatttgatggcatataatatatatatacattgaatacattgtaagtaagaaaatatacaggttagaaaactgtaggtatagcatattgtaaaaagaaaatatatatacacgcatagcgaaaaatgtcaggaagaatataccaaaatgttaacgattatctttaagtagtatcatcttttttacttcttgtctttctgtttctcctaaaacttctaaaataaaaaggtattatttttcatgtaaaagtttaataaacttatgtgtccatttaaaaata

SEQ ID NO: 216138 - DNA, 253 bp, Homo sapiens
  misc_feature (224)..(225): n is a, c, g, or t
  misc_feature (231)..(231): n is a, c, g, or t
  misc_feature (234)..(234): n is a, c, g, or t
taaataaagacagggtttcaccctgttggccaggatggtcttgaactcctgacttcaggtcgtcctcctgccttggcctcccaaagtgctgggattacagacgtgagccaccgcacccagcctgtttagtgtttgatgcatagtattttttagatggctattgaatgcatgtaaatgcgtacataatcttttttaatctcgttcttccatctgcccttctgtannttctcncanccgtatagtagtagtaggc

SEQ ID NO: 216139 - DNA, 284 bp, Homo sapiens
taaataaagacagggtttcaccctgttggccaggatggtcttgaactcctgacttcaggtcgtcctcctgccttggcctcccaaagtgctgggattacagacgtgagccaccgcacccagcctgtttagtgtttgatgcatagtattttttagatggctattgaatgcatgtaaatgcgtacataatcttttttaatctcgttcttccatctgcccttctgttggtcctcctttcctctacataaattgaattataccaattcagcagcatattgttcttcttg

SEQ ID NO: 216140 - DNA, 427 bp, Homo sapiens
acacacaccaaaacaaacaaaaaagccaaacttccagaagggttaaagagatacaccgatttttaaactataaaagagcacatggaagaaaaatacatgtaagaggccgggcgcagtggctcacacccgtaatcccagcactttgggaggccatggtggacagatcacgaggtcaagagattgagaccatcctgacttcaggtcgtcctcctgccttggcctcccaaagtgctgggattacagacgtgagccaccgcacccagcctgtttagtgtttgatgcatagtattttttagatggctattgaatgcatgtaaatgcgtacataatcttttttaatctcgttcttccatctgcccttctgttggtcctcctttcctctacataaattgaattataccaattcagcagcatattgttcttcttg

SEQ ID NO: 216141 - DNA, 712 bp, Homo sapiens
aggccgggagttcaagaccagtctgagtaacacagcaaaactcctgtctctaaaaataaaataaaaatatttttgagatttttttcttactctgtctcccacgctctgtcacccacgctggagtgcagtggtgtgatctgggtctcactgtgtcactcttgctggaatgtagtggcgtgatcacagcccactgcagcctcgacctcccaggctcaagcaatccttccacctcagcctcctgcatagctgggactacaggcagacgccaccacacccagctaatttttaaattttttgtagagacaggtctcattacgttgtccaggctggtctcaaactcctgggctcaagcaattctcccatcttggtctttcaaaatgttgggatcacaggcgttagccaccatgcaaggcctctaaaaaaatttttctttttaattagctggacatggtggtgcacgtccatagtcccagctattcaagaggctgaggaaaggatcgcttgagtccaggagttcaaggctgcaatgagctatgatcatgctactacacatcagcctgggcaatgcagcaagacactgtctctaaaacaaaacaaaaccccccaaaacccaactacaataataaacacaagatcaataggctgggcatagtggctcatgcctgtaatcccagcactttgggaagctgaggtgggcagatcacctgaggtc

SEQ ID NO: 216142 - DNA, 341 bp, Homo sapiens
caccgcagccttgctgagctgcagtgggctccacccagtttgaacttcccagcagctttgtttatcctgtggctgtgaaactgcctactcaagcttcagcaatggccgacccccccgccccaccccgcaaccccccgaccaaggtcgactgtctcaggtgcatctcagattgctgctgtgctggcagcgagaatttcaagccagcggatcttagtttcctgggctccgtgggagtgggacccgctgagccagaccacttgactccctggcttcagcgcccctttccaggggagtaaatggttctgtcttagtggcattccacatgccactggggtatggca

SEQ ID NO: 216143 - DNA, 528 bp, Homo sapiens
acacaggataacaaaagcatccatttggatagagaggaagaggaagaatctcttttagcaggatttcatgaaggaggtccacaaagaagagtttattctgattgcgtaaaagttcagattggtttgttgagcctggactagaaccaaagctagggcccagcccatcgaggcttctttcacccctggactattgactcttttcatgtcatttttctcctctacatacatgttcttcctcattgtctttgttcaaatctcagtcaccattaactctcttatccttccccctcctgctcttccccttttgtctcttttcacaaggtagctctaaagcatctctgtatttgtccggttccaggcatggcaggatgtagaagttaacatttgttggagactgttttgcttcctggaatctcccctctagaaaactttgtgtcgctctgcttacaaacctggtatatccctgagtagaggcagtgctattaaaactcagtaataataataataccaataagcaatgtgcatcag

SEQ ID NO: 216144 - DNA, 358 bp, Homo sapiens
aagtattaacaagcaagcttatatatttataagagatgggaaaatattagaaaggaataaatcatgtcttgtcaacatgaagaaaaagtgtattttttttgttaacttattattgtgtttccttgtataattttcacttggttttgttggttttactacttgcttcattctttcaaaaactacatcttcatagaccatttcagcttttgctatgtgggcagaattataaaacccaatttcaaaatttcaactgaacgttgtcagcatttttctttgggctttttattgaaaaaaaatcctaattgtgtgtgtgtgtattttagtattaccatgaatgtaataacaataaaataaaaca

SEQ ID NO: 216145 - DNA, 705 bp, Homo sapiens
ctcggtggctcacgcctataatctcagtgctttgggaggctgaggtgggagatcacgaggttgggagatctaggccatcctggccaacatggtgaaaccccatctctactaaaatacaaaaaattggctgggtgtggtggtgcacttgtagtcccagctactcaggaggctgaggcaggagagtcgtgtgaacctgggaggcggagcttgcagtgagcagagattgggccactgtagtccagcctgggagaccgagtgagactctgtctcaaacacaaagcagaagtaagcagaaggtacaatgcttggcataaagaaaatatgcaacaaatattaatttccttcctaattttcatttcatttgatttagtcatttaaattcatttcacattttaaaagctacgattcttacagctgttcagaaacttaacacagtttagttacttttatattaactatttaaaaaaacaacatgcaaccttcatgaacacaatatcaaataaacaactctcaaatctgaataaactacagccacaccaaattgagccggtgctttcttagattttatttttcattttataatgaaaaatacacctctaaagagcatatggccgggcgtggtagttcacgcctgtaatcccagcacttcgggaagccgaggcgggcggatcacctgagcctcaggagttggagaccagcctggcc

SEQ ID NO: 216146 - DNA, 395 bp, Homo sapiens
agcatcatcagtagggtttgtccctgatgcctttacaacagcatctgagcacctctcaagtttttccaggccagctccagtttcagtgaggagagtgtgggctttctattccccaaatattcttactacagttaatatgtaggttactgccccagcccaactgcaggttcccagatgtgagttccatgtaggcagaaactgtccagttcttgaaattgaattacttccttgtgtatgtgtttttttcctacttaaagctcctcgggatgcttcctctcaaaagtctttgaagaataagaggttaagctaagacaacctgaatcaatttttttttttttgtcaaatgcgattgaaattatccccataattcaataaaatagctttttcccttcttt

SEQ ID NO: 216147 - DNA, 2272 bp, Homo sapiens
aggatgagtgtactaagcttctggttggcaatattgttatcacctgatataacaatcgtacctatcgtattgatgatgtggattggaataagactccaaaggatagcttcacgatgtctgatgggaaagagatcacattcttggaatactacagcaaaaattatgggatcacagttaaggaagaggaccagccattgctgattcacaggcccagtgagagacaggataatcatgggatgctgctaaaaggggaaatcctgctgctgcctgagctttcttttatgaccggaatcccagagaagatgaagaaggacttcagagccatgaaggatttggctcagcaaatcaatctgagccccaagcaacaccatagtgctttggaatgcttgctgcaaagaattgcaaagaacgaggcagccaccaatgaactgatgcgttgggggctccgtctgcaaaaggatgtacataagattgaaggacgtgttctgccaatggaaagaattaacttaaaaaatacttcgtttatcacatctcaggaactaaactgggttaaggaagtaaccagagacccttccatcttgactatccccatgcatttctgggcacttttttacccaaagagagcaatggaccaggctcgagaactggtcaacatgttggagaagatagccggccccattggcatgcgtatgagcccaccggcctgggttgaactaaaggatgaccgaatagagacttatgtcagaaccattcaatccacgttaggagctgaggggaagatacagatggttgtttgcatcatcatgggcccacgtgatgatctctatggggccatcaataagctgtgctgtgtgcagtccccagtgccctcccaggttgtcaatgttcgaaccattggtcagcccaccaggcttcggagtgtggcccagaagattttacttcagattaactgtaaattgggtggtgagctctggggagtggatattcctctgaaacagttaatggtgatcgggatggatgtttaccatgaccccagtagaggcatgcgctccgtggttggcttcgtggcaagcatcaatctcaccctcacaaaatggtattcccgggtggtgttccagatgccgcatcaggagattgtggacagcctgaagctatgcctcgtgggctccttaaaaaagttttatgaggtgaaccactgtctaccagagaagattgtggtgtaccgtgatggagtgtctgatggccaactgaagacagttgccaactatgagattcctcaactacagaagtgttttgaagcttttgagaattatcagcccaagatggtggtgtttgtagttcagaagaaaatcagtactaatctatatctggctgctcctcagaactttgtaactcccactcctggaactgtggtagatcatacaataacaagctgtgagtgggtggatttctatcttcttgcccatcatgtacggcagggctgtggcattcctacgcattatgtctgtgttctcaacaccgcaaacctgagccctgatcatatgcagaggctgactttcaaactgtgccacatgtactggaattggcctggcaccatcagagttccagctccttgcaagtatgcccacaagctagctttcctgtcaggacacatcttgcatcatgaaccagccatccagctgtgcgagaacctgttcttcctgtgactgcacagcttggagatgggctggtgagaagaaaggcggcctcagaactcagctgtgactcttgcagaatcaacagagactgaagtgggcttttgtgttataattttccctttctccaaccctgtagaataagatttctttcttgtcttttaaacctaatatcaccaagaagcaagtttctgagtaacagctgaaaatggccttgttgcctgtgtagagcaagttacggtggtactgccactctgcaggtggagcgggtgactctgggggaccattaagacctccagaccgggtgcggtggttcacacctgtaatccaagcactttgggaggccgaggcgggtggatcatgaggtcaggagatcaagaccatcctggccaacatggtgaaaccccgtctctactaaaatacaaaaaaattagccgggtgtggcggtgcacgcctgtagtcccagctactcaggaggctaaggcaggagaatcgcttgaacccgggaggtggaggttgcagtgagccgagatcacgccactgcactccagcctgttgacaaagcaagactctgtctc

SEQ ID NO: 216148 - DNA, 1244 bp, Homo sapiens
agaagctttttttccctgccctctaggcacagtagctttggcactaactgcaaaaggatctgccatgattccaggctacacaatgcgagtgggcctctcactgactgtggtccgtagcctgagggctctgtgagtcacacatcctcgctgtcatttcaggtgaaccactgtctaccagagaagattgtggtgtaccgtgatggagtgtctgatggccaactgaagacagttgccaactatgagattcctcaactacagaagtgttttgaagcttttgagaattatcagcccaagatggtggtgtttgtagttcagaagaaaatcagtactaatctatatctggctgctcctcagaactttgtaactcccactcctggaactgtggtagatcatacaataacaagctgtgagtgggtggatttctatcttcttgcccatcatgtacggcagggctgtggcattcctacgcattatgtctgtgttctcaacaccgcaaacctgagccctgatcatatgcagaggctgactttcaaactgtgccacatgtactggaattggcctggcaccatcagagttccagctccttgcaagtatgcccacaagctagctttcctgtcaggacacatcttgcatcatgaaccagccatccagctgtgcgagaacctgttcttcctgtgactgcacagcttggagatgggctggtgagaagaaaggcggcctcagaactcagctgtgactcttgcagaatcaacagagactgaagtgggcttttgtgttataattttccctttctccaaccctgtagaataagatttctttcttgtcttttaaacctaatatcaccaagaagcaagtttctgagtaacagctgaaaatggccttgttgcctgtgtagagcaagttacggtggtactgccactctgcaggtggagcgggtgactctgggggaccattaagacctccagaccgggtgcggtggttcacacctgtaatccaagcactttgggaggccgaggcgggtggatcatgaggtcaggagatcaagaccatcctggccaacatggtgaaaccccgtctctactaaaatacaaaaaaattagccgggtgtggcggtgcacgcctgtagtcccagctactcaggaggctaaggcaggagaatcgcttgaacccgggaggtggaggttgcagtgagccgagatcacgccactgcactccagcctgttgacaaagcaagactctgtctc

SEQ ID NO: 216149 - DNA, 422 bp, Homo sapiens
cgtgcgatctcagctcaccgcaacgtccatctcctgggttcaagcgattctcacacctcagcctcctgggtagctgggattacaggtgtgcaccgccacaaactaatttttgtatttttagtagagacggagtttcaccatatttgtcaagctggtcttgaactcctgacctcaggtgatctgcccacctcgggctcccaaagtgctgggattataggcatgagccactgtgcctagctctcatgattttttaaaaaataatttcaacttttattttaaattcggggtaacgtgcagatttgtttcatgtgtatattgtgtgatgctgaagtttgaggtacagttgattgcatcacttaggcagtgagcatagtgtccagtagttagttttttaactcttttcccccttctgtcgtcttctc

SEQ ID NO: 216150 - DNA, 355 bp, Homo sapiens
tggattcaataagttgagaaatcccaatgaatcaaagggagagcagctatctggtaaataattatgtaaaagaaaagatgccagttggtatccctttggtgagattttcctaggaattctgctgttcatatagagtagcaaagtttagagacttggctaaagaatgaatgaatgaatgtgttccattgttatctgttcaaactggtataagctataaagcacatcatgcaagaggcagtatgctagtttgggcaggcctcttctcctcctcctcctcctgggaggtcaaagctgcagtgatttgtgattgtgctactgcattccaggctgagtgacagggcaagaccttgtctca

SEQ ID NO: 216151 - DNA, 273 bp, Homo sapiens
acagttttctgggtggccctggaatgaatgacttctctcttacttgcttgtagttctcaggaatgaagaatgtggcattaattgcaagacagccaactagatgcagccaggaagaacatctgccaccaaaagactgggatattgggaagcctggagcactctgaacagatcttcagagggaaggcattgagaatgggtggagggaggacacagataccaggctgaagggaaagaaagctgggaaccctgcacaggactacaactcatggggaa

SEQ ID NO: 216152 - DNA, 492 bp, Homo sapiens
atcgactatcctagggctatacctacgccgaggttcttgctcagagcagcataaactgcagtctgtttgggaggtggctttcttggcagaggttctttgaaatgcttttatgacacttttgtttgtttctctgtaacccaaaagagttaaaagggagatgagatggctgcattcaaattgattgcatgtgctgaagcaagggtatgttctttgtcagcaagcaggatttatatttggagagatatttatctgtgggaataggctaaagtgaagaaatcaataaatgtgttttggctctttagaaataatttctgctcagcaaatagaatgtgctaagttctttaattaaaattccatacctcaagtggaggtaatttgggagatgtttctgcttaccaagtatgatgttttttttactttgcttactttttgttttaactgcctaaggttgagcctttctgtcttttaaggataaaagagatggttgactag

SEQ ID NO: 216153 - DNA, 368 bp, Homo sapiens
taaaaaattagctggtgtgttggtgcatgcctatagttccaaatacttgggaagctgaggcaggaggattgcttgagcgcaggagttccaggctgcagtggactatgatcctgccactgtactccagcttgggtaacagagggagactgtgtctcagaagaagaaaaaaaaacaagtataagttctcaccggtatcttaaacatcaagtaaaacagtatcgagtaaaacaaaaaactaaaaactccaaaagtcaaaaacacttttaaaaagaacatggtgttaagagtagtttgttcagtttccccatagaaaatgatttatggaaggagaataaaagattattctgaacactaaaacaataagactg

SEQ ID NO: 216154 - DNA, 117 bp, Homo sapiens
gtgcctggcctttagtgccatacttgattctgcagagaggtcaccacacattctgaagttgggcacccaccccaggtccgtccccgttccatcaaacatgaggaagaggctcatgtg

SEQ ID NO: 216155 - DNA, 510 bp, Homo sapiens
cagaataaaattttctgtatacaagagtcaccttcaatagtgatattttcagtgcaagttaaggatagcactgattggttgaagatttcattgaatgttagataaaaatgaatgtgagtaaaattattcctatccatctttattatgagagagtgaatattattggcggatttaaaaaatactggatgcttttattagtaagggaccagaactagttagatgctaggtctaactagcttcaagcctaagttaactccacctaagggtgtcctctggaatatgagatgtcacagaaacagttcaaagagaattctgcccagagatttttttaactcttttactcctttgctccatttgtttcagagtaggctcataaggaaagagccatgttttatagtggttgtctttcacgcttcccctcatttgttaaccatttccatagatgtacaagttctgttaattaccttgtctttttttttattatacatgcccaaaattgctgtcctatgt

SEQ ID NO: 216156 - DNA, 397 bp, Homo sapiens
cactaaattagactctctcccgtctaactggaaagttgggaaatctcgccacaggtgaccaaagaggtctctttttttttctttctttcttttttccaggacggagtttcgctcttacatccaggctggagtaaagtggcatgatctccgctcactgcatcctccgccccctgggttcaagcaattctcctgcctcagcctccagagtagctgggattacaggcacctgccaccacgcccagctaatttttttgtatttttagtagagatggggttttgccatgttggccgggctggtctcaaatgcctgacctcagatgatccacccaccttggcctcccaaagtgctaggattatggacgtgagccaccgcgcctgaccctacttggtggttttt

SEQ ID NO: 216157 - DNA, 668 bp, Homo sapiens
agtacctgtgggcttaatcagaatcagaggtcagccagcaaggaatgttggagggggatgggagggagtggggcatcattcagtttaatggtcaatagctagttgtgggggttggggggcagtggttggagaaaggtgagtcaaaaagcagcactactgcctccggagcaaatgaatgggaataaaggttgatgataccaggtcagtaggagtctaaggtcagggctgggtcatacaagacagatgagattctgataagcagagactgaaaataaaggcaagacaggaaactaaggacttgttcagtgaacaagactgtcaggtttaaagggtgtgtgtgaagtggactaatgaaagacaaaacaggatggtagatttaggtcatgtaatagtagatgtaaagtaagaagtttaagattttattctataggcaatggagagacagcaaaacatgactagaactaatattgtgggagaataatcaatactggtattcaagataaaacgaagaaaagctgaagcttggttaggaggccacaggattaatctaggcaacaagtcagagttatattaatgggaatggaaaggaagagttgcacacagaatgtagaagtacaatcaaagtctagcagtatattgcaaatgatgggcaaaggaaagaaggaact

SEQ ID NO: 216158 - DNA, 354 bp, Homo sapiens
tgaacagaaagcaactaactcaatctgggttgagtgacagagaaaatgtttctaaagaggtgatacttctcagtcttaaaaccaaaaaggggttagccaggtagaagaggaagagtaatatgtacaaaggcaccatactgatatacaataaaggattacacatttaagaaactgcaagtcaagtctgtatggatggaatatagtactcaggctgaggagaagctgcagcagaataactagcatttaatattcaaaccactctctgaggtaggcactattaatatccccccattgtgtagatgagaaaactgaggcacacaaaggtgaagtaacttgaccaaggttaagttatga

SEQ ID NO: 216159 - DNA, 430 bp, Homo sapiens
gaggctgaggtgggcggatcccttgagctcaggagttcaagaccagcctgggcaacatggtgaaatcccgtctctacaaaaactacaaaaattaactggatgggatggtgggcacctgtagccccagctatttgtgaggctgaggtgggaggatcctttgagcccaggaggtcaaggctgcagtgagtcgagattgtgccactgcactccagcctaggtgacaaagtgagaccctgtctcaaaaactaaaaataagcatgaggccctgtgttgttgattggccacagggcacacccacagagctgaccctgatattcaatatactcacagcactgatcagcttgcaaaatgcatcagctactgcatctacctccacccacaagtggatcaaagaatttagataccaaactcaccctgcctgacctccctg

SEQ ID NO: 216160 - DNA, 409 bp, Homo sapiens
actccctggtcactttctaggatcagaagtcttcaagtagaaaagaaaaagaatgctttcaacccgatgatccccaggccccttctagctctaaaataagttaagcatctgtggaagggagagatgatgagtgtgactttcatgcattaagaaacgtacataaaaatgagatgtgcacatagaagtgtgagtcaggagttctgacactatttcctctgatacttctgtgtcttcttaggtttcactggaatggcaatttgaattctcttctttgagacatacatggtgttaaagatgatttaactaaagacatttaagccttggccatttgtaaaattctcaaatataactagatatttagaaagtatatgcatgtgcatatttttcacacaccgtgtgaaattcagat

SEQ ID NO: 216161 - DNA, 259 bp, Homo sapiens
ttgaatcccatcaagatgtctgttgtaacactccgaatgagctgcttcagaatcacagggagggctgctcagagggaagaaaacttagcaaccacagccaatcggctccaggttgaggcacactgattgatcatttcctccctgcttttcaggacgggaaacaacatcacagcagagaagaatgcttgaaggccagacgcttggcctcctcaggcaggaagatcccatctagctccttggctctgggactatgtgtggg

SEQ ID NO: 216162 - DNA, 159 bp, Homo sapiens
tctgtgaggagcagagaaaaacggtttgaaatggcgattttggaacttcccatgttttccataatttcaagagaaagctgacatttctgagtccttcctggcagtaacctaggatattttttctctttcagagttacagaagatgtaccattttccatg

SEQ ID NO: 216163 - DNA, 205 bp, Homo sapiens
ccctccctgcgccccgtcatcaagaagaaaattcgaagaaaaggtttagcagggacagagaagcgacctgtcccggaaaccccttaaagcctgcgggtaacatgtttgctccctcctcccccactcggactatagaagtatcaccaatccactgcagagaaattgggaaaattcagaaaaacaaaaaataaaaagaaatccacct

SEQ ID NO: 216164 - DNA, 203 bp, Homo sapiens
actagactgggagccatacgcctagggcctgggcttttctccatatgatgcccactggaactggaactcacgtagctgaaaagtgatgctagctgttggctaggagctcagctgagcctctccatctggcttggactcctcacagcatggcagctaggttccaagactaaatgttccatagcacagcaatccaaaagagaatg

SEQ ID NO: 216165 - DNA, 598 bp, Homo sapiens
caccaacatgactggtgtccttatgagaagcaaggaagagacataaggagaacatggtgtgacaattgagacagagattggagtgatgcatctacaagccaagaaatgtcaagggccgtgagccacaccagaagctaagagaaaggcatgggactgaccctcccctagagccatcagaaagagcctgaccctggcggcaccttgcttttggacttctagactccagaattatgagaataaatttgtgttgctttaagccactcagtttgtggtaatttgttatgacagttctaagaaactaatccaccctgctaaagagtaaatgtctgatgcaaaactcactacatggatgaaaaggctgagatattccgaagagtcataatgaactgtgccgtcatctacaaaggaagtgcagcactgcaacaactcaagatagattctggagacgtggcaggacagacgtgcctaccagactaggagcactttcaggacagcgtcatgccttgttctcctccacatccctccgtgcctgaaaatcagaaatgctcaattaaatgttgaaaatgtcaataaattcataggaaaacgaatcagataa

SEQ ID NO: 216166 - DNA, 368 bp, Homo sapiens
aggaagcgctgtgtgattgctgcttagagttatgacattagatccgtgaaattagatttagaaacatgaaacgagaaatttgagtataatcagtgtttatcaagtattcatgtgcaatgtactgtgctaggtatttaaattagcactaatgctcacaactctacacaaagtaagtggtgtcggcccaattattatagacgaagaagctgaaacactgatttctcttttaaaatgggagtggagaatagtcatgtaactaataaatgccagagctatgattcaaactcaagccttttgtgacttcacatacttcctaagaagattcatttcctagagcacatttttcccaccttatgctttaactcgct

SEQ ID NO: 216167 - DNA, 458 bp, Homo sapiens
atttaactgaacctaccagaccccattcaaaacatacagggataaaataggcctgagtactgagatgtactcagatagcatttggggaaagtacgtgagtcacacataaaaacagaccgttcttaatgcaatgggaagggtgttaactataaaaggaccctgtccagctggctcagggattcaggtagagttactttggaaaatctacccacaccttatcctgaatcactgctccctacactcttaaatctgtgtccactgaaggcattggcctttactgttcagggatgtgagttatgttgcatacttgtgaaaaatttaaaaatcaacttaaaattcaaacccaaaacttattaaaagaaagcaaatttaggccaggtgtggtggctcacacctgtaatcccagcactttgggaggctgaggcagccagatcacaaggcaggggaatcgcttgaac

SEQ ID NO: 216168 - DNA, 462 bp, Homo sapiens
tcccgcctcagcttcccaaagtgctgggattacaggcgtgagccaccacgcccggtcctgattgaggaatttaaaagactactctggttgatttggagaatggatcagggggcagagggagccccgagagaggaggctcaaggcatagaacagcctaagaacagcctcgctgaagatggtggtggcctggatgagggtgtcagtgctcttggggtgcactttaggtgggctcaactcatcctatgaccatttgcattttcagcaatgcctttttctggaaagaagttttcaaatgaatgcaaaagtgaagagattagttcagtaatgaggcgtgtatccatcacctgcttcaataattacaaacattctgctattgttgtttcacgtatccccttaacatttgaaagtaaattgtagctatcacactatttcactcataaatccttcagtatacatctctaa

SEQ ID NO: 216169 - DNA, 409 bp, Homo sapiens
tcttcaactaaatctttgaaatcttaaacttgtgccacatctcagctttgactagctgtatttaaaatgctcaatagccacaggggagccactgtattggacagcacagttctatacccagttttacggatataaaactggtgttgggcaaattactttccgtctttaggactcctgctttcatcagtaaaatgaaggattcagacttgtttgtcttctaacaaaaaaatgtggttccctccaggtatgagggagccttcagaggtgccctaaataatctgtatctcgatctgggtggtgcttgtgtgggtgtatgtataatacataaaaatttatcaggcagtacacttaagatttatacacttaatagtatctttgttatatctcagtaaaagtttaaaaaaaaaaa

SEQ ID NO: 216170 - DNA, 454 bp, Homo sapiens
ctgggttcaagtgattctcccacttcagcctcccgagtagctgggattacaggtacccgccaccatgcccggctaatttttttgtagagacagggtttcaccatgttggccaggctggtcttgaactcctgacctcaggtgatccgcccacctcggcctcccaaagtgctgggattacaggcctgagccaccgcatctggcctcaattaccaatgactaaatttgtcttcttaataataaactttacttctagtaatttgacagttcaaggcaagttgctaaatattccaaaataatttttaaatatagtaaggacaagtatagatgataattactataactattttcaacacatataaaatttttctatcaaaaaactgagattactatttctaagacaacaaaatttgatatcagaatctccacttacatgattgcatatgtgtaagcacga

SEQ ID NO: 216171 - DNA, 572 bp, Homo sapiens
gccacgctcctggtccacccactttcatgttccatcctgtacacctggctctgccttttagatagcagtagcaaaattagtgaaagtactaaaagtctctgatatgcagaaataatgacataagcctgtctctctctcttcctctctctctctgccttggctgccaggcagagaagggccccctgtccagtggacacgtgacccacgtaaccttacatatcattggagatgagtcacactctttaccctgccccttttgctttgtatccaataaataacagcgcagctagacattcggggccactactggtctccgcgaattggtggtagtggtcccccgggcccagctgtcttttcttttatctctttgtcttgtgtctttatttctgcactctctcatctccacaaatggggagaaaacccaccgaccctgtggggctggaccctacatgtgtatatctttggataattgtttattcaaatcctttgcccttttaaaaatttgactttttgtctttttattttttacttataagagttattttatatcttagtagactctatcagatata

SEQ ID NO: 216172 - DNA, 621 bp, Homo sapiens
ccatttgcactccagcttgggcaacaagagcgaaactctgtctcaaaaaaaaaaaaaaaaattcaagtgaaaatccgattgttaatgaattagaatatcggatcataacacgttctagagctggaagaatgtgtcatggtttggcatctgttccacaccaaattgtagagtgttaggctacctgtattttcagattccttctgctttgagaattaaatctgttgtagtcacattctgactttgggcatagttctatttgcctccccagtgagcagacacctggctcttcttggtgtgtatatgaaaagtagaataagtggaattcattagaagctggctgctatcatgtttagggaattcaagaatgatatcaacaaggagaatgaataaaagaaatatttaaagacccaaactccactaagatgagtagactcagactgaaaaaaaaaaaaaaaaatcagacctggaagcaatggggaatgatgtgcctttttagagtcaagatttgggtcgaatagagtgtaagtttcagaggcaaagtttcaaccaatgtcagcagtacaaaggctacaacttccaacatcagatctccatcagtaacaacatcttggaagagggcag

SEQ ID NO: 216173 - DNA, 557 bp, Homo sapiens
cggattcatcaatttcctctaggttttcctgtttgttcatgtatagttcatgttctctgatatcttttgcatttctgtgatatcagttgtaaggtctccttttcattcctgcttttggctcttctttttttcttggttagtctagctagtggtttattgattttgtttatcttctcattaaaccaacttttcatttctttttttttatttcttagtctctattttgtttatttctgctctgatcttcattatttccttccttctactaattttgggtttggtttgtccttgcctttctagttccttaaggtccatcattaggttatttgaaatctttctactttttttgatgtaggtgtttattgctctaaacttccctcttagcactgcttttgctgtatcccataggttttggtatgttttttccatttaaatttaagaaattttttttcttctttttggagacagggtctaactctgtcacccaggtggagcaaagtggcacaatcatggctcactgctacttcaaacacctgggctcaagagatcctcttgtc

SEQ ID NO: 216174 - DNA, 376 bp, Homo sapiens
agtttctcataagttataaccagatggtggctgaggctgagtcccaaaggtatctgcacctaatgtgcctgacctctgggctggaaagactcaagccagggctggcatctctccctcatcctcatcctcttcctccatgtggtttcaccagcatggaggcttcagatcatctgcttttctcatatggcagctcaaggctgcagtacaagtgaggggagcgagagagcaagcccctcccctattgcctcttctaagctagcctcagaagctctgcagcatcatttctgccacagtcttgtttgtccagcagtctcaaagcctgctcaagttcaagggaaattggcatagacaccatctcttgatagcaagtgtattt

SEQ ID NO: 216175 - DNA, 219 bp, Homo sapiens
taaaattatctttctgatgctagagatgatccaggaattcacttatagagcaatgataataccacttcaaataatgtttctcttagactcccagaacttaatacgctttccttctgagtcactacatttgccaacaaggaagattctgaaagataagcttgctgatgatgaaaacatcacttggtggccaacctccttattacacataaagacaaacaa

SEQ ID NO: 216176 - DNA, 436 bp, Homo sapiens
ggaaagcctgcgactaactgaaaaagttacacagctgacactgctgcttaaagaaaccagatggcgccagagcttcttgacccctgaccagatgccagaggaagataagacaccataaaaccagcgcaaatgggaactggcaaaccctgggtgcctttagatcatgaacatatcattataatgctaatttcccttccctaaaagaaaatctctgccattttgtgtacatatgatatatgaagatgcatgtttatgaattgggcctgcgtgtctggagtcccaccctgcacatactaacattcctttcctgccccataggaataaaggcaataaaccccttgccttttattcttcaagaaaagatgctttcagaggaagagctcaccttctccattccctggcaaatgaataaaacctgattgcctttttcaatggg

SEQ ID NO: 216177 - DNA, 244 bp, Homo sapiens
gtagagacagggtcttgatatgtcacttaggctggtcttgaactcctgggctcaagtgattctcctgccttggcctcccaaagcgctggaattgtaagtatgagccactgtgtccagcctggccctggtcattcttaaaatgcactcttaaaatgtacctcccttcactggaaaacatttttctttctttctttttttttttttttgagataggggtcttgctatgttgcccaggctggagtgc

SEQ ID NO: 216178 - DNA, 325 bp, Homo sapiens
tagatttgttttgaaattcagaaatcttcagatttcagaagggcattatggtgtatataatgtttaagtcatccccagtggggcttaggttaagtaatatccccagtgggaattactcctgtaatcaaacatataatctctactgaaaaatgtatgaattagactaaataaaacaaagactagaaaaccttaagttgaagtcaggttttcttaccatataaattatatttgagactttgagttttcaaaatcttctgaacttctaaattgttaagttattctgggcctgtttattaaagactctggaaagtcttgaagaaaagaa

SEQ ID NO: 216179 - DNA, 490 bp, Homo sapiens
ccactggcccacctaaattcaggcccaagactaccctaatgccaccctaagggatggagtttatgataaagtctgtggccaaaatatcctggagaaagagaaaggagggtacaggtggaaattccctaaggtggcacatgcccaacaacacaaaagcctgtcttcaagttcaccccaagttcatcatgccatcattataatagaatttacatacagttttgcccccccatccctgggaggcttttcttaacaaattataggtaagaccatgcacagtttaattttagattgtatagctatacacttcaatcaaataacatcatcctgtcactcagatacagcccaaacctcaactcctccccacaaaccccataaaagcaccttgagctctgtaaagaagtgctgagttcacttcgcagaaataagcccgctgtccctcagagtgtattattgtgcttcaataaactttgctttaagcttgcattttggt

SEQ ID NO: 216180 - DNA, 235 bp, Homo sapiens
ggcttaaagaaagtctttccttcccttcgcataagcaagggaattttcatcatcattaaaatggtgatttttcaaaaagggcagaaaagtcagattagcgccccctggtggtataggtaaatcccaggggaaaggggaaaccccggcagaggaaggcgaaaaccagaacccaacatcattagttggaataacaaaaggcttaagaggctaggcgccttggcagatggatgcctgc

SEQ ID NO: 216181 - DNA, 457 bp, Homo sapiens
gaatgaccagacatgtacaatgactgcttttaggaagtagaaaaaaaatgagagtctgtcgtaggagtctttatctctttttattaaaacaaaaaaatcaacacgtccttttgaggatatagtaaaaatgtacttgagtagctgacagaagactacagcccaggatccaaagcagcacaaatcagtgaggcctgagaaggcgctaggatctctcagaggcgtctgcttcctccatcaacaaagcacaaagtttagacttagttttgtattcttgaggctaagagcttaatattttaatattagaaaaatataactcctgcacattcttgaggatagtattttattaattagaaaaatataactcccatatatctaacacagtatacaggaatctgatgcgtgtcactgaataaatgggtgaaaacgatgtttcgaatctttggaaagaaggaaagaa

SEQ ID NO: 216182 - DNA, 450 bp, Homo sapiens
cagttcggtagtcatgatccaaccacatgtccattgagcatttgcaatgagtcttatccaaattgtgatgtactctaagtataaaacacacactgaatttcaaagatttagtataatgaaatgtaaaatttctcattaataatttttatattgaattttatgttgaaatgaccatacttggatagattgggctaaatcagaggttgacaaactttccctctgaaagactggatagtaagaattttcagctttgtggatcacctggtctcaactatgcaactactcaactctgccattgcagtgcaaaatcagccatagacaatataaaaacaaatgggcatggcttgttccaataaaactttatttaaaaaaaacagatggtgggccagatttcccccacaggctgtatagtttgctgatttctgtgttaaataaaatattaaatatatt

SEQ ID NO: 216183 - DNA, 526 bp, Homo sapiens
ggaggtggggcatccgggtctcttggtggctgcttctacccccggagctcagctgatcttcccttccagactacgaggtgtgaatttcaaacttccgtaatggagttagcccacagtttattgctaaatgaagaagctttggctcaaatcaccgaagcaaaaagaccagttttcatctttgaatggttgcgatttcttgataaagtcttggttgctgccaacaagaccgatgtaaaggaaaaacagaaaaaacttgttgaacaattaactggattaataagtagttcacctggaccacctacacgaaaattattagctaaaaatctcgcagccctttatagcattggggatactttcacagtttttcagacacttgataaatgcaatgacattatcagaaataaagatgacactgcggcctacttaccaacaaaattggctgcggtggcttgtgtcggagcattttatgaaaaaatggggagaatgttgggcagcgcatttccagaaacggtaaataatctattga

SEQ ID NO: 216184 - DNA, 395 bp, Homo sapiens
tagcactgtcttaggaaatggagactttttgatagaaagttgccaactgccaggtgtgacattgagtcgagagaactttctctccgaagcctctggtgtttggtttgtcactgagctctgcttcagggctgttttctctccgggtgagaacagtggcagaagcctgtgaaatcaggctgacctgccttgcctctctgccgcatacatgatgtcagcgtcttcacgtgtgtatttttccggccaactccatcatctgccattgtcttcgttttggtgccttaggttgatgttagccagtaaggatgtactcaagacaggctgtggaattcctttttctctttagtggcgtaattcatagttttattaatgatcttatatttatagaatcactgaag

SEQ ID NO: 216185 - DNA, 436 bp, Homo sapiens
gcagagagtcaggcgtgactagagacctaacagcatcttctttccttcctccctgggccctgccccttgtaggcaatgggtatggcattattttgcttttattttgcatccttcgacatgggccaccctactttaagaaaacttggagggagggaaggttggggaggacacacctcatttccctggaccccttttggaactagccaaatccccagagggccttaatggttcttacttggatttgcagcccaaatcgggcttaggttgaaacctcagaagcagacagaagcagcagaagagatgtattaagaatagagataaagccgggcatggtggctcaaatcccagcactttgggagggtgaggtgggcgtatcatttgaggtcaggagtttgagaccagcctggccaacatggtgaaacccatgtctactaaa

SEQ ID NO: 216186 - DNA, 319 bp, Homo sapiens
ctggtccctcagatccccctgcaggggcaggaatgtctgagccagggcattgtttctgtggaatcttcccaccaatgaatctcccagcaggaccaactgtttggctgtatttaaactgtcatttagccaaggcagtttgctggcacacccaacttcaacccagcaagcacaacaggtctgcagctcgcgccaaagcttgtttaaacatcatttgaaccaaacagccagtcaatttaaaaatactccaagccaaaagccaatgagatttgaaaacaagaaaaactgaaaatgaaaataaaagggaaatatatgaatttat

SEQ ID NO: 216187 - DNA, 487 bp, Homo sapiens
gacagtcttgtcatcatgttactagatgtgtgcagcactaaacgtggggtggtgaatagaagaaccatattacatccagatggcttgcatgcatatatagtgttttgtgtttatgttactgccttactagatgcaggtactgaaaggtatccacctactttctgaacagagatagtcgtggttgtataaactgtcagaaaatgagtgcataaactttctgtttgtaaagaaggtaacattgtaactatttctcatcagacagaatatagtatttatacatagcataattcattagtaaggtataaattgtctttttaaatatctaatgtcttaaattatgacttaactaaattcaaaattatttatcatagtaatccttgttatcaaaattcaaataggtgagtgtaatatacaaggtaagggtctgtggccctgtcaaacaaaaacaaaaataaaaacatggtgacctctttgatggtaaaaaaaa

SEQ ID NO: 216188 - DNA, 496 bp, Homo sapiens
agcaggatttgaaccctggcaattgggctccaaagtctgatcctttgtctataatgttgacaaaaacttgtggatgttgtggtaaattgctttctctccatttgaaatcccattgagttgaagagatagacgcatagtgagtatacgtcccaaggaaatgtattatattgttttctgggtttcagttaattcaaataaaataaaaatagtgaagcaaagatttggactagatgctgtgaggttttgtgtcagcatgcaacagtgtcacaacagtgtcatcaccacgtttggttctgtgttgtggatgtaatattttgccccacatacatagaaagttcaatgaatagcactgaaccacatatataccaaattaaagacaacttttgatattatgtattctagagggaatctttctggtatcagaatattcatactactgtcattgggatgagttttaaatgtatacctttttaaataaatcctctttaataataaa

SEQ ID NO: 216189 - DNA, 367 bp, Homo sapiens
gtttctatggtgtttagacaccctactgggtagagaggtaattgattgttgggtaatcagtatatgtagctgttggggagataaagggaaagtgggttcatcagcagatacggggctaggtctcttaagtgtcagatccatctttcactttgttttccatcttcctcttgcctgcccccagttaggcctttcaagcatttaaaaatactgagcatttttaaatactgaggttatatagtgacatccttctttttttttcttttaaaaaatgttattatatgaacaacattataaaggagagtaatattatgtaccgtaaatcctggctcatggtgaacacttaataaacatcttattaagtgaatga

SEQ ID NO: 216190 - DNA, 355 bp, Homo sapiens
ggatatcagcacatttggagcctccctgtagccccattttctgacagcatgttccatttccgtgtagctgcaccggatttagctgactgttcaactgatccttattttgctgggatattcttcaccgattacttcttttacttctatcgacgctgtgcctaatttgttcaagtttggggactttaccaaagaaaaatactcaggaatacatttaacagaaacgaacatcctcttgcaacttcttttttcttctttgtaaaacatttacgtttattgctgaaggactttttcaggctttagcttccaacagttttgagacattaatgaggagaataaaatgtttgctgaaacttga

SEQ ID NO: 216191 - DNA, 423 bp, Homo sapiens
tacttgtttttttggctatttgtgttagctaaataccttttatagttcaaacatgtcacatgcttgtctctttattataatttttggttgaggactctattctgtgttctctttatgattatgtaaatattgttcattgctgggccaagaaatatgctgtaatcacattttcgttcttatataactttttccaggagttaattattgctttatgatttttcctttgtatctagctttattttcattttctacaagaactctgtaaagtagtggacttctcaatacaaaatttcacataatcaaacctgtcatatatgatagcatttttacttcttttctggagaagtacctcttcgatcacagcatcttactttgtagtgtggactggaagttttctgggtacagctattattttgtcagctg

SEQ ID NO: 216192 - DNA, 339 bp, Homo sapiens
acataaggatgaatgatttagtccttgcccatagggaagtagagggtcagacacaaaattcttcccagtcctgcaatttcaaatttcagagaggctgtggcagtgcagaggaggaaatgcttccaactctattttccatttacccagttaagatatatagaagagacgcatttttccttgcttttctttttaaagactgggtctcactctgtcacccaggctggagtacagtggcgtgatcatagctcactgcagcattgaattcctgagctaaagtgatcctcccatgtcagcctcccaagtagctgggattacaggcacatgccaccattcctggcc

SEQ ID NO: 216193 - DNA, 637 bp, Homo sapiens
cgcggtggctcacgcctgtactcccagcactttgggagaccaaggcgagcagatcactaggtcaggagttcgagaccagcctggccaacatagtgaaaccccatctctactaaaaatacaaaaaattagccgagtgtgctggtatgcaccggtaatcccagctactcaggaagctgaggcaggagaatcgcatgaatgtgggaggcggaggttgcagtgagccaagatcatggcattgcactccagcccaggcgacagcgcgaaactccgtttcaaaatattttgaactgaatgatatataaacacaacttactaagagtttggggatgcacttaaagcagggcttagaaatgtctatagctttaaaccataagttatcgatataacttaaagaaggatgccaaatcaagaagctaggaaaagaaagcaaagtaaacccaaaataagtgaaaagaaggaaataataaagataaaagcaaacatcaatcaaataatggataaaagcaaaaataaattaaatagaaaattaagaacagcataaaaatcagtgaaacccatgagttctatcgatcaatataggctgggcgctgtggctcatgcatgtacacttgtaggtcaggagtttgagaccggctgg

SEQ ID NO: 216194 - DNA, 422 bp, Homo sapiens
aattcagtggtgacagcagtttttgtggtttatgctgtggatagagaaaagcagaggtggttagtcttaaaactgtggcacagaaattgaagctgataataagaattttaaccatgtcttaggaaaagccaaatcaaagtcccctgctgataagagagtgagatgaatttgaaacatgggcaccacatccatgttcttgtaggcctggtttgtggtccagggccaattgtaagctgggatcacaagacagacacttctccagcaagcagacaacaagggaaggtctgaacttaaagctgcctctcttgtgagcccgaaagttgaatgtctctgtttccccaaatacatgatcccttgtcatttaataaaatcttcaggtacagaagcattagaagtggggtagaatcaggtaaggtcctgct

SEQ ID NO: 216195 - DNA, 614 bp, Homo sapiens
tctgaaggggagaagtactgctctaggcaggtgattctcaaagctaaagtgtgaggagcaccaggagggcttgttaaaccaagattgctgggctccagccccggtatttctgattctgcaggtctgggtgggaccagataatctgcatttctagaccagctctagatgctgctgccgccctggagaccccttgagagccacagaactagcctggagatgagcagtctaagcctgctttcgcctccctccatgagctaaaaatggcttttacatttttaaatggttgaaaaaaaatctaaggaagagtagtattttgtgacacataaaaattatacaaaattcaaatttgtccgtgaattttaaaagttttatttgaacgcagccaagctcattgatttatgaattgtttatggctgcttttgaagtacaagggcagagttgagtaattatgccaggggctgtatggcctacagaggcttacaatatttatcatctggctctttacataaaaatgttgccatccatgcgctaaactatttagaatataactggaaactaattttcagaaccgtcagagattcaatgcagaattcattacagtaagttcagctact

SEQ ID NO: 216196 - DNA, 262 bp, Homo sapiens
tgatggaaatgagagcattaaaaaggtttgggtgcactgggtgaatgcatcttaaggaacttgaactgcatctggaagaagatagggtgcccactgaaataggaaggtaacataaacacatttaaatttagaaattcaactctgtgctgaacatggtggctcttgcctacaatcccagcactttgccaggccgaggcaggaggatcgtttgagcccaggaatttgagaccagtctgggcaacatagcaagaccaatctctac

SEQ ID NO: 216197 - DNA, 611 bp, Homo sapiens
taggtgctcagcatctgcacttgtttagggattttttctattgtgagtcatggtgggaagcagggcctaccttccactacagaagtggaagagagcagatagcaagcttctactctccaaggaataaagtgcaggtgtgttgcctgtgctgccaaccaggtgctctcactcaggtcttagagactggaacaattacggtaatagggattcactccagctgcacagactacaacacccagtgaccatcagtagccgtggaagctgagggcctgaatctctagaagccctcgctactcaaagtgtggtctggggacttgttaggaaggcagaatctgggacccaccctagacctactgagtcaatatattatagtgccttgcacatagtagggccctaatgaatatatcttgatgtatagacatatgaaaatatattgaaatttgatcttgtggaagctatctgaattatatttcttcaaaatataattatgtaaacagcccttaacccaatgactgtactcttgaaaacatattacatgatattgtgtataataaattgcattttacttgcatttcattgatatttaaaagactcttccagtgaaaaaaaat

SEQ ID NO: 216198 - DNA, 526 bp, Homo sapiens
tgagtttctatttaacaaatacttatatagttttatgtgccacacactattacaagtactttacaagtaacacatttatgcctcatatgaagtgtagatgctcttatctctgttttacagaataggaaattgaggcatagaaaacgtaaataatttgcccaaagacaaacaactagtaaatggcagagatgagattcaaattcagggcaatctgggtctggagtatgtgcccctagtcagcatgttatatctttcagaggctgacacacctttgtgtatgtttattattggatcacctgcataattattaaggtttatttataaacctagcagaaatgtttgctgtacagtacataacttctttggaaatgatttatagtcatattctgaagcatttagtgaggacagagctaaagatagcagttttcacatgaattcagatatgcccctaagtagttcctcttattttaactcattctgtgtttactacagtaaaccagagtaaaaattcagcagtaataatttt

SEQ ID NO: 216199 - DNA, 386 bp, Homo sapiens
tacactgtagtgtgtctgcatttggtttgttctgaatgcttgcctagactaaaactgcagtctctctctcttacttacagtgtatctctctgttcagatgtttccctctaaccctagctagctccctagggggcctcacctgaacttgattagtttagtggtcaacaaatgaattgagcaggcagctcaaatacctcaaaggcttccaccctctgtcatctgagctgtgtgtggattagagaatacattcagagtcacagcaaattgacgtctccccaggctttcagtttttgccagactctgggatattccacatacatgcctacgttagcagtcaggcagggatctggcaagtttattatcaggctttcatagccctcttgctt

SEQ ID NO: 216200 - DNA, 602 bp, Homo sapiens
cgaccaacacacagggatggtgccaacctgtcactcaatgacaacgcagggctggtgactaactggtttaattcgagaccgtgggtcggaccacttgtctgtgctttgataatggagaatttgagtccctggaaaaagctactcgaccaggttagactagtggctggtagagtgcgaatgacaacatgctataccatcaagatgttcctggatcagtgtactgaccgatctattgcactactgtcagttgtaaccaagattgttgtattcgaggagaaagacacttgcctggaaaacacacggaaagttttttgagtatgggggagccctgcaccaccccattatgatttgaggtctctcctcggatgctcccaaatctggcaacggcggcaaactattgggctgaaagactcaatccagtgtattctggatttaaggctcatgacataatgcccggagcgaatatcacacttccacttactcagatggctgcctctcactgagtgtcaagaggaacagggacgggcatatggtcactccagctttgaacatcctaaagaattatggggtaacaggctacaaatgaatacggtcagttccct

SEQ ID NO: 216201 - DNA, 631 bp, Homo sapiens
ggagacagtcttgctctgttgcccaggctggagtgcagtagtgatcttggctcactgcagcctctgcctcccgggttcaagcgattttcctgtctcaaccttccaagtatctgggattacaggcacgtgccactacacccagctaatttttgtactaagacgaggtttcaccatattggccagtctagtctcaaactcctgacctcaggtgatatgcccgcctctgactcccaaagtgctgggattacaggcatgagctacggagcccggcctagaagtggagtcttagaaggagtgaccatgatatgtttctactgagtagaagggggaagggaggacataacctttgcatgatatagtgaaatgcagagctggaaagaactattaagatttgagtgaaacttttgccccctgtgttgaatgagttaactttcagtctgtaaaataaacaggaagaactgggaagtacactgtatcaattgctaacactgaataacctgcgctgcctgttttttcagcttctgctcccagaccacagaccagtggtggaagaagttacagatccctgtaagccactttgctcctggcctttgtacaactatctttcatcatttcttttattcatcattag

SEQ ID NO: 216202 - DNA, 310 bp, Homo sapiens
ttttttttctctttaaagcaaatattagttgggatagttctaaactgtcagagatattcaaataatgttgtagaaagagatcacagtgttcttctttattgctaccagatctgtaccctgagactttttatataaacagcgtaagagcttttctcaggtagtggaagcttctatgccatccttccttagagtagtaggtatcaacttgtggttggcccctcaagtgatctgttatctataataatgaagatctctcaagctgcttgcatcagtatctcaagtttataaaatattttcggattctatttca

SEQ ID NO: 216203 - DNA, 519 bp, Homo sapiens
agacccccactggtccccgtctacttcttcaatctgatccctctcactttcacccctcatttagttggtgccagccatatcagcctttctattcctatatcgaaccaggttctcatatttgtgttttacaattctctctgagtaaaaaattttcagagggcagatgcctgcctcccagtcattcaactcacaatggacatgtcccctcctcagggatgctttccctggccacccaatctaaataaacttcacattaaaagtgctaaggaaattctcatctgcactgtaacacattttttctacctatctcctgtaatcagaggaaatttttttttttatttacctgtttttagagacagggtctcactatgttgctcaggctggtcttgaactcaggcagttcacctggtctcaaatctcatgagtagctgggactataagcctgtgccaccacactcagcctttaatactttaatattggattaacatgcctcaattagataattttttatactttaa

SEQ ID NO: 216204 - DNA, 479 bp, Homo sapiens
cacatccatctctttaagccaatatctaatttggattattatgccaataaaatctgggtagataaagatatctacgagaccataaattaatgaaaaaaatcctctcatttaaaacaaatgcacatgcgtgtgtgtgctcacaaacacacaaacaagattcttgatcatgtagatttatagcatttgtatattttgttcctccttgtttgcacaagtagagaaggttgtccttaacagtttttcttcaaattttgtttctataaatgaaaaacatgtcggccgggcgcagtggcttactctgtaatcccagcactttggaaggccgagagtgggttgatcacttgaggtcaggagtttgagacatgtgaaacctgtctctactaaaaatacaaatatagtatccgagcttggtggcgggcacctgtaatcccagctactcaggtggctgaggcaggaaaatcgcttgaacccgggaggtg

SEQ ID NO: 216205 - DNA, 424 bp, Homo sapiens
ctgccaccaggtcccacctccaacatgggcaattacaatgcaacatcagatttggtggggatacagatccaaattgtatcacaaaccaacaggtaagaagaaatggggaggtacaggaaaactggccttagctttgtgttaatcccagacaaatttcaagaatggactattaaatgtggtttatgattacttagaaaatggttttttcatgatttattttgaaaaaaattatagacccataggaagttataaaaaatgtataggtcacgaggtcaggagttctagaacagcctggctaacatggtgaaaccctgcctctactaaaaatacaaaaattagctgggtgcctgtaatcccagctacttgggaggctgaggcaggagaattgcttgaacctgggagacagagttcgcggtgaaccgag

SEQ ID NO: 216206 - DNA, 176 bp, Homo sapiens
gatctagagtatcccgtggtcgatcactgtactgcagtgatgaagctgagattcaaattcaaataatgtatctccaaagtccatgctcttttttttttcttttttttgagacagagtctgctctgtcgcccaggctggagtacagtgatcgaccaacagctcagtgcaatgtccgc

SEQ ID NO: 216207 - DNA, 260 bp, Homo sapiens
ccgcctcggcctcccaaagtgctgggattacaggcgtgagccaccgcgcccggcctctttcgctttcttagatgctaaccagatactactcttttgtttttctgttaattcaaaccatgctaatttgtaaatgcagattgcaaaggcccaagtgagaaattggagagatcacagggagcactatgagcatccgtcctgtgtcctgcagcatcaggtgggaaggaagaggaggcagtgtctgggatttctcatgatggtgc

SEQ ID NO: 216208 - DNA, 381 bp, Homo sapiens
gtcctaggtgtaactcaaagggacacagcaggctatgtcacctgggtgcgttttgtgccgtgacaaaaagctaatcaccttcagttataaacagtagctacctcagcatcagtcccctgttttgtgagcagtgggagatattgtcctacaggagcttacagagattggcaactcaaggatccatcactcaaaacagatttcgattgaaaacattgacggaaggatatattttttctatctgcccaggaaagtggctttctggaagggtgcacattgcaggagaggccaggtagattatatcagtaggctcctttccctagcagaccacacaaaatatggggaacaaatttgtttatctgcatatgcatacccgaaaagcca

SEQ ID NO: 216209 - DNA, 543 bp, Homo sapiens
tttcttctgcttggtctacattatggttaaagtatacaactgtatttggaaatttctgtagtaaatttttctattccagaagttctgtgtggttctttcctaatatatagctatgttgtctttcatgctctgaatctttcttctgtcttctctgtatttgatttcaactttctctggcagattgttgagtttccttgccatccatattctgagttctatatctgtcatctcagccgtttcaatctggttaggatccagtgctaggaagtgagtgcagtccattggaggtgatggaacactcttgtctcctgtaccgctggggttcttatgctgccttcctaaccaaggaagctgatgcttcttttattgaatttgcttcatttggatggggatttttttttattttttcccttgaggatatgactctggtgtgtgttgtatataatcaattggctttgtttctgggggctttcagagggccaatattctgtacatgttcctcagtggcaaataaattcatgaggtgactatcacagatgttgt

SEQ ID NO: 216210 - DNA, 487 bp, Homo sapiens
ccctcaatggtggtctccagccaacaagacagccctcaaggatcctgcctcctggtattcccctgctttgtccagtctccttccacagtatatcagggttgctctgtgcctataatagaacgtaacagaagtgatggtatgctacgtctgagattatgtgagagaagatacggggtctctgtcgcttagccctcttgctcaagggaaagcaggtgctgtgtcctgagcagccctatggagaggccatgggggtaattgaactgacatagattctccaaccccagtcagcccttcagatgactgcagccctggctgacagcctgactatgtcttcatgagagactgtgactcagaatcagccggctgagtctctccctgatttctgactgtcagaaactgtatgagatgagaagtgtttgttgttttaaaatgccaagccttggggtgatttgttatacagcaataaatatctaatataccaactcta

SEQ ID NO: 216211 - DNA, 384 bp, Homo sapiens
agagggaactgctctgtatcccacttctgacaccacgtaatataaactaataagaaataaaaccaacgctgtggatcagcaaacaaaagagaagatattttagcccagcatgatggctcatgcctgtaatttcaatactttgggaggcttaggtgggaggatcacatgaacccaggggttagagaccagcctgggcaacatagtaagacattgtctctacaaaaaataaaattagctgggcacggtggcgcatgcctgtagtcccagcttgggaggctgaggtgggaggatcacttgagcctgggaggtggaggttgcaatgagccaagattgtgtcactgtgctccaggctaggtgacagagcaagagaccctgtctcaaaaa

SEQ ID NO: 216212 - DNA, 644 bp, Homo sapiens
gaagggtagagtaaagggatgctgaaagtgaggtggttggggttcagtaaaatagaagatctaagtattgaggaaggagagctaaataagacattagttcagaacacattaaagtaggaaacacaggctaaagcgcttacggctggtaatgtaagggaataaagtggtggtgtttaagggttaaggaaaataggaaatgatggcaacaagcccaaactcgagtttgtcccatccaaaaaaagaaaaaaaaaaagggcagcggctattcaactattgcccattgatgcatgccagaatgtggagcaatattgccaaatcttctggtcttccaagagaaaccagaaatctggattttcatataacatatatttaaatttagaaaacttttttttaacattacacatgacgtggcattatgtgaacccaatcaaatgcacctgagaattgttttagcccatgcactttcaagttgcaaccgttttttgtgacatactcagatagtgtgtaataatggatacacaatgtaggaggaggaacagggagcctgaactgtttggggtaatcatcagattcaaatactttttaacagtaaatggctggaatgggttaggctgaggatacaaaagagatttagaaatgaggga

SEQ ID NO: 216213 - DNA, 456 bp, Homo sapiens
cctgtttgcagatgacatgattgtatatttagaaaaccccatcatctcagccgaatatctccttaagctgatatgcaacatcagcaaagtctcaggatacaaggtatataaaaatcaattgctttcctatataccagcaatggacaagtggaatttgcaattaaaaacataacaccatttacattactatccccccaaatgaaataattaggtataaatctaacaaaatatgttagatctatatgaggaaagatctatatgaggaaaactagaaaactgattaaagaaatcagaaaaaaatacagatcttttgtattcattggtaggaatactcagtattgtcacaatgtcaatctttaacttgatttgtacaatcaatataatcccaatcaaaatcagagcaagttattttgtggatattgacgcactaattctaaagttcatatggagagaata

SEQ ID NO: 216214 - DNA, 366 bp, Homo sapiens
aatgctcagcatttctcatctatacaagaggcctccctagggcagagagggcaaactagaagaagggttgtggggcagagtggaaaggagaacaggggtatgaatagccaaacgaattaagaagttaaagagccagggagttggcttatttgtctgcaagtcctagacctaactgtacccattcctgcctaaagcaaggtactttgcctctctgagcctgagttggctcacctagaggctggaaataagtccctgcaggtagaatgcacagcctgagtcaggtaacagcctgagactggaaccctatgtgggaaaggtgccaggtgaagccaagacactattgtttttcctgttataggcagtagt

SEQ ID NO: 216215 - DNA, 482 bp, Homo sapiens
aggtaccctgcaaggtctggtgtcctggggaactttccttgcggccaacccaatgacccaggagtctacactcaagtctgcaagttcaccaagtggataaatgacaccatgaaaaagcatcgctaacgccacactgagttaattaactgtgtgcttccaacagaaaatgcacaggagtgaggacgccgatgacctatgaagtcaaatttgactttacctttcctcaaagatatatttaaacctcatgccctgttgataaaccaatcaaattggtaaagacctaaaaccaaaacaaataaagaaacacaaaaccctcagtgctggagaagagtcagtgagaccagcactctcaaacactggaactggacgttcgtacagtctttacggaagacacttggtcaacgtacaccgagacccttattcaccacctttgacccagtaactctaatcttaggaagaacctactgaaacaaaaaaaatcc

SEQ ID NO: 216216 - DNA, 496 bp, Homo sapiens
ggaacatatgaattaggacagtgcttggcatatagtaagttttaaaaaggtatctatcattgtctttgccatcatcatcatcattatagattcttgacacctgtggaatatatatagcccatgaaatgacaaataaggaatgcttatattggctcctaaatttctccaaatgacatatttcagctatagaatccagtgttttctgtatatatcctccttatgccacaagttaaccagtagctggcagtctccgagtccctctatctttccagccttctgatcctcaccctatcccaagctgagaccttggcccagagcctcagcctggcagtaggcatgattcagatttgttcctcagcaaaactgccagttatcaccccatgggctcactccatctgcagtcattgaagccaagaaagttgaatccgggaatgccagaaggtccactactggtttctcaaggtgtgtttcacaggatgctggttctgttgagtga

SEQ ID NO: 216217 - DNA, 470 bp, Homo sapiens
ggaaggcacagggtatgacacactggtgaccttataactgtaaggagtgtggataagtatttattagtccttgtgtgttttagatacatgaaagaatttactcaaaaggaaactctatgaatgtaaagaatgtggtaaaacctgtgtagtttcagtttctcttgaataaagtcatttcctggtattctcaggggattggttccagcaccccttgagaatatataattttgctcaagtgctttacagaaaagtgtatttgcctataactaggcaatcctgtatactttaaatcatctctagattacttataatacctaatgcattgtaaatgctatgaagacaactgttttattgtatttagggaagtatgacaagaaaaaacatctgtacatattcagtacagacacaaccaccatacggctacctacctagtacacatcatctacaatataacattttctttttaaaaa

SEQ ID NO: 216218 - DNA, 710 bp, Homo sapiens
  misc_feature (710)..(710): n is a, c, g, or t
ggtcaggctggggcttatggcttgttctgacagcaatgagaaacatttaaaattctagttagctgggtgtggtatctcccagccataatcccagcactttgggattacaggcgtgagccaccacacccgcctgtaatttatttacttatcttttttatcagagacaggttttcaccatgttgcccaggctgatctcaaatacctgacctcaagtgatctgcccgcctcagcctcccaaagtgctgggattacaggcatgagctaccacgcccagcaagactctgactttctaactcactcccagtgatagctagtatactgctgctccccagaccccactttgagtagccaaagattaggatattgtcctaaattcaaggcatctactacaatataatattgaagtagaaagagaaaatacaccaaaaacatggggggccagatacagtggctcacaccagtaatctcagcactttgagaggctgaggtgggaggactgcttgaggccaagagtccgagattgctgtaagccatgattgcaccactgtactccagcctgtgtgacagagtgagactccatctcaaacataataaacgattatattaataatacagacataccacttataagcatagaggcattcacataagcatagagggatatttgagaaaccccaattacaccgaagtagccagttggcggacacttn

SEQ ID NO: 216219 - DNA, 577 bp, Homo sapiens
gagaatgagtgcccagtgaagtgcgaagccccttataaaaccatcagatctcatgggaactaactcactatcacgagaacaggatatgggaaatcgctcctgtaattcaattatttccacctggcccatcccatgacatataaggattatgggaactacaattcaagatgagatttgggtggggacacaacaaaaccatatcaagactcatagccatacaactgtggtggtcttggataagatccagaagaattctctggattgtcaggccaagactcttgtactttttccttactttctttcaaataatggagtatctctgtgctagagctgcatgcaaatggtgttgggggacaaaagcacccatgtgtccagcaccactgggactttgctgtttcagacctgaagccaacacttcactgggtcttgcccaaggcccactgtaaccactacctgtctactacttatagtcattcaaggtttcagggctctacaatcagcaatcagcaggtggcaaagccaccgatgtttgtatctctctttttagagcagtgagttcccccaggacctgagtggg

SEQ ID NO: 216220 - DNA, 583 bp, Homo sapiens
ctgaaacaaatgtgtatttcttcttgtgccacaaatcttttaaaataaagtgaatatatttttacaaataagcacaaagaataaacctataatagtactgaaaaaagaaaatgaagccttcaggagcaattttgagaagcttctgaaggttagaaatttttaaatagagaaaccaagagcacagaaaccatacagaagaaaatgaagtcaggaggttcatggtcaccagcgtgttctatgcatggctaacttggatataccaaagatacttctaactcaacatgtttaactagaacttagcatcttcccataaacatatttctttcatttgtggttacttttcttggttgtggcagtattatccacctagtcactgaagccaaatctttgaccctcatctttgcttttactctcttctcacatacatgcattgcttcatgctctattgatgcaatcttttaaactattcctcaaaaatacctgctcttcccccagttctgtttcattactttagttcaaggcaacgtgttctgttgcctagagtatgacaatgtcctccaattcagtctcccctaccttcatg

SEQ ID NO: 216221 - DNA, 423 bp, Homo sapiens
ctagaaagtcttcctgtagaggcatttttaagaagcattatgataggcattgcctctggaaagcaggcatgaatagatggctggggtctatcatgagagagaccgttctccatatatcactttgtaccttcatatgttgccttttgttttgttttggtttttttttgagacaggaccttgctctgtcactcaggctagagtgcagtggcatgatcatagctcactataaccttgaactcctgggctcaagtgatcctctttcacagctccccgagtagttgggattacaggcatgcacccccatgcctggctgtatgttgctattgtgtattttaaaaacctaatcctgactgtgctggtagtcgcatgaatctgtgcacatacgtgcaaacaagtacatgtaaaactggtgaaatctgaata

SEQ ID NO: 216222 - DNA, 493 bp, Homo sapiens
ctttgagcttacattttgtggggagacagacattgatcaagtaaacacaagcatgatagctgttgtgaaatagacacaaaaacacacagggtgttgcacaagcacacaatgggtgccctcacctagtctgggggccaggaaaggatctctgagataggtgaagatgaagggggtttttagagtatcattcttctttgttgaactctcacgtgccaaatactctgctttgcaattagcagatgctagattcatatttggtgaccaactagcaagtgaggaagatctagcaggatgagaaccagtgaaaatacagcccagtccctgatgggactaattcctccttaatcctttgcttttgcctttttttcctgccaaaattatataaagatttgcatccatcttttatctttatttaagtccattttgttcaaagttttcaatgcctggtaaaccaaaagtgaattaaacattaacatattagtttacattgcta

SEQ ID NO: 216223 - DNA, 431 bp, Homo sapiens
atctatgaatggatgcaatggaaactgtgaggtaaatggtccaaggggcatagtcctgcaaactggagctttgtctataataaacactgtatggttgaaagtatgaagattcatcttacaatgcagagagatagacacaatatttaaactactattacacaaataatttagataaaagaaaatttaataaaatatgccttagaagtttccatgctttattacctgtagaagaacataatgaaacatccctcactatatttagcttactgctctcccaactctggaaaaatagcctcactctggaaaaataactatcaaaccatggttttatactaaaattttaaattatgaaatgagcgtcaattttcattccaaaacagagtatgagatttagcagatttgttgactcaaaaataaagaaaagatgtaaa

SEQ ID NO: 216224 - DNA, 492 bp, Homo sapiens
ggagaatcatttgaacccgggaggtggaggttgcagtgagctgagacactccagtctgggcgacagagcaagtctccatctcaaaaaaaaaaaaaaaaaaaaatcatgacctttattatctcactctttacatgggtcaggaattcagaaaaagccatagtgcctgttatgaccttgtcttagaaagtgtacagcatcactcactaagtccagccaacactcaaggggaggggaagagtgtcagaaaagagtttccagacatatgtttgtgtatgtgtgtttctgttggacataaatattttattgggctttagatttcgttccgcttcctgggtcatcaaaaatatgtcagctaatggcttttaaaaatacatggcagtgttcttgtacttgaaggcgtttagtcatatttcatatctacaaattctttaactagttctttcaatccagaaagtcatttcatgtatatgaatgtgtttatggatccttatg

SEQ ID NO: 216225 - DNA, 256 bp, Homo sapiens
gtaaatatctcgcttaattttagattccttggggaactaagagttaagtaaaacatgctccaattttcttaggtttatttttaagtatttttgttttagctttttttttctctgatcatgggagtacattttcgctcaaacacttcaagaacaaatgctattttaaaacttagaactctggaatgatcagtattaaaaagttgtgagtcaaaaggaccttgacaaaaccttaagagtgtggctggaaatggaaatg

SEQ ID NO: 216226 - DNA, 254 bp, Homo sapiens
cattcctccttggaataactccacctcctcctacttgtctagtctggtgaaatttctcttatccttcaaggcgtagcttaaaggccagcttctctgaaaaaccgttcctattgcctcttcctctgattggagtctgctctcctgagcttttcttgctacttaacagtgctactccaaatgtaccagtaagtctataattatttttcttacatcttatttgttacagcttcacatttagtaagtcttaataaatg

SEQ ID NO: 216227 - DNA, 509 bp, Homo sapiens
ggattctaaaaggacccctacaacttgaatgataattttaacttctgactcatttgcctgatagtcttgccagagctttgattgtcattttagttagatttagtgttggccatttgagtaagctcctatgcagctgtggcaaatgttcatttccatgaagccataggcatgttgtgagtataactatctacaagaactagtgagagatcatcacattggtatccccagacactaaagaataacagcagcttttaaaagcaaataaaaataataagcaatataggctgccagtttgtctcaagaaagaaaatgaaaatgagtttgtaataagggaaaataaaattttaatctgattctaaaaataatctgctgtaagtagatatttaaaatttaaaataaataagataaaaaattaaaaagcaaaagtaaaataaatattaaggaagaaatgtcaagagtagtctctctcttctttttcattctcttttcctttttcttctttgctttct

SEQ ID NO: 216228 - DNA, 145 bp, Homo sapiens
aacccttcaattgcttcacaccaccttcaagacaaagttcaaatgcatggtaaacacagtccttcttcctctggcttctctcaccagtccccattcacatgctaacctccagctaccctaaactacttacagttctccaaacaaa

SEQ ID NO: 216229 - DNA, 160 bp, Homo sapiens
gtgccttctatttgttccacttgttctgtttctttttctttctttcctttctctggatttatcattgcatttgcactattttcccctctactgatttggagtttattcttttatcttttttttttttttaagaaacggcatctccctctgtcgcccaggc

SEQ ID NO: 216230 - DNA, 403 bp, Homo sapiens
cctgagtagttgggactataggcacatgccactagcctgatcatttctactttggtctttgctactacatactacgttctctttctgtttttcaccaaagaaagtagtctcttttccttgagctctcatggctcttttgttagtacttcttatattacccatcacatctacttgtattatagttattttgtatagtttatcttcctgattaaattataagctctgtggaggcaggaatcagctcttctttttctccatctccttcagagtccctaggactatatttcatacagagtaagtgcctagtacatgttttttgcactgaattgaccatgagtacatgaattccatagtctaaagttcacccctttgttgactaccttactttctctttcacagaaaa

SEQ ID NO: 216231 - DNA, 497 bp, Homo sapiens
attcagtgaataaaaatagagtttcatgtccgtttttaggtgcatagcaaggctgtgctgggagctgttcttccgcccagtcttatatgaaccagaatgttacttagtgtcgagcacctcctaggtaacaacacaaaggagaatgaggccaggagcagaaccaggccataatggccaggcagatgctgggggaggagacgctgcgtctttccctgagccttcctggtattttctttccttgaggagtagcagctacactctctgtctttggccccagcctcacaaaagttagccaggggacctaaaatgcaggggagatgcggttccctagtgggagagctctatgacatctctcagggtgagcatctccactgttgggagcaccgtctagagagccagagctcctgatggacttgcaagatgtgtaccagggcgccaggatcagggtagaggcatggagaggtgccaagtcttgaaagtaggggtgtcgatcagcc

SEQ ID NO: 216232 - DNA, 434 bp, Homo sapiens
agcttcttcccttcggtccgaaacccctccgagagggctgagtcggggacagacaggtggagtttccagagcctgcaccacccgggacactgctggcagctctctaggccctagagtctgagctgactccgactttggctcaccgctctgcggccggacgattgtatgccattcaaaaagtcgggagttgaaagacagcacgcagcacctttgtccccctccccgttttcccggcgcgctgaaaagaaatggggctgggacttaggggcgggggagggcttccaactcggtttctctatctcctccaccaccttagagcccaccctccccaatgagcgttttgttctacccagccacgtgtttgtcggatttttgtttttgtgatttttttttcccatggaacaacaagaattaaagtactaggagctattaaa

SEQ ID NO: 216233 - DNA, 416 bp, Homo sapiens
cctgagaaagggaacataatatgcaattaaaattaaggacgttctatttgaggggacctgttacatgaaattacagcagaaggcaattggggaatattattattttgcatatttaggaatcaggataattagaagatgccaaacacgtagggccaactggtaagggtttgggaagggaagagggaaaaagacctcaccttgtgggatgtgggcatcagtgggagggtagctgtgcatgttatgtacagaaaatagggtgcttggagctattgtaaatgatgaggggagtcctaagggctgtgattgtggagaagaaacttagaccctcaactgaacaacatgagtcacattcctgcccctccattttgttgttacatcatttgctctttccaaatctttgatttcttcctcatctg

SEQ ID NO: 216234 - DNA, 398 bp, Homo sapiens
gccagctaaaatcccaaagcatgtttaccatccatgggcacaaccccaccaacatttgtttagttcttcctagtatgcagaacacacacacacacacacacacacttctgtgacacgtggcctgtcaggactaacacctagaacttatgcatctctgaaatcttaactaaaaagctctacaacctcttaccatcccaaacctttatctcttactcccaaatagctgtgctttgagcctttgagcctttgcgtttccctggtcctcctattttctccctcccagtcttgcccatcctcgttccatctggagccagcctagatattaaggttcatttcttcaatcattctcttcctaacacctttaactcgttgttcccttgcccttctgtcctcgactt

SEQ ID NO: 216235 - DNA, 425 bp, Homo sapiens
taaagttgaagaaattagaaaataaaaagatagatgatagaaaagataagaaaattatataatctatctaggatcccaacatcttattactaaaagtcccatacagaaaaaggagggaaagaaattatcaaagaaataacacatgaggctgggcactgtggctcatgcctgtaatcccagcactttgggaggatccaggagttcgagaccagcctaggcaacatagtaagacttggtctctaaaaaaaaagtaaataaataaaaaaataaataaattagctaggcatggtggtatgtaactgtagtcccagctattccagaggctaaggagggaggattgcataagcttgagaggtcgaggctgcagtaagtcatgattctgccactaccctccatcctgggtgacaaaaagagaccctgtctca

SEQ ID NO: 216236 - DNA, 577 bp, Homo sapiens
atacttaccctgtcatacgctttcacttccagtcttagttcccatgttattagcctaaacagagcaccatgaaagcagaaaacctgttctccaataattacaacttatgtctgggttacctgctgtctccatgccatggtgtcccatctttcaacacgagagagagaaagctggactctttctcctgcctgtattcaaacccataagaggcatcagctttaacatttcaagctagcgtttcaggaagagtaaattcatcttcaaccacacacctagtcattttcaaccacacacctagtcattatgttgacatctcatttcctgctctctcatgacactggtttttctctatcagtgatttctgacaggaacagtgaactagcatgtgtggaaggtgagttcctgggggaaccaattttgttagcaatttctctttctgccagctgtagcttccaaacattgcctatatttttgcttttatttctatatctattttatataaaacaacaaaatatatacatcaataagtatataaatacatatacacatatatatttaacagctttattgagatata

SEQ ID NO: 216237 - DNA, 170 bp, Homo sapiens
caggacacctggggtggggaagggagcacagaacccagacaccagcctggacacagacacctgggaaaatctcctattccttggaaagttagagtctctgaggggggagcagggacttctggccctgacctaagtggaggccgagggactggaatcagagcctcaaacac

SEQ ID NO: 216238 - DNA, 724 bp, Homo sapiens
tgaagtggctcacgcctgtaatcccagcatttcgggaggccaaggtggacagatcacttgaggtcaggagtttgagaccagcctggccaacatggtgaaaccccatctctactaaaaatacaaaaaattaactgggtgtggtggcaggcacctaaaataccagctactctggaggctgaggcaggagaatctcttgaacctgggaggcaaaggttgtggtgagccaagatcacgccattgcactccagcctgggcaacaagagcgaaactccgtctcaaaaaataaataaataaaattaaaaaaataaaataaataagtaatacagaatggccaatgtgggcttcacagggaggacaaggatttttttggtaaggggctttttggaacccctcaaatcaactgcagggcccttcctgggcatcatgctacacaagtaaaagtccctctacgttccaggattgttggctccctgggcatctggttggggcaaaaagaaagatactgattttaaagtagaattatcttataagtaagaattctaggctgggcacagtggctcacgtctgtaatcccagcactttgggaggccaagaccgcgcgatcacgaggtcaggagatcgagatcatcctggctaacatggtgaccccatctctactaaaaatacaaaaaaaattagccgggcgtggtggcgggcacctgtagtcccagctactcaggaggct

SEQ ID NO: 216239 - DNA, 356 bp, Homo sapiens
cgagaggatcgcttgagcccagggagtttgacctgcagtgaactatgattgtgtcactgtagacctcttcctcttcagctgcctcaaaaaacgaacaaacaaacaaaatagccagatctcctctctacagaatttttttttttaattagccagtggtggtaatgtacctgtggtcctagctacttgagaggctgaggtgggagaatcacttgagcccaggagttcaaggctgcagtaagctatgatcaggctactgtactccagcctgggtaacagaatgagaccttgtcgaaaaacaaactacaaccctatgaagtattggctgggtgctctggctcacacctataatcccaaca

SEQ ID NO: 216240 - DNA, 495 bp, Homo sapiens
tgtttcatttcaattttgtcttatggttttttgccccaacatggaatctctcaaaagtttccatggactccaagtttaagatgttgggatattgaacagttctctctgctcagcagagggtagggaataacattatcacttgaatgttctttgcttaacccttagacttggttccttctatgttcagagtctcatcatcaggggaaggaaagggagtgagggtcagggataggggtcttggtgatgcatcctctcccgagccacagaaccaaagagtttatagaggaatttacagcctcgttttcatgtgattgctacatcctaacagggcttcatttgggggtggggggaaacatgtaaaaataattgccagtttctacttttctattagctttttaaaaatcagctgtaaagttgcatttctaaagaaagatatatataatatataaaatacatatatagatcaacttgacattggtgataaccaaaattatt

SEQ ID NO: 216241 - DNA, 580 bp, Homo sapiens
ggttgagcttcagtcatttagtttttattaaagttacatattaaaatagatcctgagaaatgcgaatactaatgtaacttagtggttttaagaacagtgatactatacgatatataggctgttatcatgtagatgcagagaaataacattatcaaaggtatcttcatgatgcaatgtatattgaatgtgaaattaattcctgcagaataaatgctgtaggaataactaaggtccttttgctaaggtttatacagtctggcatgccctggggaatctagttccctccgaagtaactaaaaacagacgaactttaactgaaaacatatcatctgaaagaatttcgttaatgactttctccttattacttagagtttaaatttggtaaatcttctgatgcttttctttccttcccatcccccaggaatagcaactgaaatccagacaagcattcagtatagaaaactacgtttctgagggaccattacattttattttgctttgctcccttgttggagttgtaagcaacctattaaaaagtttttgtttttaaataaaacttttttcctaaagaaggtttaaa

SEQ ID NO: 216242 - DNA, 693 bp, Homo sapiens
catggtggctcatgcctgtaatcccagcattttgggaggtcgaggcaggcagatcacctaaggtcaggagttcaagaccagcctgaccaacatggagaaactcccccgtctctactaaaaatacaaaaaaatagtcgggcgtggtggtgcatgcctgtaatcccagctactcggaaggctgaggcaggagactcacttaaacccaagaggcggaggttgcagtgagccaagatcacgccattgcactccagactgggcaacaagagtgaaactctgtctcaaaaaaaaggaaaagaaaaaagaaaggttagattctcattactttccacccagtcttcactctcttcctttcatgacatactagaaatagctatcctaaaacacaactctatcatgtcactcctttatcagaacaccttcaaaaaggctccattccccaccaatcaacccttcaagattcagaccaaatgcctccttctccaagcaaccttgtgtaatctccttcccctaaggagaggtcattgcttcctcctctgaacttcagcagtacctcacttgacccttaccaatttcagcctcctatcacaagtacctgtactgacatacaagcatcgtcaccctactggaagacaagcgccttaggagaaggttcaatgtctaattgaactgtgagtctcccacaaattctggtga

SEQ ID NO: 216243 - DNA, 740 bp, Homo sapiens
ctttgtataaacaagttccctaaaagattcttgcattaatagctaggaaccatgttttgagaaacactaccctggaagtttataatttctctgttagctctggtgttggtgaactgtaatcgggatggagtataagcaaaatgataaaaaatgtcaaaaatattaaaagtgtcttaagaagaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaataaaaaaaaaaaaaatataaaaaaaacataaaaaaaaaaaaaaatttggggcgccttttccaccagtgtttttttaatccgggcgctttttattccggcccccatattggccctctttgggcaatatccccttttgggggggggtataaaaaaattggcgggcgttttaaaaacacggtgtggggggaaaaacctgggggttcccccatattaaagccttgggagaaaaaccccttttttggcggcgtgtgttaataaagaagggcgccccccacaggtgtcttttatcaaaagggggccccctcttgggggggaaaataaaaatggcggcgcttttattttttaaaaataacgcccggttaaatttttgtagaaacaaccctctttttttaacaaacagcgtcgcgcagagtcgggatctctcttttatacccccctcccgatcggggttgggtttcttcccc

SEQ ID NO: 216244 - DNA, 111 bp, Homo sapiens
aatctatagattaagcagtggaatccaaaacttccactctcaccctttcctccctccctgtcaccctcacactaatagtggcagattccaatgccccaggctccagcggac

SEQ ID NO: 216245 - DNA, 336 bp, Homo sapiens
ctttgccacagcacatgggagacaggaagtcagagctgccaacaaatccccaccttgttaattttatcagagccacggataatctgaaaacaggaaagatgctataaatggtggttctgtttgtggatccatcttgcagtcggttttaccagcatctacccagccagaggccaggagagggcagggcttgagatatctctaaattcctcttttcctttgctttctaagtcctcatcctgctgggcttgcagcctgtcttggggtcccttcagcctccccccattccacctgtaggccaagtggtgctgagccttccactatgggctgtggtcactc

SEQ ID NO: 216246 - DNA, 381 bp, Homo sapiens
ttttgagacagagtctcgctctgtcactctgtcccactgcatcaggctgggatgcagtggtgcaatcgatctcgcctcactgcaacctctgcctcccaggttcgagcaattctcttgcctcagcctcttgagtagctgggattacaggtgcccgccaccacaccaggctaatttttgtatttttagtagagacagggtttcaccatattggccaggctggtctcaaactcctgacctcaagtgacccacctgccttggcctcccaaagtgctggaattacaggcatgagcaccgcggctggccctgaaccctgccagttctaaagaatttgaacttccaattacttctttcttttctgagactcccttctgtcgtcttctc

SEQ ID NO: 216247 - DNA, 559 bp, Homo sapiens
aaaggcttaaaaagaaagccaaaccactgtacttatatttgcagaagcaaatgaagtaaactggcaaaaggaacttggattgcaggaaagtcaaagtaatatcaaatcctaaattcagttgatctgggccgagcatggtggctcatgcctgtaatcccaccactttgggtggccgaggggggcagattacttgggctcaggagtcggagaccagcctgggcaacatggcgagatcctgtctctgcaaaatatacaaaaattagctgggtgtggtgtcagatgcctgtagtcccagctacttgtgaggctgaggtgggaggatcgtttgagcctgcaagatggaggttgcagtgagctcagatggtgccactgcactccagcctgggtgacagagtcagaccctatctcaaaaaaataaaaaataaataaaaaatcagttgaactatatggaaacttctgtacctgtgtcaacggtgcatcttatctaatactatatgatactgtaatctaatattatctctgataattcaaaaatgctaataaactctgctcaaatgtg

SEQ ID NO: 216248 - DNA, 926 bp, Homo sapiens
aaaggcttaaaaagaaagccaaaccactgtacttatatttgcagaagcaaatgaagtaaactggcaaaaggaacttggattgcaggaaagtcaaagtaatatcaaatcctaaattcagttgatctgggccgagcatggtggctcatgcctgtaatcccaccactttgggtggccgaggggggcagattacttgggctcaggagtcggagaccagcctgggcaacatggcgagatcctgtctctgcaaaatatacaaaaattagctgggtgtggtgtcagatgcctgtagtcccagctacttgtgaggctgaggtgggaggatcgtttgagcctgcaagatggaggttgcagtgagctcagatggtgccactgcactccagcctgggtgacagagtcagaccctatctcaaaaaaataaaaaataaataaaaaatcagttgaactatatggaaacttctgtacctgtgtcaacggtgcatcttatctaatactatatgatactgtaatctaatattatctctgataattcaaaaatgctaataaactctgctcaaatgtgttagtttttcatacttcatcctatgccaggaaatgttttgaacttcaccaaagctttgctaatgtctccctaccataaggctgtcagctgaaaatagcaaattactgcccgactcccattgaccataatatccattccgcatgatcctagttctttaatttactggaagtctttactgttttgtggtacctactaatcagagactcaaagcctatagatacagaaatgtaacagtaaatctcaacctaaggctaatttgcaaataaaattacaaaatcaacttagaacccaaagactcactaagtgatatgcttttgatgttttgaaggttttaaaaggttataaattccattaaattttagcatac

SEQ ID NO: 216249 - DNA, 819 bp, Homo sapiens
gtatcctcagaggcagggggctgccacctttgcactaagaaggaattactgatttctaccatttgagaaaaggagtgttgaccacatggaactccgaataggttcatgcacatggaacaaagccctttaggagaaaagcccgttttttgctgtctgcctgatactggatggttgagaaacaatcgtggtgggcagtcacgccaacacttgtgcgggcctaggacacaggaaggtttagccctggcctacagggagggtgggcaagcacagcaatcttgtcccccaaaagaacatcagtggccgctggtgccaagacccacgggaaggttagagctctgggttacatttgtggagagagacacagacagcggcagagacagagacgtagtaatccaggctgtgtggcataagaagataaagcggccccccagcccggggcccctcccatggacctcatggtaccgagcctccattttctcatctgttcagtgaggatgaagcctcatctcccagggtttttgcaaagacagggagactggccgggcgccgtggcttacgcctataatcccagcaccttgggaggccgaggcaggcggatcacaaggtcaggagtttgagaccagcctaaccaacatggtgaaaccccgtctctactaaaaatacaaaaattaggcaggcgtggtggcacgcgcctgtaatcccagctactcaggaggctgaggcaggagaatcacttgaacccaggaggcagaggttgcagtgagccgagattgcgccactgcactccagcctgggtgacagagcaagactctcaaaaaa

SEQ ID NO: 216250 - DNA, 467 bp, Homo sapiens
gaattgtgctatgagacagcagtgatgcggaagcaagcatggagccggcctttatggtgaccggatttcggtcctgattttgccactagtgacttggatgggttttaagtcacttccaaccttcccagaccttccttgctttacttacaaaagggtgtagcctttatgatctctgaggcaaggtcccatttaatggtttgggtacatacccggtgacaatttaatgtcacgatgcataggtatgcacagactgatgggatgtctcttccatgtcttgattctccaaaactcacagagtaatgaataacaatttcatagtttagaaaactccgacataggaaatgtcctgtggaatgtgtgaaggccagtgtaatggaattgattctcaaagggacattaatgacacaatggattcagacgaacctggttccattcttacgggttacattacacatggttaaataaaa

SEQ ID NO: 216251 - DNA, 517 bp, Homo sapiens
agttgagcatcccctaatctaaaaatccaaaatgccccaaaatctgaaactttttgatcaccagcatgaagccagcagtctttcaatacgtgtgtatgaatggcaaactgctctcctaccgccgggaatttttaaaaccctatttaaatgcttgtgcatgctgtgagtggtacacatggctgaggttatgatctgttaaaatatgtactagtttgaaatgttttagtgtactcatattaataaaattgccttctatagaaaaaatgaactaaaattatagtgcagattgataaaaattcatttgatattagtatttcatctgatttaaatagaattagaacaagtaaggttatgcctttaacattcttcaagaattttttggcaggcaaatcatagctctttcagaactggaaaacatgctgtaagcagaatctaattggtgaggaaacagtgatttcaaaacaaaattttaaaatggaaaagataccacacaccatcatagtttcatctcaaactg

SEQ ID NO: 216252 - DNA, 403 bp, Homo sapiens
cacagtggctcacgtttgtaatcccagcactttgggaggcccaggcaggcggatcccgaggtcaggagtataagaccagcctggccaacacagtgaaaccccgtttctactaaaagtacacaaattagctgggcatggtggcgggcacctgtaatcccagctactcggaaggctgaagcaggagaatcgcttgaaccgggaggtggcagttgcagtgagctgagattgtgccattgcactccagcttgggcaacagagctagactccttctcaaaaacaaacaaacaaacagacaaaaaatattagcttgtatgtagtcacgcattattataaccaatattaatactgggtcttaaacttaattaggccttcagatttgaaaatctcaatatttctttctact

SEQ ID NO: 216253 - DNA, 823 bp, Homo sapiens
aactcaattaatttggctagtgtggaatcattatttgaataaatactccaaatgtatttctatgtaaatgtgttcattttactgagtaaatcaaattcaacataatatatttggtaacgtgtctctaacagataaggattgctttttaatataatcacaagtcacggtcagatctgacaaagtaacagtttcttacattgtctaatatccagactgtgttcatattgtccctatcatctcgaagtgttgtgcatttggagtatttcaatcgggatccaaaaagatccatgcattgctttggttactatgtctcttcattcttttgcaatcttaacacgtctccctttcctccccttttctcttttatgccatttatttgttgaagaagccctggtgttttgtcttgtagaaatctcctacattctggatttgtccagctgctgtcttgtgatgatgtttaatatgttcttatagccaccttatatcctctaaacaagtaattagagctctactgcttgattagattcgattttttttttttttgcagaatatatcatagaggccagatgcaatggctcacacctataatcccagcactttgggaggcccaggcaggtgatcacttgagcccaagagtttgagaccagcctgggcaacatggcaagaccccatctcttaaaaaaaaaaaattagccagacggggtggcagacacctgtggttccactgtcgttccagctacttgggaggctgaggtgggaggatctcttgagcccaggaggtcgaggctgcagtgagccatgttcatgccactgcacttcagcc

SEQ ID NO: 216254 - DNA, 917 bp, Homo sapiens
tgtgtcaccaagttttatatacacttagattcacttttattgctttttttcttaatggtttaattgtattttaattatataacacatttacagtggttccgacatcaaaactataaataaagacagagaagtgtgtccatttctgccctctcctccactctctccccatcccctaggcgtagtcatttctttattagtccttactttatttttcaaagttacgtaataaatgtctatgtttctaagctatctttagatttgtaaaagggctaaaatgttacttttcttacattgtctaatatccagactgtgttcatattgtccctatcatctcgaagtgttgtgcatttggagtatttcaatcgggatccaaaaagatccatgcattgctttggttactatgtctcttcattcttttgcaatcttaacacgtctccctttcctccccttttctcttttatgccatttatttgttgaagaagccctggtgttttgtcttgtagaaatctcctacattctggatttgtccagctgctgtcttgtgatgatgtttaatatgttcttatagccaccttatatcctctaaacaagtaattagagctctactgcttgattagattcgattttttttttttttgcagaatatatcatagaggccagatgcaatggctcacacctataatcccagcactttgggaggcccaggcaggtgatcacttgagcccaagagtttgagaccagcctgggcaacatggcaagaccccatctcttaaaaaaaaaaaattagccagacggggtggcagacacctgtggttccactgtcgttccagctacttgggaggctgaggtgggaggatctcttgagcccaggaggtcgaggctgcagtgagccatgttcatgccactgcacttcagcc

SEQ ID NO: 216255 - DNA, 504 bp, Homo sapiens
cagtcggctcctgtgcatgagcgttttgaaggacttcggcaagaagccaaagtgacatcattgctgctgttatcagatgggatgaagtccacatgtaagggccctggatttgggctgcttgggtttggatgggggaggggcaggaatctcaccaagagtcttttcttgatacctgagtccacctgacaccgagtgcgtgctcagtaaatatttgtggatatgacccactgaccttggaaatcagctgaatttcagaactgtccgttcattctaaagatagctctttgattctttcactgattaatgagtcaggctccgtctttctaccacctcctgaaatgcccacgctcactaagagtctgcgtgctgcactgccagacacacttcatttggcaaaacttaggttatgagctcacaatgtcaattcaggaaacgcaagatgtatttatctaagagatcttttgcttagactctgtgctaacggtgattctcccaccttgggat

SEQ ID NO: 216256 - DNA, 88 bp, Homo sapiens
ggtcaggaatcttacctctgttctgtattcctggttccccatgtaaagtctggtgttctttgtcctccgataatatttttgtgaccct

SEQ ID NO: 216257 - DNA, 353 bp, Homo sapiens
ccttttaaatatttttacaagataggttctaaaacattacgtttagagtgatcctatgtgataaaaggtacatcttgagcctagaagttcaaggccagtctgggcaacatattgagaccctgtctttacaaaaaaaaaatttaaaaattagctgggcatggtggtgtgtgcctaactatttgagaggctgaggcaggaagattgcttgagcttgggatgtcgagctatagtgagctatgatggcgtcacggcactccagcttagacaacagagtaagacagcaagactctgtctctgtctctcaaaaacaaatgaaaaaaattaaaaacaacaaataaagaaaaatatatgtg

SEQ ID NO: 216258 - DNA, 528 bp, Homo sapiens
aaagcgtagcagcatcaacccaatttatattttcagcatacacttctgaatccatgatttctcctctctgctgtaagtcaacaagcactaagctatgcatagtggtgaatgccaagagttttaggacttaggatcctccctttaaggaacttggcatctagagagaagacaggtttgctgtatgccagaaaatgcaggctgtatttgacacaatgccctagaatcacctgggagatagtttaaatgcatatcctggcccatcttccagagatgcagtgggtgcagtatgtaaaactcaaccatctgcatttttgaaaagtgccccaggtgaccccggtgcagataattcatcatcaagcaataatatggagataattctatgcaatatacatctatatacagggataatatcaacacatttaacagccaatatggtatgggctattggtcaatcgcaatggagaccttagtgtgggggttgggaattccagaggctctctgctgatattaacccctagctgctactca

SEQ ID NO: 216259 - DNA, 420 bp, Homo sapiens
ccaagaagtttatccggcaccagtctgaccgatatgtcaaaattaagcgtaaccggcggaaacccagaggtattgacaacagggttcgtggaaggttcaagggttagatcttgatgcccaacattgattatgggagcaacaagaaaacaaagcacatgctgcccagtggcttccggaaattcctggtccacacgtcaaggagctggaagtgctgctgttgtgcaacaaatcttactgtgctgagatcgctcacaatgtttcctccaagaaccgcaaagccatcgtggaaaagagctgcccagctggccgtcagagtcaccaaccccaatcccaggctgcgcagcaaagaaaatgagtagacagctcatgtgtatgttttctgtttaaataaaactgtaaaaactgcaaacaacaacaaca

SEQ ID NO: 216260 - DNA, 541 bp, Homo sapiens
agacaatagagaggcttcactcaactttcaggtgaatatctttttagagatctgatgacattagataaaacagcaccattcagtaactgggctcaggctactgtctttaaagtccttgagtcgtgatagagctttgttgtaaccagtgacataacaatgtctattgtgtgaggaagcagcttcccttaaaagaagaaccaaactcagggcactggaaagtttttgctgagagtgtttggaaggaagactctcaggtaaggatagttgaacactggtaatgactgccttcccaggggctcagctttcttttggtgttggtccaactgacttccacggccaccatcatgatgggtgtgtgtcgtgtgtgtgtgtgtgtgtgtgtgtgtgtatttaagtaggagagcagggcaagcggcactgctttcattttagaatcttcaagtgaagtggggaaaaaatctgtttttcatttggctcagctgagaaaagaagggaatttcacaaaaactatataaaatattaatggagaaaggaagagaac

SEQ ID NO: 216261 - DNA, 259 bp, Homo sapiens
agcagttcatttggtgaaatttatctaggatgtgttttggtggttcagttcttagcctcatatatcctgctgtgtcctacaaaatgcacattgggaatttaaagtctgtttaacattctgcttttagagtacgtgagccacatcacttgaactgtgaatgaccatttggtggtcttttaattcctgaggatacttcgttcctttgaaataagaaacaatctttaagaggataatttctttgagaaatagtagtaagtgc

SEQ ID NO: 216262 - DNA, 466 bp, Homo sapiens
caaacatgctgtttttaatacaaagcttcattgtaacctgctaataatccaatgtatgggtcaatttcattttcttctctttgcaatcatctcttgaccagaagattgcttaaatgacttctcaaggtccctgctagactctgcaaagtcatgacaatcagtgcaggtgatgtcatcaaattttaatttaggacatatatccatcacattatttcctatttaaaaacttaaaatgatttcccattagccaaatttcttactgtgccatcaaagctctccccacccacccttcacctccctcctcctcttatttccttttgccttctttccaccaactcctcccctgccccatggggctgctttatgcctgagtgcatctgttcacactgctgccccctcagcttgtgctggttcctctgcatcctgcttcatatgcttggcaaacgcctactcatattttaagcct

SEQ ID NO: 216263 - DNA, 452 bp, Homo sapiens
tggagatggtgggctaacagaacactcaaatcttacaggagtttctcatctcattttctaggttggatgcctcagcgtgcattcccaggactttatgagatgatccactgaaggatttcagcaagaacattctggagtgtcaactgatacgtttttcagtctcagcttgctcactgtttgagtagtgtcacatgtacatgcgtgttattagaggcgaatgcacgtttttgttactgagagagtggccctagagcagatgccagcgaactgcagcccacagcccgaatctagcctgccgcctcttttcatgtggctcacaagctagtcatagtattatattttaatagtgtgggaaaacatcagaagaagaacaatattttgtggaacatgaaaattatatgtttacattttagcatccataaacgtggtttcattagaacacacttctatgg

SEQ ID NO: 216264 - DNA, 615 bp, Homo sapiens
acatcaatttaatcaatttgataacccagctttcctatataatataaggaaagtcatgtctcagatatgtcatcatccattttatagaaaagatcgcagtggttacagtcaagcactcaattataaataatacacatattctctgtagaataggtttaaaagcttctgaaagtataaatatattttctaatcaggagggcagaggaaaaaaatattaatccttactagaccaatctccaagattatccgtaaatagataatccctaaatagattagtttgagagcacatgagccagcaggattgccaaatagaccttgcacatgtattttatctatcatcagtacaaaagtggaagcatcttatggagaaaggttatactcttctgggatacttttctttgaaaagtcaaaatttattattctctcttaaaaaagtaattatggtggaaagatcctgtaagagcagtattaattgaaataaaaataagcaacttgaatatccagtaataggtgattgagttgatatattcataaattggaatcatgcttccattaatgtattcatattttaaggagtgtggaaaatgttcatagtaaactaagactataaaacta

SEQ ID NO: 216265 - DNA, 580 bp, Homo sapiens
agtgagatttggactttagatgatcctggttgattgatataggaatggtgcttctcctgagacaggtaaccacaaatttacttctcaggataatgttttaaagtgggtgttctgtttagtttttaaaaatgtttttagtttttaaaactaagtgggttttgaacttttagtttttttttttaatgtttttagttttcccaggcaagcattttcagtagtttagatgaaaaagaaatttcttagtgatttcattgtctttttcaattatattgttgtcatgccttttatataagatcttttataatccaccacccatctattgttttggatagtcaagaacttgtctttgctgtgaaaatttttctcattaaaaatggctaaaaaatacatactttctctgtttttcaaaaatacggcatagaggttttgtttagttttttcatctgatactggatatgtcaagatgaatctatgaacttcaagcaaaacttattgaagctttggtatatgtgagtaatttgttttagagaactggagcctatagcgatataaaaaaatagcaaatgcaaacattttatat

SEQ ID NO: 216266 - DNA, 224 bp, Homo sapiens
agtgagatttggactttagatgatcctggttgattgatataggaatggtgcttctcctgagacagaggttttgtttagttttttcatctgatactggatatgtcaagatgaatctatgaacttcaagcaaaacttattgaagctttggtatatgtgagtaatttgttttagagaactggagcctatagcgatataaaaaaatagcaaatgcaaacattttatat

SEQ ID NO: 216267 - DNA, 528 bp, Homo sapiens
ggggagtaacaatctcgagagtccaactccccaaacccttcagaattcaccttcttcttctataaaattgggtgggttaatttacttctttgagttgttacagttttcttccctgctgaagaaaacacaagatcccttcatggtataagaagggtcattttgtatttttctgcaaccaagccaagctgggtcatacaaccagctcttaagaaccctgctgaatcccagatgactgagcccttcctacacagctgagatagatagacacttccaggtgaggggatttgggaccctgctgcttctagagccagtcatttacaaaaacaaaaaaaactggctctccttagcttctatatagtttctctagtttactttcccactggatctttcccactggattttaggtataatatttgacaaataggcccttgctggatgttgaattttccttcttcctcttcctttagtatttctgatgcatggtgcatgagatatgagatcatagattcttctggattcctcaagagg

SEQ ID NO: 216268 - DNA, 141 bp, Homo sapiens
agattttagagaaattactctcttctggtttttatggcttctcacaagaatcctgctgtaattgtttttgttcttccatgtgtaatgtttcttttatcactagctgctttcagtctctcctctcctcctccagcccccttt

SEQ ID NO: 216269 - DNA, 478 bp, Homo sapiens
ggcagtctcagtttgaagaaagtggtttcttgagatggaatctgttcctggtgaagatgctgtgaacattgttgaaatggcagtaaaggatttagaatattacataaacttagtagataaagcagctgcagggtttgagaagatagtgtcccaatttttaaagaagaaaaatttgagtaaatttgggtaaaatttacccaaaattacctattgtgggtaaaatgctatcagacagcatcacatcctactgtgaaatctttcatgaaaggaagaatcaatcagtgcagcaaactacaattgttgtcttattttaagaaattgccatagccaccgtaacctgcaacagccaccaccctgatcagtcagcagccatcaacgtcagggccagaccctccaccagcaaaaagattatgacttgctgaaggctcaggtgatccttagcatttgttagcaataaagtacttttaaataagttatg

SEQ ID NO: 216270 - DNA, 351 bp, Homo sapiens
caaagcctattgtctttttcgaacattgatcttgactttgatattcctaacatatcttatataatcactgtgttttcctttcagtgcaatgcatttttaagacactcacaaccccctacctgaaggcaagctcaggtgaaaatcgggcatgataggcgataatgagcaggatttggaatgtctaggaagctaatcttgtctgacacgcagttacacgtgtgatggcgttttgcttccctctttctcttactgaggccgctccattcctgtggattagcctgatttccagccacattttaatcttcaattcagtttgaagattaaaatgaaactgctgttaggggcaaaaaa

SEQ ID NO: 216271 - DNA, 547 bp, Homo sapiens
gggattagactggaccaagtttggactagacttgaactaagtttacagtgaaaccagtttgagaggcaagcgggacgcgtatggaggcggactaggtgtgcagaggcaattagatttaggatttaagaaacctggatctggagtcagaaacacgtagattcaatcctagctctgcttcttacgagccccgtgatcccaggcaagttcattttactgagccttatcagtaaaatgctaatgctaatagaactttgctcacagaggtacggtgaggattaaatgaggaaacacttgtagtgtccagtaactttttgttgtaataattgtagttatagtcacatccttcctagcatcagccatgattataacatattattatatattataataattattaagttagtgctaggaaggagatgaccatatttttatatcttatttaattatataatgttgtttaattacatgttatataattatgattaaggttggtactaggaaggaaataacttgagcccgtttcccccacgtggcatctgttcaccga

SEQ ID NO: 216272 - DNA, 784 bp, Homo sapiens
gctctccaccaccaagtaatccttttgccgattgcactctggctgagaattcggtcacccagctacagggaattctatctgttctattccttcagtgtaaaaagagttgccatcccgtctcatttcccctttgaagttctatttaaatgcatggcaaattctagcaatatcttaagattgatttgggtctggatgggagatggtgggtgttgagactcagaaaccctgactgaacacttctcttttcactctttctgggtaagtactgtattttctgtgcccttctgcatctggaaaaagcaactctttaggtaactttaattttcattttgcttagaatcaaaaagcctgcatttttgtgcaggcatgcacatattctgtcaaagtaaagaagctctttttttaagcacttagtgatcaattactttggagttggaggggataaaaaataaatagaacttaaacaaactgctttcatgtaaatgctatgtccatacattgaatttattaatgtaattcattaggatgtcatctaagcatggaagaaaaatggaaagatatgtgaaaatactttaaaaataaatgaaactgaaaaacctaagatcactttgtaaaattgccttaacagtttgttgacaattcacctgcaaatagttcacatttttattgtgcttgccaagctgttttctctgtatatttcattttttcttactagacttttaagatttattatatattcctaaaatctggagtaaaggaataaatattagacagtatcattatt

SEQ ID NO: 216273 - DNA, 435 bp, Homo sapiens
acatctccactgagttcaaccgttatggcatctccaatgagaagcctgaggtcaagattggggtttctgtgaagcagcagtttaccgaggaagaaatatacaaagacagggatagccagatcacagccattgagaagacttttgaggatgcccagaaatcaatctcacagcattacagcaaaccccgagtcacaccggtggaggtcatgcctgtcttcccagactttaagatgtggatcaatccatgtgctcaggtgatctttgactcagacccagcccccaaggacacgagtggtgcagctgcgttggagatgatgtctcaggccatgattaggggcatgatggatgaggaagggaaccagtttgtggcctatttcctgcctgtagaagagacgttgaagaaacgaaagcgggaccaggaggaggagatggact

SEQ ID NO: 216274 - DNA, 1397 bp, Homo sapiens
tgaattagagcaggtcctgaatgtaatgactagcgtccttataagaagagtaaaggaaacagacacaccacaaagacaatgtgaagatggaggtaggctgccccaagcgtggggccaccgaagctggaaggggcaaggaaagattcctagagttttgagaacatggccctgctgacagcttgattttggacttctagcctcctgtactataagagaataagtttgttgcttcaagccactgagtttgtggtaatttttaaagatagccctaggatactaagtacagtaggattgtgtgtcgcctagaggcccttgagaagaatctttccgtgggctcttccagcttctataggcaagctgcattccttagctcctggctcttccttcatcttcaaagccagccatagagcatcttaaaatcttgtttgtctgaatagtattctgttgtcatatctcctctgtgtattaaggacttatgtgattatattaggcccgtctggataatcatggttgatcttcacatctcaagatcttaatcacatctgcaaagtctgttcgttccatgtaaagtaagatattcaagattcctgggattatgacatgtacatcctttggttgggggtgaggggcattattgtacctaccacagacagtttttttaaaagctaaaaatatttgtcatacaacctagcaatcccacttccagttatctaccagaaaaaaaactaaggcgtatgtccacacgcagacttttatgcaatattcatagcagcattataatagtcaagatgcacatacagcccaaatatccatcagctggtgaatgaataaacaaaatgtggtataaactataccaaaatagaatactattcagcaataaaaagatcagactgctgacgtgttaaaacagaggtgaacgtcaaaatcatgccacatgaaagaagcctagtgcaaaagatcacttttcttgtgtgcttccatttatattaaatgtctagtaaaggcacatttgtagaaagagaaagtagatttagtggctgtctaggggtaggaaaggggattgattgcggatgcacctaaggaattttgagactgtaatgagaatgttccaaaactgaattgcaatgatagttgcacaactttatagtaaaaaaatcactgaagtgtgcacttaaaacatggcttttatggtatataaattatacctcaagaaggctgcttaaggagaaagaaatgagggggatttaagaaagagggagttcatacacctaaatgtaaaatgtctagagaaaacataaaaatctttgtgatcttgagttaggcatatttcttgaatacaactcagaaataaatccatgaaataaatttgtcaaaatgtaaaactttcccaaaaacaa

SEQ ID NO: 216275 - DNA, 511 bp, Homo sapiens
ggtcatgcagggcatcagcagggcaaggagtctaggctttattcaacatgcaacaggaagccactgtagagttacagacacggaagtgacatggtccagatatttttccgcagtgtgcaggaatctgccacatagtatctgctgagtaactaccttaatggctgtgacgatgagggtggaggtcagtgggttatgctgctgagtgacacaacctgtagtgctgcaggagcctggaggtagggagggagcatagcatggctgtctgggcagatgagtccagtgagatgggtgggttctgacttcatgaggggaaagaggaggctccacaaccctcatgagggacagagagtagatggggtgggtaagcaccgggccaggagtggtagcagacagctctcgtaagcagcccaaggaaaggctaggaacataggaggtctgaagagggaagcccaaactgccaggtgggctgggaggcatcatcccaaaccagtgatggttcctgagaagactg

SEQ ID NO: 216276 - DNA, 471 bp, Homo sapiens
cagagtctgctctgtcctgagatagaaaagaatcaaaaaggggtctcatggtggggaggagggaattcaagcagaacactcctgtttcccagcagcttcggagccccaggaacatgatgccaacagctccaaacagatagcacgggaggtagggaatccctcgacctgctggtaacatttgacatagtgccttttaggcaaagggaaggtgctctatagagaaagtcgggctgtaatccttccggtcctaaggaaatcactgtgtacactctgcccccaagatgccccttccagatacggaaatcagccctgcttcaatagcacaaaaaactcttcataggggaggagcaaaaccctgttcactcgatgctgaaaaaaggagacgggagagtctgaaacgagactgcaaattctcaagacttcaaaccccttcggtctgggtaatacaaaggaagaataaaatcatctcag

SEQ ID NO: 216277 - DNA, 150 bp, Homo sapiens
tttacctgtagatttccagttctattatatgcctacgtgacctgtcacctcccacagtgtccttacacctgatcagtgatatgtttttttgtgtttgtttttgagacagagtctccctctgtcacccaggctggggtgcaatggcacaat

SEQ ID NO: 216278 - DNA, 409 bp, Homo sapiens
caaggagaactctatgtgataacagagtcagaaattaggatgatgtagctccaagccaaggagccccaaagactgatggccaccaccaaaagctagaaaggagatgaggaagagggttggatgcagtggcccatgcctgtgatgctagcactttaggaagccgggacctgagaatcgctagaggttaggaaatcaagaccagcctggacgacaaggcaagaccctgtccatacaaaaaataaaaataataacagtttaactgggcatggtgtcacatgtctgtagtcatagctactaaggaggttgaggtggaaggatcacttgaagccaggaatttgaggctacagtgacctatgatggtgtcactgcattccagtctgggtaagacagagggagactctgtctcaaa

SEQ ID NO: 216279 - DNA, 94 bp, Homo sapiens
aaacttttggaattactctattacctacatctaagttgcaaatccaaaaataaaactaggattttattaacatattctgcccttcattgcttcc

SEQ ID NO: 216280 - DNA, 372 bp, Homo sapiens
cccatgggggcaggagagcaaaacaatggtgtacaaaatcagacaggcttgaaccccacctgccttcctcccccgctgggcagaagcggtgcacccaggctccacctggctgtaatgcactccctcccttgcagagaggtgcctgaaatggctctgtctgtgccaagaggggtgacaagatctccagagtggcacaggactaaggtgaggacaaaggaggaagacttgggagggtcaagtttattccctccgggttttcaccaataataggataacgctacccttaacccggctatcaagtgagcaccacacaaacatcttgatgttttccctttcaatgtttttctgtaaagaaaaaaatatttctaggta

SEQ ID NO: 216281 - DNA, 227 bp, Homo sapiens
  misc_feature (15)..(15): n is a, c, g, or t
  misc_feature (21)..(21): n is a, c, g, or t
  misc_feature (47)..(47): n is a, c, g, or t
  misc_feature (54)..(54): n is a, c, g, or t
  misc_feature (73)..(74): n is a, c, g, or t
  misc_feature (113)..(113): n is a, c, g, or t
gtctggaagatttanggagcnctaatccataatcgtgccacctatcntctaccntgttttaattttttctccnnaaatctcaaaaaaataattaaggatcacaaatgagcatntccttgccaccactgagtaatccagggagaaaactagggaggcctttagtttcatttctgaacatctatgcactgggtagtgtcccatagggtgaaaccagacaaagggaaaca

SEQ ID NO: 216282 - DNA, 261 bp, Homo sapiens
taagattgtcctggggactctcccaggggctattccatgtgcaaaaaccacatgtccctctcaccactggggaagaatggtgatcaggcaggagtggatgcactcaaagggaaaagtctttctctaggacctggaaatgattgctcggaagtgtaaacagcaaaaaagttagagccctatcgcacagcttgctccaagtttcaaaattaccttctgtccctcctggacttgggaccattatttttccttcagatatgccag

SEQ ID NO: 216283 - DNA, 373 bp, Homo sapiens
tcctggggtgcccgcatgttctatttctcagcataacagatgatcacacaatgtgaatggtaagtatatttctgataacacaaacatggaaaaatattgcaagctaggaaatgtctgatcttctgatagtcatcttttcttaaattttttgaagaaaaaataattttctttaaggagattatgacaaaaagttaataaaaactcatccttcttaccaaaaatcttgatagatttgacaacatcacagtggaaaatatcaccaggctcagtggctcatgcctgtaatcccagcactttgggagagtgaggcaggaggatcacttgagcccaggtgtttggaacgagtctggcaatgtagtgagaccctgtctct

SEQ ID NO: 216284 - DNA, 448 bp, Homo sapiens
tcccacgccagcttgtgtggctgcggagcgggcacatccctggactgagagcgccttgaggaaaagggccgccctcctgtttctgcgattaaggatgcctatgaacggaatctgctgtatcaatggacatttttgtgtttaaaaggagaacgcatctttcttgagcgccaactgtgactcaagcactcacaacaaatcttgtgaagtgatgttacaacagattctaggaagtaagaccctcccttaaggcctggaactttctggtgttgccatgcatattgtagatggcatgtgtgtgaaattttgcatacagtttgtgcgtgtgtgtatttcattcacagtttcctgaagcccaggctaaaaaaattttattaacaatcaagtatcattaatagacgatataatagttcttataaaatatacactgatgttgccatgcccgttccaa

SEQ ID NO: 216285 - DNA, 656 bp, Homo sapiens
  misc_feature (490)..(490): n is a, c, g, or t
cctccaaaggcttccccatctgaccagtttacagttaccaagtctccttctccagggaagagccactcagggcaggatggggggcgggggctcttctgcccactcacagaagcctccctggctgcctgactggggtagctcactctgtcctcagaaagcccaaatcactttgcttggacctcagacatcttgttttgcactagggactttacatctaccctgcaataccataagcttttggaaagcctggaccacatggggaggtgtggcttctaagtccctccgggaccctaccttgccttccctctgggagctccctagcagcctctctaagcagccccgactcccagggtttgcctacattctatgccctcaggaggtgttcagtgccccgagctggggcttggggaggaggggttcctaggaacatatatatgagaaggtgtctcactctgtcacccaggctggagtgtagtggcgcgatcacggntcactgcagccttcaccctccaggcccaagcgattctcctactctgtctctacaaaaatacgaaattacatatcctgccaaaaaaatagaaaaccttcctattacccggccgttaatgccgcatgcctgtagtcccagcttactccggaggcttgaggtggcagcc

SEQ ID NO: 216286 - DNA, 829 bp, Homo sapiens
gtcaataacctagtttctccatgagaaaatttataacaactttttagccaatttatgtcaaattctacagctgtcaatgaaatagtcaaagagttaaatgcctactgataacatttaatttatgacttagttccatatgcatatttgatgtcacattattttaaaaatttatttaatggacatactgccctttcttcccatgttctcatttcatgaaacaatttccttcaaatccttcgcatgtatctttagtatcagtatcctttgtatcatgactttgagttactgtgtttctttaaaaatctttatctcaagaataaaaaagtccaaattccgataataaggaaaattatccaaatttacaccattgaaatcaattataaatggaaactagggcctgtttcactaatctcaggtattaacagctttaactctaataaataaaaatcaagttcattaaggaatgcaaaagtctaaatacctgttagattttcacaagtttttttaaaaaaaatctaaaagtgtgcatatactacattattcaaaataaagcaattaagaaaatattaatgagtgatttttataaatttttacaatactgactctgccttatactctggtaagtatgttacgttatgttaacccaattaattctcatcataatctttgtggcaaacaaagctaataagtactcttagtccaagacaacaacaacaacaaaacactgtattttgttttgaggaacacaaacagaaaaagcaatcaaagtcactaaagcagattaatttctttttttttttttttctccttgagatggagtcttgctctg

SEQ ID NO: 216287 - DNA, 531 bp, Homo sapiens
tactggtaatgatagatgggtctgaagtagtatttataagactgtttgggggaaaaagtatttaagagttagaggattattcagctttttattttatattttgagtgacttttgatgttatatttttgtaatatgtattcatttcaataactaaaatttcaaatttattggcataaagttgtttaaaaatacccttgtctttttttttttttttaatgtcagtggcgtctatagggacacctactttttcattcccaacattgacttttattgtgccttctctttttctgtttgaccagggatctcccagtattactggtaacttcaaagaactaacttatggcattattgatgttctcgctcctgtgattgtttcctatttcatcagtttttaatttattatatcttattaatatttaattattatcttgttcctttctcctctcccctttgattttcagctttccttctttcaaatatatgcatttaaatatgtaaattttccttttagttcaactctttttttttatg

SEQ ID NO: 216288 - DNA, 231 bp, Homo sapiens
ggctgccaggccagacacaaaccctttgggtcccagcccacatttgcaaggtaaacgtgccccttcctataccttctcatctccaccataaaacagcccagggggcctctgtttgttgggtgtaattagctgtttctccctcacttgatcacaattagattccggtttagaagaaagcagccaaaggggtctttgtgctggggcctcttaggctgacctggggtaactgag

SEQ ID NO: 216289 - DNA, 718 bp, Homo sapiens
tgcagtggctcatgcctgtaatcccaacactttgggaggccaaggtggctggattgcttgagaccaagagttcaagaccagcctgggcaacatggcgaaagcccatctctactaaaaatacaaaaattagccagatgtttggtggcgggagcctgtaatcccacctactcgggaggctgaggcataagaatcgcttgaacccaggaagcagaggttgcagtgagccaagatcgcaccactgcactccagcctgggtgacagagtgaaacgctgtcgcaaataaaataaaataataaataagtgaatgaaagatgcagtgggaagagactgagctgagaagccagtcagagatgggttaattataggctgtgtggccctgggcaagtcacttaacctttctgagcccaggtcctttgtctgtgaaggggaataaaaataaccacctctccagggtatgggggaagactggaatgatgtatgggaaacattgaatatgaactacttatacacggcaaatgggaagtaaatttgtatcaccgttattaatgattcagactcacactgcagcccatgcatgacctgtaatcacaagtgtcacacaaaatcacacaattcaagtctacagcttgactctgggagctactggttaataaacaacatggcgatagcctctttaaatacaatggttctcctgtctctccatgcaagcagctttagt

SEQ ID NO: 216290 - DNA, 695 bp, Homo sapiens
ttgaactttatttagtaagaattcttagcaaaattccctcccaggcacacctacatggtgcttcattttcagtgaactacaaatctctgaaacccaaaactgcaatctaaaagtacaagatggctggactcgatggctcatgcctgtaatcccagcacttcgggaggccaaggcaggaggattgcttgagcccagaagttcaagaccagcttgggcaacatggtgaaactttgtctctacaaaaaattagccgagcttcacaaacaatcttacaggagtcattcattaattaactcaacaaatatttatagagtacaggagacactagagatccagcaaaggtcaataacatgtgctgtcttagagaaaacttatattctaagaataatcaagtgacaaacaggagctacatcaaataatcacaagtacacttcagagaattaaaaccagatcaacgtagagaaaggcttccttacattcgatagtcaggaaattctctctctaccaggagggaactgagtgacaaggaacagtcaggtgggagaagggcattccagatgaaccagccctgagcggggaactagaaggccagtttgagaaaaggaatggagagaggaggaacagtttgtggtcaggagtttgagaccagcctggctaacatggcgaaaccccgtttccactaaaccaaaaaaaaa

SEQ ID NO: 216291 - DNA, 611 bp, Homo sapiens
aggtcattaaaggcttttgtcattttaattccttctgaccagccagatggaatatgtatggaaattatgaacatttgtctggaattagactcattctagagcgaagattgactctgacattctcagtggactctgcctcaccaagcaaaccagtttcagagccaagatggcatgattgtttcagcattggcatctcgctccttggtcttctttccatgaaagcctgttgtttccccttcctatgcagctactgtattcatctagggctctgttgggaagggtatcagactgagaactgggagacctgagttcttgggccagctctgtcatctctgggtgtgtgatcttgggcaagtgtcatcccttctctatgcctcagtttctgtctctgtaaaatgaagaggtagagttcatagatggtccccaatcctgcctaaccacctgaaatacctggggagctctaaaacatgcagatttctaggcctcagactcatctctccctgccttcacccttttaccccctcgtctctactcccctgcaaattgtggttttgcatagctaggctagaaacccagaacgtgcattttgtaaaacctcttcaggtaaatca

SEQ ID NO: 216292 - DNA, 528 bp, Homo sapiens
gcacatagcaggattggcagcaattaattgtcagaactgcttaagctgtacacattcttataatgtacacaattaattggctgaactgcttatactgtacacgttccaggacccaatcaacaagcctctgtgctcctcctgccaacaattcagaggttcatggtacagaaagggtgcaatacttaaactaagcaggacaggcttcaccctctttaagttgagaaacgggaatatattgatgacattcctttctacttttggaattgcaaaaggtccacaatatctgcctttggattcaatatatgtatatttccaaaagagtgaaaaatgcagactgacaatccaaatgcctttgcagctctgcaggcaggcaagacaaaagcaatttatgatacaatttctctccactttggatgcagagttgcttgacctaccttagtgaaaacagcacaaactagaaactggtgctgctcgccagtcatccctaattagaatgagatctgcagtgcatacttttctcttcccttc

SEQ ID NO: 216293 - DNA, 363 bp, Homo sapiens
ggatttatttatcaaaatgtcaccacaataattgttacagccagccttgctccttcaaaaccatgctgccttgatagactacagttagttaaaattcctttgctttggttgcttttaaaaaaaaatgtgtgtgttactgtatctcacacaccacagctttaggaaatgttagcaaactgcaaataatctctcactcacataattgtcaagatgtttaaagtcatttccttctacaaatatgtccaaactctgttatcctatccctataaagttatatatcattcaagggcttttaaggaaagtacacaaacctgtattaagcaacaaataaatgccacagaccaggctatgtgctattcatta

SEQ ID NO: 216294 - DNA, 260 bp, Homo sapiens
gtctcctatttcttttcctctgtgtgttggccttaaaaatgtattatataatttgtcttaggccaaaaccatagtttgctttggagctggaggcactgactctgctcagggtaaatgcttctactcatggtcctagataggagagagtgtcggggctacttgctgcacacagcctgacgtgccattctcctttccctttccatgcttcctttgccccccaccattttttttcttttcttcttcccttctcctgtctcttc

SEQ ID NO: 216295 - DNA, 408 bp, Homo sapiens
gtcagtcataaatttttttcagtatgtgtcaataataaaaataaggatgataataacagggaagcatcacaatgaaggaaaaaagtactttcttctaccctgtggatgcatgaagtgaggaatctataggcagacccagcactgctcataactagccctatagccatggccttgggcaagtcaattattctttttggaacatgattttttcatagataatgaaaaggtaggagggtggtgggaaaagggaaaggagcagaaaagataactattgggtactgagcttaatacctgggtgatgaaataatatgtacaacaaacccccatgacacgtgtttacctatgtaacaaattttcacatgtacccctaaacgtaaaataaaagtttaagaaaagacaagagaagat

SEQ ID NO: 216296 - DNA, 322 bp, Homo sapiens
agtgttggatgtttgatttttctggcaaaacttctatatgatcagtgccaaggggctttgtggaatttctttaaaggtcttttgcctttctattgtcactgttttgaacactctatttctcagttactgggagtggggaggcagttgtgaggcatgagtacctgtgaaattggaaaaagttctgagttactgctcgcaagtgactaattatgagaaggctggaggacagcacaaacatctctggagtgtgccatgaaacctattgccttatatttcaatcttccatattgcaagtaggttgataaacatcaggaggcaatta

SEQ ID NO: 216297 - DNA, 440 bp, Homo sapiens
ccatctgtgttcccacaaaagccatgagcccattccatttttatggctgcatagtattccacggtgaatatgtaccagatttttaaatccgatctgtcattggtgggcatttaggttgattccattagacctgataattctttggaatagtagcggagaggaggagatggagtgaggcagacaggcttcagggggatgtagaaagtcagatggccagggctttgggtatggattgggttaggactgaggagcaaagtaggtaccaggcatatctagttggatgaaccatgtattagtctgttttcacactgctataaataactatctgagactgggtcatttataaagaaaagagttttaattgactcacagttctgtatggtgagggaggcctcaggaaacttacagtcatggcagaaggcaaaggggaagcaaggcat

SEQ ID NO: 216298 - DNA, 424 bp, Homo sapiens
cattcccaccagcagtgctgaggattccagtttctccacattcttgtcaacacttgttggctatctgtcctttttgatgttagagggtgtgcagtggtttcactttgcatttcctgatggctaaggatatgcatcttttcatgtacgtattgtccatttgaatagctcctttggagaaatgtctgtttggatcatctgtttctacacactgtataacaatgcaagttagacagcaggggctcaggaataaagccagagtttacagtgtgccaagcaagatgccaatgaatgactctgctgcgtcctcctaaacttattcctgatttaggtccatgcttctttatctccctcctccaccacacacaccctttatttaacagtgctgaggccacaccccctcttgcacactgctggctgatgaatt

SEQ ID NO: 216299 - DNA, 514 bp, Homo sapiens
gcggccgccgcagccgccctacgcgctgcgccgtgaggagcgggttgcggtgtacccagcgggccggcgccgagccgagccgccgcgtccaccgtggggcggggggcgcctgcgaggagggggtgggagccgcggcggcccgaccctccccgcccgcggcgctcccgctcggatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaa

SEQ ID NO: 216300 - DNA, 504 bp, Homo sapiens
agatttgggaggccgaggcgggcggatcacgaggtcaggagatcgagaccatcccggctaaaacggtgaaaccccgtctctactaaaaatacaaaaaattagccaggtgtagtggcgggcgcctgtagtcccagctacttgggaggctgaggcaggagaatcgcttgaatactggaggcagagatagcagtgagccgagatcgcaccattgcactctagcctgggcgacaagagagaaactccatttcaaaaagaaaaaaaaaaaaaaaaaggaagaaaagaaagaaaagaaaagaaaagaaaagaaataacattggaacaactgaagagaggcatatgggaaaaagaacctcaacccctacctcacacagttcacaaatattaacttaaaataggtaatagacctaaccaaaaaataaaaataaaaattataaaacttctgcaagaaaaaaaaaatcggagaaatcggaatgatattgcctagttctagatcgcgagcggccg

SEQ ID NO: 216301 - DNA, 801 bp, Homo sapiens
attttcttgtgattccctgaacttctttaaaaaaattctaaattatctttcaaaaatcttgtagatcttcaattcttctagttcattattggagttgaactggtttcttttagtagtaccatacttcgttggattttcacaatccttgcatctttatgttgatgcctgcacatttgaagagacagttacctcttctagtttttgcaggtgttccttattggtgtcagacctttactttttagtatcagaacttaaacatggcctgttgtttcttcctgttcagtggatgacttatagtaagtactggaactaaaaccctgcactagaactaattcattgccctgtcattgtttcctgttctgggagaagacttatagtgaacattgaagcataaatgctgttgcaggatgaaatcgctgccctgccattgtttcccaatccagggaagacttacagtgagcaccaaagcttaaacactgccacagaactacattgctgctctaccactgtttcccaaactggggaaaactttagtgggcactggaacttaatcatggctgttagttgtttctatccagggaaggttccatgcaagcacctgggctttgtggaaagcctgggactcaggctatcccacagactgtccccctacagctctatggcatcagccagtctcttcaacgtggtttcccaggtgattggagtactgagtagccacaaagatccacacacctgtcactgcaatcactgacccacttttgttcccaatacactccagttggttcagcccttctggcattt

SEQ ID NO: 216302 - DNA, 573 bp, Homo sapiens
ccccatccacggagcggctccttcagaaagtgattccttttgtcttgtggacacctgggcctcaaggcttctggagtctgggttccaccggggcctcaggtcctgctggggtgtggcagcgtctgcagagccgctgtccgccttggtctgtcctttcactcgaggtcactgcagagccgctgtccgccttggtctgtcctttcactcaaggtcactttgttttaggtgtgtttttcgcaataagcacaatccacttaactggattttttggggacgttttgtctgtttgtgtttttactgatttagctctcgtgacttgtggattccgtccttgtttagtctcgggcatattttcttctattagatcgctgacccagttatttagttctctagctgtaggaccccgtgatgctgcagcagctttgatgtcttctctgcctccgtctttactttctcttccactcctttcctctggattcacagtggttttccaaaacccagcctcaatcattggtgcgtttgtggccttgtctgttgtattcttggctgttaacaaaattttttgtgacttta

SEQ ID NO: 216303 - DNA, 370 bp, Homo sapiens
ctttgtgtttgtgtaaactttgaggtttcttaaaactaccaaagcagtgaggagaagatggcagaaagctgtgtgctgatattctttttcctgtttcttgtttttccctcccccaaaagttgtggaattaattttaagtagaaggaaaagggcagcttgagatgtttaaatttgacttaagttttaactgaagtttgtttgcaaaaagatgaaaacgggttaataactttagagaaagttgatttcatactcctaaggtttggaagccaaataaagaaaacaaaactgtgaagttaacatagtagttttggtttcttatttgtagaataaaggtatgatccagccccatggaccaaggcagcaggaggag

SEQ ID NO: 216304 - DNA, 511 bp, Homo sapiens
agtactaagagactacaagtgtgtgtctacatatatttttaatgtattttcttagggttttgtaggctctaagagtggaatttataaattaacctcttgagaagatagctcagccttatttgaagattcccttctatgtatttatatcatgagctggacttcatacttttgaaataattaatggaaggcatatttttataatgaatccatccatgacaggtagaattatgcaaagcatgaatcaatcatgggtttttcatttgagtatcacaaaatgttaatcataaatacattttgcctctatattgtaatttctaaaaattgcaaaataagtttcttaagtagaaaaatcttaagatgcattctgccattttgggctaactgcctccttattttggagcttgctgtaattgagcatgtgttatttaatgagttatacctctgtcatatgtgtgtgtttatatcacaaaataacttatttttataaaaccatattttgagtcatcatttg

SEQ ID NO: 216305 - DNA, 545 bp, Homo sapiens
ggtaagttgctatttaccatataaatagaagtagtcttcctacctgccaaaatgtgccctatattctgttgcttttctgttatatagatggaccttctgtattcctaagggtgataacttctgtttgtgcattgatcccatgctctatcttcaaagatactactctagcaattcttccctgtgttctttgcataatgaatttacccctctgctagataatttacatcagcatgcaaacgtgctttatattcctcttgttaaatctatcatttcttagcataatattgtccttcatcttctgcacataccttaattcttttcagccagatcctttttaaaaggggtacccacagcctggacaacacagcaagaccccatctacaaaaaataaaaaatttagccaggcatggtgatgtggtacacctctgtagtcccagccacttgaggctgaggcaggaagatcacttgagcccaggagtttgaggctatggtgagctacagttgcactccactccagtctggatggtcaaatgactctgtctctt

SEQ ID NO: 216306 - DNA, 616 bp, Homo sapiens
ggggtttttcagatgctccagtctgtcccgttgatgtgtctgttgttcacaggcgagggctgtgctgcttaaattattacagatttctttaagatgtcgatgccagatgggctggtcctcttttgtattattcccccagaattttcctggctctctttgcttatttcattgttcagtgaactgtagaatcgacttatccgtttaacctaaacaattcagttggtgtttttactggaactgcattcgctttatagatatactcgggaacagatgatgtcttcatgatgttgaatcttctcatccaaaaacacagccatcctgccttttgttcacagggcctgttgtggccctcagtacagtgtggggatggtctcttcctacagacccactcggttctccttcatccctacgtatgtcctcttttttgttgctattataagtgaggtgttttctctcattacagcttctacctcattattttcacactggccgtgaccgctgtgtatgacttttgtacccagttttctttctcaattatcttctttgtggttttcttggattttccaggtttacagtgacatcacctgcaaataaacacttcaccttcggcttttca

SEQ ID NO: 216307 - DNA, 342 bp, Homo sapiens
gagttgagagggtagactgagcccaggtattaggctcagctctctcctgaatcttggctaaactgacagtaagatgagcaagacccccagagaatggagctgggaagcagatggaggagtggtcattgacttcgcagatgggaggctactgcatcctcagttctcagtgaattggaggatggccacccaagtgagggaggccatttgctttattcacttcaccaattcccatgtggatctcctctggaaacagcctcacagacacgcccagaaataatgtttagccatgggcatccctcagcccagtcaagttgacataaaattagccttcacaatttcaga

SEQ ID NO: 216308 - DNA, 506 bp, Homo sapiens
gagatattgaagttcctggtactctctgtgcattcacaccttctgtgagattattttgcagtttatcccagtcattttaggattttagaaccaaaaaagagtgtgatgatttcactttgcatttgtttcagacattgtgaaaatgttagcctgagtacattaacaatagaaagctgacttgacccttgggggctgacctttgaaaaacacatagccagcacttgagacacatggccatatagggattaacagctgtgtgctgaagtagattagtgtttctaatttttagtcattcacgtgctagcttcataatttttggccaaattgttcactaacctgctgtttacttaataaatatcttttctttaaattgtctgttatttgcttgatagttgtcttcagaatgttttacttcttagcttcatcccatgtaattatgggtttgctgtgtgttttgtgtgtgtgcgtgagaaagacatacattaaaataaatattacaaaagttt

SEQ ID NO: 216309 - DNA, 324 bp, Homo sapiens
ctgtggagtgcagtgcaggagctatgatgcaggctcccaggagctacctaccctgtccccgccaggcacccaaggctgcactgcaaacaggcactgccaggctggggccctgggagaggccagcagactgaagcgtgctcaggatctgactgaccctatctcatgcgcaagattactttgcagggttcagctctgatatttcccctaaagacaaagtctcctatgggagcaagttgaccctagggaaatgggtgtccctggccatacaccactaaagatgctcccgcacaaaaccctctgagctctgcactggctggagttctg

SEQ ID NO: 216310 - DNA, 466 bp, Homo sapiens
ccttgtctcaaaaagaaagagagaaagagagaagagagagaaagagaaagaaagaaagaatgaatgagttagctgggtgtgctgatgtgtctgtagtcctagctacttggggctgaggtaggagaattgcttgagcccaagagttcagggctgcaatgagctatgtttgtgccactgtactccagcctggatgacagagcagcaagaccctgtctctaaaaacaaaacaaaactaagaattttaggatgacacaactcagtccatagcaagtgatacctctttgactggaacaaataaccttatgcttcaggtgcaatatctcacacagacactatggccttcgttcactttttaaactagcatttattgaagacaaaactatgtgccaagttttatgccagctgcaggggatatcccgtaccctccaccagtagaggagacagagccagtttcagagaagggtgg

SEQ ID NO: 216311 - DNA, 400 bp, Homo sapiens
aaaaaataaaatattgagatatcatcaagaaatttctacagcttcacattcaaactcttcagcactttcagagctattgatatgcatatgtccacctagtaccatcttgtgtgctttcagaattattggtaaggctgcatttcctgagtgctctaccacacttatgtctggattttttttacccagctacagacccacactcctgcaagatttgatacccttctatttggcaaaactcagtttcacttttctttcagtttaatcacaggtccttagaagatcggacctgtgattctattcaaagtcagaaagagatttctcacaaattgatgtcatattaacatgtcaatatgaaaattattgtttggtaaaccagaagtgacctgtctgaagccctcaa

SEQ ID NO: 216312 - DNA, 324 bp, Homo sapiens
gagatcacgccactgcactccaacctgggcaacagcgagactccgtctcaggaaaaaaaaaaaaaaaagacttaagggacctgtaaaccaaatgcaggtatgaatcttgtttggaacttgatttgaacaactgactaactaaaaaaatgcctttttttttaaacaggcaaaaataaaacatactctgtttattacatgttactaaggaattactggtaattttattgagttggtggtattgtgagttttaaaagtccttatctatttagaagcacttattaatgaattaatatgaggcctaagactctttaaaaaatactcctt

SEQ ID NO: 216313 - DNA, 447 bp, Homo sapiens
ctacaaaagtcccaatttttaagcccacacaaaaaggtttcatttgaatctctgctcatttggaaagggaaaagtccctaggattgcccagcatccccaacaaagcagagtttgctaaattcccatcatttgggaagaggaaccttttttttttttttttttttttttttttgggctgaactatcctccagatctcctgggcgggaggaaaaaaaaatggtcatcagatatgtaggcagatgggctgtgatcaccactggaagctcgaagtatttggggaaactgaaactgtctagggataaagctgccctggtttgtgtgtttctggtttcactgattaaaaaaaaaatccatctaccaagagtggataaattttaaaattctgccatgcccagttttcgaagccccaaatgcgatataggaacagctgtggtgtgaattagttgg

SEQ ID NO: 216314 - DNA, 201 bp, Homo sapiens
agaggccagactctgggtccaagtgctactttatgagtgcacactgggaaatccttgaaaggagatgtaatccagtctctggctctccccattccctccacatgggtctgcaaagaccctccaaactgaggtgcccccgtcagtcagggcatgttggggacactccactgtctgcattctcctgataaagttcaggatggt

SEQ ID NO: 216315 - DNA, 464 bp, Homo sapiens
tgccacctggctgtgattcttggcacaaaccagacaaatatgtgaaaacaactgtgtgaagacactggagaaccaatacaggcaaggagaggtgatgatccctctgaaaagtgtaatagttgagtttccacactgatcttggcctttatcatgagggtattttctagactgctataaggtgaaatcgagccaaacagcaagtttccttttttactagtctgatgtgacaagcatcagaccttgatgttgccagagtcagtaaggcccagggagcaaaatactggggaggatcctattccaggccctaacagaaatctcaagacatggaaacaattggtagcacacatgttctctgaccacattctcaaaggcaattaaaataggtagatgagccacacttccttctaaattaactcacaagttaaattaaaaattataaggcaaattagtgaatatttagaacc

SEQ ID NO: 216316 - DNA, 323 bp, Homo sapiens
gagataatgtttgagttaattgatgagggttttaagcagtaatcaatatttcccaaactagcaaacccagcatgttttagggtcattttcaatgattaaaattaaaatttggttgtttcaaaactttggttgaatgctaaccactggaggcctggtgttggatgaacagagcatactgggatgctaaaaaatattaagtgcaaatcccatctttgtctgaaattggtttttgtataattcctgttttaggaaattgtgaaatcatgtaagacagttttcactataaattattttcaaaagtctttgtgctaaatgatcaggca

SEQ ID NO: 216317 - DNA, 158 bp, Homo sapiens
cctgtggatggaaaacagaaggctgtgagcatccatggtcattttcccctttttttcacagttgtagcccagactgtattaggtaaggccaggtaagatcagcaaattgtctcagcatttagctagtggaataaacacttttcagataaacctctcca

SEQ ID NO: 216318 - DNA, 277 bp, Homo sapiens
tttgaaagcagctgtcttttgaaatgagcagagacaaagtagatgacctttctctgtctttgacatttgtcacttcttatagtgtttcagatgaaatgagaaatctgttgaaaatgtgtatttgcagcagagctaaagaatctttcattgctgggttttttgttgtttttgttgttgtttgtttttgagactccgtctcactctgttgcccaggctggaatgcagtggtacgatcttggctcactgcaacctccacctgccgggttcaagtgattct

SEQ ID NO: 216319 - DNA, 312 bp, Homo sapiens
ttctgcgttctcctcggttggtgtcatatcactgcatggacagcaggtgtgtgaaggtttgtgtcatccaccgagtctgccctgactgaactggtcacatccgcggatggccgtggtgacctcttctgagctctgatctgctattgtggatgtctttgtacaagaggaagtgactgtcctgatgggagtggtgagctgctgcaggagtgactgacagtgactgcttgttctccatcccccaggagtgactgacagtgaccgcttgttctgcatcccccaggagtgactgtgactgcttgttctccatccccc

SEQ ID NO: 216320 - DNA, 236 bp, Homo sapiens
caggaagatctcttgagcccaggagtttgagaccagcctgggcaatgtgatgagacctccatctctacaaaaataaaagaaaattagccaggtatggtggcacgtacctcctgtagtcccagctacttgggaggctgagggctgaagtgagaggatcattgcctgggagcaatggctgcagcgagccacgatcacaccagtactttccagcctggaacagagcgagaccctatctc

SEQ ID NO: 216321 - DNA, 479 bp, Homo sapiens
atctttttaatgactcttgtattttaaacctaaaattttgattaagcttcacttaatattaaaaaagatagtataggtcacgatgttatttgatgcaaacgttggaaagacagaatcttcttgatccaagagcttttagaattcaaagtctgattctggttattactctgctcatttaagatagtgaaatgaacatttacattctggcaacctcagaagtacaatgaacaaaggacaccagccaggtagggcaaaggcctgtgcacccccttttgctgttacatgtttatcagatgcgtgctctgtttctgttatattacattacttttctcttcaatgtttactgaggaagaacaagtagctcctcaggcaaatcaactgttaactttgcagtttttatttaatctcccaggaatgtaacccttaactttaaagaatgtagtgaccataaaacttataaagcatgtttcttaaggaaa

SEQ ID NO: 216322 - DNA, 370 bp, Homo sapiens
aagtggtgtgctcaaggccaaactcctaattagaggtgggaccagagctaggtcccaggtcccctaacttgcagcccagggccctctcactgtactggggtgtattcatctcatttcgatatgggaacacagatgtgtcagaatgaggaagttactttccaatgcactgtgcagttatgttagccatgctatttctccatcctagctgaagtcccaccaccatagaccctgacactccactgtccccatgtcctagatcaccacgtagtgtgcttattctgcttcatagtctcatactcagcagtcccagcccaccacatactccttctctccctttacagtttccctggtcactcacttcttgtagtcc

SEQ ID NO: 216323 - DNA, 533 bp, Homo sapiens
tatatttgctgactccctaaaatctatgttcacttgaatcttacactgactttgtacccaggagagtgaaatattttaatcatgctcattttacagataagaacactcaggtttggaaaggaaaagtgagctgcttaaggtcagagtataagcagggcctcagggcacaggtcctactaagggaagaacccaaatcagaactcaaatgagtgcttctttctcctcgggtgatgctatggttggaacatgtacccctaaaagcatgtgttgaaaacttaatcctcaatgcagcagtgttgggaggtggggcctatcgggagatgcttaggtcatgagggctctgcccttacgagttgattaacatcaattagggtttgaggttgcaagttctatctcttgctctctttctctccctctctttgcccttctaccatggcatgatacagcatgaagacctttgccagatgctagtcctcaatcttggacttcccagctccagaatcatgagccattaaatttctgtttattataaa

SEQ ID NO: 216324 - DNA, 318 bp, Homo sapiens
ttatagattagatataatagactatagattagataatagtaaggtttcctgattttgataactgtagcatgcaggccagaactagggcgagacaacagaggctcctagggtacaaagttgaaggaagccctcttgaagggccactcacgctcaggccttgttagcctccatctagttctagccctggtgttgtcgttatgtaggaaaatgtccttgttttcagagctacacactgaagtattgagggtaaagacatgccagtatatgcaattaactctccaagaattcaggaataatcatcatacataggtagagcga

SEQ ID NO: 216325 - DNA, 556 bp, Homo sapiens
aaactatcaatgctgaagacttaaggcctcttaagaataccctttttgcaagaggggatggaaacatctctggccccaactccgacaggaaagcctggttttagcattgaaaagatgaggcctgattgttgatttctttcacgtgtgtgtggaattaacatcttctatccctttcaatgttgaattaacttagtgacgaactcattaaggactccttatcaaggctttccctcctttctataattttatccattgtcagctttgacagaaatcccactgaaggtttgtcaaagagccattgaagagttctaagtggtcttgcttgcagagggcaactgcacttgacctctatttatactttttgtagtactcttgcctggactcagagatgcaactgggattgaaattatatttaccaaacatcaacatattgatgttagaccttaaaagaagaaaacgtaaaacagcatacagtctttttgcagtaaacagtaaactcaggaaatttttattcattgattccttccttcaacaaaattatggttaagaatacctg

SEQ ID NO: 216326 - DNA, 551 bp, Homo sapiens
aatgggaaaaaaaagtttaaacaattgaaatgggtatatttcttctgtggtctagtaaatgaaactttaattttatgtttactccatgaatgttaaaattaactgagtctagagggcccaccaggcagtattccagactaggggctctcaaaatttggcccaccagtcagcagcattggcatcacttgggaacttgttggttcttggaccccattttgcacctattgaatcagaaggtctgaggatggggcgcagcttaacaagtttcccatttgactgatgcatgctaaagtgtgacaagtgctaggtttatctctagtattttgaccttctactagcagtcagcctctactttactttccagagtctagagacatgtgtttatttttgatgcctagagaaatggtgaggagttctctaatgtagaatgtacatacagttacaaatgtctgtggtattcttgcttaaagtcaagtctgttttgcaggcctctgctctgcctcctgaggcaggttttcagagagaaaactttagagaatatatgaaattta

SEQ ID NO: 216327 - DNA, 417 bp, Homo sapiens
cgccaggttacattctaggctccagtctgggtcctggccaatctacagacacctccaggacagggcctttgcttctacctgaagacacagtacaaattttagagcaagaataccacggttcaatgccaggtgcagtggctcataactgtaatcccagcactttgggaggctgaggcaggcagatcacgtgaggccaggagttcaagaccagcctggccaatacgatgaaaccctgtctctactaaaactacaaaaattagccgggcgtggtggcatgcacctgtagtcccagctacttgggggactgaggccagagaattacttgaactcaggaggcagacgttgcagtgagctgagatcacaccactgcactccagcctgggtgacggagagagactccttctcaaaaaacaaaaa

SEQ ID NO: 216328 - DNA, 534 bp, Homo sapiens
taagctttttaaaaatgtcagttttcccaaaaggatgtgatcatttttttccacatagaaaaggagatgtttatacatcctaggtctgaatgtctacactcttcgactgctaatacagataagaaccgaccatttgtagtgtggccatttgaagacatgctccttaattcgaagtagtaaaaaagataaaccacaaagcagtgtgccttcttttccttaaaggaacaacttattggccgggtgcggtggctcaggcctgtaatcctagcactttgggaggtcgagatgggcggattgcctgagctcaggagtttgagaccagcctgggcaacatggtgaaaccccgtctttactaaaatacaaaaaaacaaaacaaaaaaaaaaacggccggatgtggtggcgggcgcctgtaatcccagctacgcgggaggctgaggcgtgagaattgcttgaacccgggagtcggaggttgcagtgagccaagaccatgccactgcactccagcctgggcaagaaagtgaaactctgtcgtc

SEQ ID NO: 216329 - DNA, 667 bp, Homo sapiens
agcattttaagtaaaatttattttcttcacaattagaaaacatgaaaaggcatatacaatgcctttggtgttttgaatttaagaatcaatgtctgagggacttttgtgtgtgaaaataaatattcatatacatttttagttgtttaatgtttgatgtattacactgctttctattaaacaaaactttaaaaactgattttcttgtgtatctaaatctgggttataaatttggttagcttaactcctgtaacaaatataatgtttatttataacttgtatttggttgattcttttggaaaactaggaatacaataacatttagataaaatatttataaatacaatgattacaatatatgttaaccttatatcacatccagttaaaaacgtgctgataacatggatttaatttcttagtcaagtcacaagggctgggtggtctctcatcttgatggctcccggtgagccctggaacatggcggtgtggtccaaggcaatttaaacctgtgccacagattattcagctgagtcctttttgcaatagagttttaagaccctctttcatttaaatttaaatttttgaaacttagtgtccttcctaaaaataaaatgaaatgaagtttcctaaagtgttgtattattagtactatctaagtcatcatcctggt

SEQ ID NO: 216330 - DNA, 863 bp, Homo sapiens
catggccgggcgcggtggttcacgcctgtaatcctagcactttgggaggccggggcgggtggatcacgaggtcaggagatcgagaccatcctggctaacatggtgaaaccccgtctctactaaaaatacaaaaaattagccgggtgtggtggcgggcgcctgtagtcccagctactcgggaggctgaggcaagagaatggcatgaaccagggaggcagagcttgcagtgagccgagatcgtgccactgcactccagcctgggcgacagagccagactctgcttaaaaataaataaataaataaataaataaataaatattcatatacatttttagttgtttaatgtttgatgtattacactgctttctattaaacaaaactttaaaaactgattttcttgtgtatctaaatctgggttataaatttggttagcttaactcctgtaacaaatataatgtttatttataacttgtatttggttgattcttttggaaaactaggaatacaataacatttagataaaatatttataaatacaatgattacaatatatgttaaccttatatcacatccagttaaaaacgtgctgataacatggatttaatttcttagtcaagtcacaagggctgggtggtctctcatcttgatggctcccggtgagccctggaacatggcggtgtggtccaaggcaatttaaacctgtgccacagattattcagctgagtcctttttgcaatagagttttaagaccctctttcatttaaatttaaatttttgaaacttagtgtccttcctaaaaataaaatgaaatgaagtttcctaaagtgttgtattattagtactatctaagtcatcatcctggt

SEQ ID NO: 216331 - DNA, 403 bp, Homo sapiens
tgactattttacattgaaacataaagtaactattgtttgtgcgtgccttcccttcacataaatcaatcctatttataaaccctttcacttatatagcctcatttaacctgattttcatccttctcagagaagttgttgaagaaaagtcacgtgtgtcaaattcaaatcaaaaccacaatcagtcctccttcccaaaattctttgcgtttcccaggttcaaactctttactagtttcttttcatctaacactccagcaagaaaatctgcaagatttgcataagcgttccctggagcagagctctatcctgatagaagactgaagaatttctccctgtcaatctttacataaatctggcaattcacaggaattgtacatgtaatattaaagcaagttttctaaag

SEQ ID NO: 216332 - DNA, 395 bp, Homo sapiens
ggccaccgaacaccagtgcagtagccaggatgggcctgtggctctggctgcagcctccagggacaccagctggagagaaggaagccacgcatggagagcggccaggctcaaaatatcttaaagaaaatggaactcggagtcagtcatctgttctcaacgtggtcatctcaaaaatatgagcacacggaagttttcttccttcttgtcagttttgagtccaatatcaatactgttgtcctgtgaaagattttaagatttaaatgttttttcatgtaatttcctgatgtcttgattgttgcttctattttgttcatcaaaaccaaacagagtggaggttgctctggggctggatggatggccagtcattaaaatcaatgccttattagtctgcctta

SEQ ID NO: 216333 - DNA, 447 bp, Homo sapiens
cccggcaccacgcgcggctaattttttttttgtatttttagtagagacggggtttcactgtgttagccaggatggtctcgatctcctgacctcgtgatctgcctgcctcggcctcccaaagtgctgggattacaggcgtgagccaccgcgcccggcctaatttttgaacattttgtagatctcactaggttgcctaggcttgtctcagattcttggcctcccaaattgctgggattacagatgtgagctaccagccaagccgtaaatttcttttaaactgagatacagcaccccaaaatatttcaatttgtttcatctacatttggtagcatggtgcttagggaggaatatcaactttaatttcccaggtttaaaaaaattgtttaagtgtcagaacatgatgtttgttcaaactcatgtttccatgtatttgtttatttttttcat

SEQ ID NO: 216334 - DNA, 420 bp, Homo sapiens
actcccagtagttaaatctgcacagaccaggtgaacggacccatgcacgagaaggaacagaaagtacgtttctactgcaaattggactgaggataatttcctacttaaaagattctattaaggatccaagagataaccacagcctcaatttcttcctataaatattcctaaaaaggaggtaaggagtaagggaagccccagaaaagtgtgagtctgtgtgggaggacactccgagtaggggtacatttcatcacttgccagaggaacacagtcaatttcaggaagatacaaggaataacaatgtatttcccccaaatcatcattaaccagtattttggccacacttcctacaaaaacctgaaattagctaaaaccaccctgctgttttcattgcactcaacaagccccagagtagttacc

SEQ ID NO: 216335 - DNA, 514 bp, Homo sapiens
ttcattgtcacctcacctgagttaaattgttgccaaaaagactatgccagggttgccagctcgcgctccggccagtggagaaggtggacactgaccgacgtttccatggcaggtcgtctgcagggcctggagacctggcctaggtcctcccggggcctgccggaccacatgttgcacatgggcctggtgtccgttgcaggtctggggggtgatggagctgtggaggtcacggaattaactgtgtgggctccaggccccttggcactgtgggtgtgggtcttgggagatgctgggatttggtcgtctgtgccccccaactacgtggacactctgggccctcagagattgtagctggatcagaaaagaggcagcctggaagtcaggctgttcataagcaagtcagtcaccggggcctggtagatgacaaagacaggagaatccaggggtcaccggggcctggtagatgacagagacgggagaatccaggggtcaccggggcctgctggacgacaga

SEQ ID NO: 216336 - DNA, 381 bp, Homo sapiens
ctgtgcagaggaaccaaagatggataccacatgtggctttggggaggactagtgtaaagtctaccaatgtccaaggcatggccttggtagaaagaggaccactactgctactcactgaccaagtagtcctctggagtggaccaggatcttctagccttcaaaaaccctttataacccccaaacagcaccttcatcctgtcatccaggctcaaggagaaaccacagagcttgcaggaagaagaggccatgtgagtagagagtgagaactcggctgcctatgagcccatacgaagaagcctcaggatgaaagctacctgaccaacaccttgattttggactcttctagaacacgggaaataaatttttgttgttttataagct

SEQ ID NO: 216337 - DNA, 461 bp, Homo sapiens
acaatagagcaatcaactaacaattagtagagcttaacaactgggtgtggtcagggaaaaagatggtcaaatagagaccttcccagaccactgtcatctcagggcgactggggcatatccaaggctgcatcccctaagaagcaacatcagaggccacatgcttaggagaggaagagggtggaatagactatgctaaaataatccatccagaccagctgtggttgttcatgcctgtaatcccagcactttgggaggctgaggaggaggatctgcttaaactcacctgggcaacacagagagaccctgtctctatagaaaaaaaaaaaaaaaaggaaagaaaaaaggttatccaggtgtggtggtgcatgcctatggttccagctacttgggaggctgacttgggaggatcacttgagccagggaggttgaggctgacgtgagctatgattgcaccactgcac

SEQ ID NO: 216338 - DNA, 472 bp, Homo sapiens
caaggtccttttattaaaaatccaaatgtgaaactcctgtccatctatgggtaatgaaaataaaagtttcatgaaataatatttacccttaatatatgtgatatacttttatattgctatcctagtctatgcatatttgatgttttttaatagtggtcgagccctactaaattgataaaatgacttgttcatagatttttaaatcacaagttgaaagaaactgtttagttaacttgacaagctatcttgatgttgtgtatcactaggtaactgtaaacagtgtagattgtatttactgcccctggaaaaaaatgcctggattttatcattacttcctaaaaccagattaactaatttttattttaatcgtatgttattatttaataattaaatacattaggtatcacattatgttattacccaagccaccaatttgtagaaaggaatattaaatttgttttttaaattcaaa

SEQ ID NO: 216339 - DNA, 488 bp, Homo sapiens
cttttattatttttttatcttatagcttatgcattgagtatagggaactaatgaaaactcatttgtggcttaagcacattgagttcttgaagttttcagagttttgaaacaacttggacttcggagttgtaaaacagaaactacaattttgtttataaattctgttttcagactttctttagaaataagatgacagagagttaaatgatttgaagaggatgggagtgggaagaatggagcagaaagaaaagaatttaaatgagtcacttttgtagcttttggataaatcattcaggtttttttttaacggttaatttagtcttgtagtctggaccatttaaaaaaggaaataggtaattatcattttaaagaaatacaattatttgccatctatcttaaaatacatgtagaccgataatttaaaaatattttactcttaaaatgtactcaaatgatgtaagaacaataaagaagaatttgtttaccct

SEQ ID NO: 216340 - DNA, 472 bp, Homo sapiens
taaaaaatttgaattaacctggaggaagaatggtcagagtggtatcattgttgataataaatagccctacttaattaaacatgcaattttaaaaacagctcttttgtgattaaagttccccattctacatgaagtcttctagaaattcttgaagaaatatgagtaatttcttcttgacatcatgcctccaaataagatagctcaggacacaattttctgtcaccattcccttactttcccaaaaattcaggaaatgttttctgagatccctccttgcacaaggcactcagctagcaagacattcttggacttgctcagtgcttgtttagtagttccttgtgtatatttacttcaatgtactctcatattttgaacttctggagaaaatatgtctgccctcattgcacatttcccaccctaaaatcaggctaataaaaataactcaataaatgctcttagcgaaaagcaaact

SEQ ID NO: 216341 - DNA, 472 bp, Homo sapiens
ttgtgaatgcactgtacttgaaatgaaatggcatacatacacacgtcctttatcttagagcccttgttagaaaatgaattggagctccaattctgccaatgtgtttcactctcttctcacacggtactcagttggctgaagacgcagtgttattgtcccgacttaagaatatgcaaaaataggccaggtgcagtggctcatgcctgtaatcccagcactttgggaggccgaggcaggcagattgcctgagctcaggagttcgcaaccagcctgggcaacaaggtgaaaccttgtctctactaaaatacaaaaaaaattagccaggcatggtggcatgtgcctgtagtaccagctacttgggaggctgaggcaagagaactgcttgaacccaggaggcagaagtttcagtgagccaagatcgcaccactgcactccagcctgggggacagagtgagactccgccttaaaaaaa

SEQ ID NO: 216342 - DNA, 384 bp, Homo sapiens
attaagatttttttttattattggcactgtagttgcaaatattaaagttattatttggtatttcatgagtatacccatcacgctgattttctaaatagtaagttttagtatgctagaagctgatgctgcagaattgcctcaggatgactctggggcaatgttttgtattttgaagtacatcacccaccatggggccccaagtctgacttagaacactctgaaattccaagtatttcaatatttttttccactcccttctttccataaatagctgggattgacctaatcctagcccaggaagaagggaaaggagctaatttaatggaatcaaatgtttaatgtaaagttttgctttatacggaacatggtaacaagtattaagaa

SEQ ID NO: 216343 - DNA, 163 bp, Homo sapiens
ctaagaagattctgagataactcttgtaaatagttttgacatcttaacagggtggcatgaaagcattgaccagctggcacataaaaaccagtctgtatctttaatgtcattcctagagaaaaattctacattctttcccaattttcttagcttttcagaaaag

SEQ ID NO: 216344 - DNA, 525 bp, Homo sapiens
ggaagggagggaagtagattctctttttgggagtgtgagtgaagaaatctgccagtctgcagtggagaggaagccacgatacttcactggggccatgaggagccagaggtgagcaggccaaagggaagcaggaacaggagatgcgaggaaagaacagcatgtggacagtggaaccacgttcctacaagttcaagaatcagtaactgatggaaattcccgtggctcactcctgtaatcccagcaatttgggaggctgaggcaggcaattgcttgagcccaggagttcgaggccagcccgggcaacatggagaaactctgtctctacaaaaactacaaaaattagctgggcatggtggcatgtgcctgcagacccagctacttgggaggctgaggtgggaggatcacttgagcccagggaggttgaggctgcagtgagccaagatcacgccactgctctccagcctgggcaacagagtaagaccctgtctcagaaaaataaaagaaaatttgagtttgcagaaacca

SEQ ID NO: 216345 - DNA, 304 bp, Homo sapiens
gggtggacattggtggttggggtcggtgaggaagggttcccaagatgagctttggccaggtgaggtggcttacactgaggcgggaggatcgcttgagcccagaagttcgagaccaacctgggcagcaaaaccctgtctctactaaaaatacaaaaactagctggctgtggtaacaagtgcctgtggcctcagctactctggaggctgaggtaggaagattgcttgggtccaggaggtcgaggttgcagtgagctaagatcacgccactgcactccagatgggcaacagagcaagactctgtctc

SEQ ID NO: 216346 - DNA, 369 bp, Homo sapiens
ttttacttttatagttttctgattttacattttttactttatagatatacagtatcacctgcagtaataataacttattatttctaatattcacacgttgtagttagttatcttgtctaattcattggctagtacttccaggacaatgttaaataatagtattgatattttcctggtatttttctgtaagggtagatgggacaacattttaaagggaggccgggcatggtggctcacacctataatcccagaacttgaagctcaggcaggtggattgaagaatcacttgagcctgggtggtggacgttgcagtgagccaagatcgcaccactgcattctagcttgggctacaaagtgagactccatctc

SEQ ID NO: 216347 - DNA, 512 bp, Homo sapiens
agctgaattctttgccttgtagaggattcaccatgggtttgtttgagcagtgggctcctctgatcatgttagcacatgatttgatttatgaaattttgatcagcatgcaacttttcatctcatttccaaattgagtcacccatatagacaatcaattggtctttcacattagtgacaaatagaaattgatgactttctccttcatctgtcacctagggggggaatatagaaggatttctaggacataaatctctcccctggtaagcaccttagggaggctgtgtctttcttattcatgtctgtatttccagagtctagcactgtgcttggcccacagtagtgggcttagtaaatgtttgctaaatgaattcactgtggcaagatctgaattttgagctgacccgtcagtttgcaaacttctcttcccccaggaattggtcaaggtttaaaaatgccaaccaatgttattgtcagcccataaaatacataattaggagagtaaatattttacc

SEQ ID NO: 216348 - DNA, 401 bp, Homo sapiens
aataagtgcctctgtctttgaaaatataactgttcttttttcctttcaggacatattttctccctttatgacccaatgcagagcgagacgataactaattattgttaaatagatttatgcacgtgtttggagagtcagggaaggagggctgatgagagagagaggctcctaaattctgcaggtgctgtaattccccggttttaattttgctttgctttttaccaataaatcattttgagagcttaaatcgctcctttcgggacatacggtgtttcttgagcaggaagggacgtcaacggttaaagctcttgttgttggtgcaacaatcagccacgatgaggctgcttggcatggaacacagtgtcccatccttagattaaatgcgctctaacaggattatg

SEQ ID NO: 216349 - DNA, 229 bp, Homo sapiens
gagttctgtttgctcagagagcttatttttaatgatgataataagaaggaaaatttcctagcccttactatatgacaggtaccattcgaagcatgttacatgcattgtctcttttaattcacacagcaattctgaggttgttagtttttattactatacccatctaacagataggagatgaagatctagttaaaacaagcaacaaaataaaaatttgcctaaggccgta

SEQ ID NO: 216350 - DNA, 368 bp, Homo sapiens
gtgattttcatgtggctcaggtctggatagcactgcacaatgtcggaatctccacaggtggggctagccagacgtgtgttgaagaggttcctttagtgattctggggcaagtctctgcctgaaaaaccaccggttcagagaaatagttctcagccgagccaccctgtaaatcatctggggcctaaatacaataaacacagaaaacagtgaactataaatgggtagcatgagggattcgaggaggtggctgaaagaagcacgtatcctgatggcatggttgcgggttatatgactccatgctctgcaagtcagaactcatagaactgcacacaaaaatgagcgaatttcactgtaggtaaatttaaaaa

SEQ ID NO: 216351 - DNA, 421 bp, Homo sapiens
caggttcaggagtggcatgttcttgtgtttgtaaagctagttagtggcagagccaggatgggaagccaagggcctctttcttttctctttgttttgagagagagtgttgctctgtcacccaggcttgagtacagtgacacaatcatagctcaatgcagccttgaactcctgggctcaagtgatcctcctgcctcagcctcctgagtagctgggtccacaggtgcatgctactacacctggctcattttatttatttttgtagggactggctttcactatgttgcccaggctggtctcgacctcctggcctcaagtggtccttctaccttggcctcccaaagtgttgggattacaggcatgagccactgcacccagcccatatcactctcctctcctgtctcatctccactctgttattgag

SEQ ID NO: 216352 - DNA, 668 bp, Homo sapiens
atttgcagatgggagtattatggggggtagaggaggtgatagcttgcaagaaaaaaattaggttgccatttcatattcagaaaactagaatcatttatttcatcttaactcagtaaaaatgacccttcattttagtttgaatcaccaaattccagctatgtaagaagttattattcactcagtgaaatacacttaaacttagttgcctgaggcatattaaataatggtttttgttagtactcttaacttttcttaagtttggaagatgaaagtttagtaaaagttccattttcctcatttgatcatataatttgatactttgggaatcatatagtttagtggttaagagcaagggctctggagtgaaacagacctgagctgaacacctggctctgacatcaggtctagctgtggaatgttgtgactctaaacttaagtattcttactggtaaaaataaagatgtgaaaattaaatattatgcacataaagcacatagcacataaatgctcaggagatagcagcagccatcatcaaactcaccattatcaatcctgtaatttcttttattcctagcatattttttaagtttagaaacactgatagtggtccagatgtggtggctcatgcctgtaatccctacactttgggaggccaaggtgcgtggatc

SEQ ID NO: 216353 - DNA, 601 bp, Homo sapiens
gacatcccaaagtgttgggattacaggtatgagccactgcacctggcctacattcaatttttttaatactaatataacacttttaggagaggggtattagaaaatcaaatcaatagcaattcataaataaagagttggaaatcactgaccttaccagaaggactatgctggagacatttccaaagaaggttttgctcttctctgagagaggagatcttcagaaatacacatttagagactagatatacaaattggctgtttgatggtctttatttaaagtgtataaagagaaattaaactcttcaacctaattgagaaataaatgtgcttagaaacgtccaaaacatgaaaatacatggcatgggcaatacatagcaaggatatgtaacaagagaagtgagttgttttcactacttgtatctaccttttatttgttttcatttattatttctgtgtatgtgcttttaaaaaataccttacgtaggccaaagtgctgggattacaggcatgagccactgtgcctagccacttatttgatattgtctattttgctgtggtaacagatatttgagagaacaatttctggttttgttgacctaat

SEQ ID NO: 216354 - DNA, 510 bp, Homo sapiens
tctcctttactcaataaacacgaagggagcaaaaagctcagggcccttgttcactagaagcaaggagccccctgacctcttcttccaaatatactattttatctttatctttattcccacattcgtccctctttgttcagtgcaacagggattggggctgcatcatatctctttaatatactgattgcttttcttttggatatataccagcagtgggattgctggattataaggtaattctatttttagctttttgaggaatctctttactgttctctgtagtaagatacattcctaccaacagtatataagggttcctcattctccacatcttcaccagcatctgttattacctgtctctcagataaaatccagtttaactggggtgagatgatatcttactgtagttttgatttgcatttctctgatgattagtaatgttgaggactttttaatatactggttggtcacttgtatatcttcccttaataaatgtttattcaaacccac

SEQ ID NO: 216355 - DNA, 437 bp, Homo sapiens
tgacatttctaatactttagacgccaacgtttagcccaggagtacaggaagcaacttcagatgcaaatcgcctaccagcagcagtcccaagaagcagagaaggaagagaaacgccgagagtttgaagcaggtgtagcagcaaacaagatgtgtttggacaaggtccaggaggtcctgtccacccatcaagtgctgcctcaaaacattcatcccatgcgcaaggcatgccccagtaagcttccaccgtagttccgtgagcatcaatatatcttttcttggtcttttaatatttttaactacagtatgcttgtatgcttcttttaactcctggataaacttttcttttttccctgagtttgtgtaattaattgaacataattttcttcctttgaataaacctgtgcctattttggagttcacagacttacaaatccaaa

SEQ ID NO: 216356 - DNA, 346 bp, Homo sapiens
actgattggaaaagtcttctccatgtgttcacagaccattgattttgtgtacaagaactcagattaaaatttccctccgaaatgttagttttggctaggtgcggtgactcatgcctgtaatcccaaagctttgggaggccaggagtttgagaccagcctgggcaacatagcgtctctacaaacaattgttaataattaaccaggcatggtagtgcacacctgtaagtcccagctactcaggaggctgagacaggaggattgcttgagcccaggaattcaaggctgcagtgagccatgatcatgccactgccctctagtctgggtgacagagtgagaccttttctca

SEQ ID NO: 216357 - DNA, 446 bp, Homo sapiens
tacctctcaaatgttcctaaggtaatatctcaggttcctaaagcaatatctttgttttagttggaatacttcctaattttaggaaaacatagtgttaaattttcataagccaaattttgtaagccgtatttattctaagaaaataactgcatgtgacacaaagctgtatatatataaggagactgaggaagagtttttcagtggattgtttagctgtgttaaatgcctctgagatgtcagataagtcaataacataatatactgttcttagctacatggaggtacttggtaacctaaggttcctgaattaacaggagttgatgggatatatagcataagtggagggattagtttttgattggagggcacatactcttctgactcaggagggaaatttataacggagggtccatatgaagttgtttcacagtagaggttaatatacc

SEQ ID NO: 216358 - DNA, 450 bp, Homo sapiens
ctgcctgtgattccccagggctcaggaaggatccctctttgtgctgtcgtagtgccttatatcttcccctgtggtaggcatttatcatgctgaattatatggcactctgaggacagagccaaagattcgggagaatgaatgcaaacatggggagttggggaagcaaaactgaagggattgaggcaagagtgaaaattctttgaagtcttgggaatcttctacttcatttcttaatgcggttttgttttcatatgaaatactttacctaatgaataaaattgacattacagcaagctgtaaattttgtttatattgcagcttcatctattttcagtatcttcttcagtctgaggggttgcaattctatagtattttgtgtactttaaatccatctcctgtgttagctatagggggctagcatcaatacatacatattagtctttgcacatt

SEQ ID NO: 216359 - DNA, 509 bp, Homo sapiens
ccagtggaatgtggacgaggcagccatggggaatgggggaaactgaggaccagatgcagttgttaccaaggatgccaagcagcctagcccaaggcagttcttggatttccctcctgcttacttctccccagcatcctctagtatccttagagtcctgctctgactgcagcccctactccttcggaactaagttactactttgtgtctagcagaccctggaaaaggtgccttcagggtctctgctagctatgtcctatcgcttcccacccagtctattacatgggtccttctgccctttgctcccacctgcctgacttgccagccttctctgtaccacacaaggagcctgagggctttgaggttttccatgccagctcccttctgttctggcttcataaaggacttggatcactgccctgagttaccgctacccagcttctccatccccctcttcctcatctgtatttgtgtgccttccctttactaggcagtgtattcacctggaaacc

SEQ ID NO: 216360 - DNA, 415 bp, Homo sapiens
cccagccgccttcccgcccccagctctagctgcccgcctgccgcctccgctgccccttcctcactccccacccggggggccgtctcccttatctccatccgcccacccccccgcccaccccacaggcactctcagaccccaccagcacattcctaacagctccagctttccaggaaagcaaaaaaaaaaaaaaaaaaaaaaaaaaaaaagaccacaacatcacgggcaggtttatttgggtttgtttgtttgcttgttggctcgattaaatactcgtggaaggtgaacgtaccccacacaggagaagtttgatgttgacaaacttctggtggcagcgagactgtgtcagcacaacttccgggataatgagagctgctttgcagggagcgcggcagccgcggcgggaggcggccgc

SEQ ID NO: 216361 - DNA, 486 bp, Homo sapiens
tgtcttccttagtttctgttacccaatacatcatatccagctttcaataaagaactacaagacacactaaagggcagaaacaatctgaagtgaaaaagtaagcaccaatcagatccagactcagataatagcagatattttagaattatcagacttggaacttacaataattatgacaaatatgctaagttctaatagaagaagtggacatgatgcaagacaagatgggtaatacaaggcaaaatggaaaatctaagaagaaatcaaactaacactaaaagtctaaaatattttaatggaaatgaagcatgacattgatgggctcattaatacactgaactcagaggaaaaaaactaattagcttaaagatatgtaaatagaaactttccaaactaacggtaaggagaaaaaagtataaaaatatagaatacattattcaagaactgagcaacaattacaaaaagtataaatatgtacaattggaa

SEQ ID NO: 216362 - DNA, 465 bp, Homo sapiens
ggctcagcatagtggcttatgcctataattctcaacactttgggaggcgaggtgggaggattgcttgaggccaagagttcaagaccagccggggcaacaaagggagaccccccctcccccgccgccatctctgcgaaaaataagaaaagaaaattagttgtatttcaatacactagcaatgccaatctgaaaatgaaattaagaaaacaattctacttttacactgaaagctacaatattgctgaaagaaattaaataagagctaaataaatagataccccatgttcatcaactggaagactttatatttttaagatgacaatactccctaaattgatctacagattcagttgcaatgcctatcaaaaaaaaattgttgttgcaatgagctgagatcacgccactgcactccagcctgagggacagagtgagactctgtctcaaaaacaaacaaacaacaacaac

SEQ ID NO: 216363 - DNA, 495 bp, Homo sapiens
ctctacttcaaaaaagtgcaacagatagattgtttttaacttatgttaacttatgttaaatatgaaaacttagttgttaaagagctgtttcttttcatcttatagatacagccgtctcagtgcttaaatgttgctcagaggcctttcctgaccattctctgaatactgtatgcccttaccacatgtttttttttttttttttaatttcctggcacatattattacgcaacactatattatttttaaaattttcttcctaatagaatgtaaagccagagactgttattttattcattactaatgcaattgagtacttttttcagtgcctattccaatttttttgcccgtttttctattgaattgctcctccctttatttatttatttatttatttatttatttatctatttatttattttactttttattttcgagacagtcccactctgttgcccaggctggagtgcagtggtgtgatcttggctaacttcaacc

SEQ ID NO: 216364 - DNA, 572 bp, Homo sapiens
catgttccagctaaactacggggtaagtgtgaagacgagagctatccaaagactgaacttgggtatgacaacatgtagaggtttgggagatgagggggattcaacaataacaaagggacatggccaatgaaggagaaggagagcccagagaggggtgctgtagaggccaagaaagcagtttttcttcctggagagggacaggagcagtgtggtctaatgctgctgatgtgtgaaatgagatgaaggctgagtgttgcccattggatcagacagtacaagctcatggtgatctcattggtaatcttataaaagtagcttggtggagtgtgagggcagaagcctaatgagaatggattgaaagaatgtggaatgagatcataccacacccagcaggaacttattcttaactcaagaatcacatgagttgtccttactgataggaattggtgaaacagagactctcatatactccgtacaatctttcttgatgaatacatagatagtgatgcaatgagccatgattgtgtgtgattgcatttcatcctgggcaacaaagcaagaccctgtttaaa

SEQ ID NO: 216365 - DNA, 435 bp, Homo sapiens
caacctgagccatttgctttgctggttctctaagcaccgcttccatattttggatttaataaagccgcagtaagacttttgccccaaccacctttttgtgcttaattgttaagctcatatacaatgggaaggaaatagaatccatatgtttctactcatttatacttaaatcatccaaatatggtgttgtaaccccaatttgtcattcacagaaactttggagacttaaatttttggaggcctgtcccaattctccactcttttgtggtcctcaagtaaatacatatatttgaattcaagagtttgagagatttataagaaattccaaaataaaattttcctccctttgttggttttcctccaacctcactgaattgtctcagatttttttttgctggctcttcttcttctactcaaactcttaagttggactgc

SEQ ID NO: 216366 - DNA, 393 bp, Homo sapiens
aaaaacaaaaaacaaacaacaaaaaaaccttgtttgtcattatcaccccacagatctttttagacatttttttcctaatcaccccacatgaaaatttagtaacatagatgtcctgtatatttgcttatatactatatgtatatcagtgttctgctgtgttttttacattaaaagagtaagatttttttcacccctccccctgccacaaaccaatttttgtccttgttgagaatgcatgccgtaaagaataggaaaaccttccaatggaatctcatacagtcttttaagaagaatcaagttccttactcagaagggtgaggcaagaggatcatttgaggccagcagttcgaaaccagcctgggcaatatagtgagaccgcccccccatttctta

SEQ ID NO: 216367 - DNA, 185 bp, Homo sapiens
ctcagggtgtggtcgcttatttatgcagccctccaatcatcacatttattaagctcctactctgtaccagacactgttctcagcactggggcgacaatagtgaataaaacacaaaaatctctgccttcatggaatgtacattctagtggggattaaaaataaacaactaaaacgcatagtgcgtt

SEQ ID NO: 216368 - DNA, 197 bp, Homo sapiens
ccaacccaagtgtgcctgatgtcaactctgatctaagatgtggacgcacatgggcagaatgatgacgtgctcttcccaacctctcatttagccagcatgtgagagggcaaggtgtcttcagcaaccatttcatttgtaaacatacgtgtttttatccttggtctacgcaatagtattaccacacaggtaataccagt

SEQ ID NO: 216369 - DNA, 215 bp, Homo sapiens
tgagcgccagtaggaactgagctccacactcaatctggcacaccccctgtccatttagtctctcaatgttctggggaatgttgcagccttcacttccgccccggcccaattttccaaagtcaccatcaccccaggaaaataccaaacctaggtttaaaaatagggaagggaagggaagggagagaagaaaggaaagataaagaaagcccaacctc

SEQ ID NO: 216370 - DNA, 612 bp, Homo sapiens
agaaatgaaagctcaggtccacacagaaacttgtacacagttattaataaaagctttctttgtaatatcccagaagtcccaactaaaatgtcttagcaataggtgaatggttaaactatggtacctccatatcacgcagtgctgatgagcagtaaaaaacaacttggacatctctcaaaggcattttgctgagtgacaaaagagaatctcaaaaggtcacatactgtatgatctcactttataatattttcaaaataataaaactgtagagatgaacaacatattgatggttaccaggtattagggaaagaagactttaggggagtaggtatgacaatagaggggtagcagggaggagatcattgcagttaaagaatggttctgccttttgattatggtggtgtttaaataaatatgtgtacatatgataaaatggcatagaactatacacacacatcatattaatatcaatttcctggttttgatattggattataggtagataagatgtgaccattgggaggattggataaagggcactgagaaactaatatctttgcaacttcctgtgaatccataattatttcaaaataaagagtttcttaaaaactg

SEQ ID NO: 216371 - DNA, 462 bp, Homo sapiens
agcctggcatttatgatcaacttcatttttgtttcttggtttttttctttctgttattgattgcatattcttcatctctatctgcacaactgagattggtgtgttagtgccactgtgttagtgttagttagtgctagccaagggcaagaagtggagggtggggggaataggcggacgagattgggtgaccaactcttcccagtttcccaggacttttccagcttttaaaactgaaagtcccccattcatggaaactcctcagtcccaggcaaatcaaggatagtcaccctagaggaaggatagcttgggtgggggaagaagggaggataaaggctactgataatgttatttatactaacatccctgctttagtccaggtgcttttttcactcaacattaagtttgtaagatttatttgtattgttacatgtagctgggtgacagagcaagaccgtgtctcaa

SEQ ID NO: 216372 - DNA, 269 bp, Homo sapiens
cagtttagcccttgaatatggccaatgacgtgttgcagcaagctgagcacttctattacatgcaaagactctgactgcaaacatccaagtgggcaagggattatcaagtttagcaatggactaaccaaaaactgcattcgtgtggaactgaccacaagctttacattatgcttttgctcctttcttgctcattacccattgtataacaaaatatgcccagacttgggctttaataaaaaatttcttagctctcaattttttgtggtttg

SEQ ID NO: 216373 - DNA, 208 bp, Homo sapiens
caatgggatcgtggaatggtagggctaaaacatgagccaaagtcaaaactattttttaaagtgaattatatccctactctcttaatattttgaaagaactgtagtcagaatcctagacccatggctataagccatcatcagacctcagaccaatatgaatcttgatgtagtaacacccattttttcttttgaggtatagtttacatat

SEQ ID NO: 216374 - DNA, 502 bp, Homo sapiens
actattaatacctgaacttgcttaccaatatacaaacaaactgggggaaatgccctttagtttcggtttcccataataagctgtatagaaacagttttttttttccttgcgtaatagtagagcatgttgctttgtactttttttttgtatctataagaacaaaaacttagaaaatatttcttgagaaatgagtatatttttaaagattcaaggctaatgagttttaattgaagttaatatgaaattatttaatcacttttattaatgatttctactctgcatttctctgttgtgtcccagaaattgatctttggaattctaaatcatttaaaatcaaaacctagtcttagtcgatgcacaatatggggaaacttcaggtcaaggaagagaagaaatatttttaaatagtatggactatagagtctttcacctatttgtagtactataataaacagataccgtgaacaattaaaacctcagaatcctacaaccctgtatctta

SEQ ID NO: 216375 - DNA, 588 bp, Homo sapiens
gatcccatcaatccagtcccagtcttccattagtgcccagttcacctggtcacaacaccgtctcattggatgctatgatgctttcttccccactggctgaccaggctccacggacctgccctgccatgttatgcccctttgtatctgcttcggtgcctagcacaggctcaacacatgacctcccagtaaaggaatggctgggttttcaaaggcctgggccacaaaaaaggcaaatgctcacctgatgaaaaagaagtcattatgtatcttggttccagaaacatagccatgagccaacctctacatagatacattactacatacttacatgtgtttatgtatacatatatccaggattctcttggtaacacaaaatgttgagaatagtaacaagttgaggttactgaggcctgatactaatcatgttgaggtcttacatgtaaatagaattggagtatagtcagaagggcagaggattttttaatctggttcttttcaattttctatcagaaacctaattcagtggttctcagtcatctgatgattctgtatagcagtggaaactttaataaataactgatgtctgtg

SEQ ID NO: 216376 - DNA, 573 bp, Homo sapiens
tgggcaacatagcaaaaccctgtctctgtaaaaaatagaaaaaattagctaggcatggtggcatgcgcctgtggtcccagctacccggaaggctgaggtgggaggatcgcttgagcccaggaagtcgaggcggcactgagctatgattataccactgtgctccagcctggatgactgagtgagaccctgtctcaaaaaacagaacaaaacaaaaaaaaattgcagttatgccctgagccaaatgttgagcttttctgcccacaaagtgcaaaattgtagtactggcagaggtgcaacccaaggggtcgccagggttctcaccgcccttggccatggggcaggctgatctagacagcagggggatgttttcagggctgaaggttccccctacctagtcgtgaacacatcgggtgctggagcacctgtgttcccatgaggccagcgtgggccatgcatggcttcaaaaggccctcgaggcttgactaagtgcgccagtttcattctgaacatgctgctctaaaacacatccctgctgagccacaggaggatcagatattgtgagcttctggcccg

SEQ ID NO: 216377 - DNA, 530 bp, Homo sapiens
agcctcagtttcctgagaaataaatgggggtaattatagtgtctactttatagtctggttgtgagggttagattatttaatacatataaaatattagaacagagcctgacatattgtaagcatgtgacaaacattaatttttattaatatttaacagctaattgcatccttattttaaagttttccatttttttctattttccatatggtagaggttaaaatttgttgatttgatttaattatgtatagtataatgccaaagggaatctttcttcaaatttttaattatattgtaaagagttactaattgacagttttcttataagttagcttagttataataaaatgtttaaaaagtgaacataatgaatacttattacctgaattaatattacatataatatacatataattatgtatttattatataaaaagtttatttgattatttaaatttgtattcatttatgtaaataaattgttatttttattaaaattgataaattttatataaatataaaactaatataa

SEQ ID NO: 216378 - DNA, 191 bp, Homo sapiens
tccagattaaccatcaactaggagtctccagattaaccatcaactaggagtctccagattagagtaaccatcaactaggagtctccagattagagcaaccatcaactaagagtctccagattaaccatcaactaggagtctccagattagagtaaccatcaactaggagtctccagattagagcaaccatc

SEQ ID NO: 216379 - DNA, 442 bp, Homo sapiens
gaggcggaggttgcagtgagccgagatggggccactgcactccagcctgggtgacagagtgagactccatctcaaaattaaaaaaaaaaaaaaaaaaagaaagaggttaatctagaattgtgctgagaaacacccaatgactcaatggtcccaatgtatctaagacagagttttaacttggttctgtctaagtaaacagaactaaaattaaggcgatcactgtgaccatggattactcattttaaccatctttagcatatttgctcttgggttatgaaagccattactgtcaagagaagagataatggggctgaacttcacagaaattcagaaggatgccttgaatgtcttctgattctcatcctttttttgtaggatgctcaagcatcatggcatcatttccagtggagtcgctgaacttgtaggttgtctacctgacacc

SEQ ID NO: 216380 - DNA, 585 bp, Homo sapiens
agtcccccttatcctcaggggatgcattctaagacctccagtggtgcttgaaaccgtggataatacggaaccctatatatactatgtttttctcctatacatacatacctatgataatgtttaatttataaattaggcagagtaagagattgacaacaattactaataataaaatagaataattatgacaatgaactgatataaaaattttgagaatgtggttactctctctttcacaatactgtaatatttttttggaccacaaatggccttgagtgactgaatccatagaaggagaaactgcagatgagggggtactactatgtgcttcagataggttatattatgaaatatatatcattcatatatatacaaatataattatccaaattatatttcacagcaagtacaaactgaccacaatgctttatagcagagagattgataaccttaccagatgagacagcataatctagctagaacagtcagtcacctacggcattgctctccttcaaatacctttgtcagtatctgaacactggccctttaggtaactatgaataaccaagggcacattttttccct

SEQ ID NO: 216381 - DNA, 462 bp, Homo sapiens
tgggtctccagagagatgaagatgaagcaagattgggagaggggcagaaagggggaggctcctcagacagagtaggggagaggaggagggatttggagccagggcagacagagcagcatggtgctgggacagcaagagggggcagctgatgacaaggagagcagagggagaaccacagcatggggaggcctgggatccgggggggccagagagtggggacaagagagtgtagcagggaagaggaaatttaacagggagaacagagaggaagcagagatagggagggcaagaaacaggcagaatggaaattggggacaatcaaaaattggacacaaagaggaacaaggggtaaaacaaattgccagaatggagcagaacaaatggaagagaaggaatagagggaagagggggagaaacagcaggagaggagaggggcagaaaaataagccaattcttatggga

SEQ ID NO: 216382 - DNA, 551 bp, Homo sapiens
tcagctgagctttgaaatggggagctggaaaaataaagcagcagtttatataggccctgaggcaagagaacctcatgagttatgagaactactgtaggttctatgtagctagagaacagagaatgagagggcactggtaagagctgaggatacagaggccgaaggacatcagattggcaggacattttatgccacactacagaatttgccttaaatgcgccgaggagctattgaaggcctttgaacagaggcattatataagtcaggtttcagctgcaaaaataaaccactgtagttcttttcagcagaaggagttttaatatagaaaataaagtgcttacaaaattggtgggagggctggaggggcaagctttaggctatgcctccaagaacagtgtcagggtagctgctctctctgacaagcaggaagatgaggcgtcaggggctctaggagcatgctgccttgtctgcaatttaggaatgaggaagctgccacagctctaaccatctgttggctagagtatcactatgcctaccagatcctcagtgac

SEQ ID NO: 216383 - DNA, 565 bp, Homo sapiens
aagtagagattgtacagtgtgaaactacaatgtctgaattaatatctgaaacaataagaatatgttaaaagttgtgagagaaaattactatcctcttagaaatttctcaaaaaaaggatgaaatcgtgatagtttattcaaacaaacacaaacttcacttctaagtgtgccatctagcttcataaggtatacttcaggaagaagcacacataaatagacacatatatatttatttatatatatatatatagaccaatataaatatttctgtatgtatgtgtgtgtgtgtatatatatatatataattttgtacggatactatattctcaataaaatgttttttaaaaactacatgttcatagcagaagttttgcagtgttaatggactatggtgctgggagaaaatggcattagagaaaaatagtaaccatatactcaaagatgaaaaagttcccaaaaggaaattaactgtaatcttaaatatgaagtacttgccagacaaggacccatagtacacagaagaaagtgcagagggcctatgactgatggaaaaggataggacccc

SEQ ID NO: 216384 - DNA, 905 bp, Homo sapiens
  misc_feature (650)..(650): n is a, c, g, or t
  misc_feature (896)..(896): n is a, c, g, or t
tttactaggttccagaccctgcggcttcagaggatttttcctgaggtgctggcagagcagctcatcagttacggcagctgccagttccccacactgggctttgtggtggagcggttcaaagccattcaggcttttgtaccagaaatcttccacagaattaaagtaactcatgaccacaaagatggtatcgtagaattcaactggaaaaggcatcgactctttaaccacacggcttgcctagttctctatcagttgtgtgtggaggatcccatggcaactgtggtagaggtcagatctaagcccaagagcaagtggcggcctcaagccttggacactgtggagcttgagaagctggcttctcgaaagttgagaataaatgctaaagaaaccatgaggattgctgagaagctctacactcaagggtacatcagctatccccgaacagaaacaaacatttttcccagagacttaaactaacggtgttggtggaacagcagacccccgatccacgctggggggcctttgcccagagcattctagagcggggtggtcccaccccacgcaatgggaacaagtctgaccaagctcaccctgcgccaaagtgctaggattaacaggcaggagccatcacacctggtctcttcccccanttttaaattgtgttgtctgtctttgttgttgagttgtaggagttcttaatagtttctggatatcagatgcctttgtggttttcacatctctgcaggcaactgtgtgtctcaaaagcaaactgcaggattgggctgcaccatggactgggccaggcatctgagatcagacagacccaggctcagctcccacttcctggcctcttctgccaccctgggtgtgcagcctcatccttggagccccagttncgctcatcc

SEQ ID NO: 216385 - DNA, 727 bp, Homo sapiens
gtcttttaaataaaaaacttgaaatatactgaaggtcatcttaaatggatacagtttatgctaatggatgatattattactttaaaacaatattttacaatcaagctactccaagtggcacactattcatcctagagatctttaaaagtaacaagcctgcctcctatttttcttcattcacagaaaggccagtctagaacgcacgagctgccccttcaatctcactaccccttacatacagcctcacactcagtctccacccacatttatttcgctacgtatcactccaccccactatcatccctcacctcccctctctcactctctactcccccgctccttctcctccctctccctctccctctatcactcgcctctatcccttcccatccaccttcacttcctattctccctcctcctccctccctccctcctccactaccttccacccaccctcttcccttcccctccctactctcacacctccatctcccccctctccacccaccctcccctctctcatccccttccctcttcacgcctacctatctcctccttctctattcaccgttccccatctctcccatctccctcctcactcctcttcctcctacttgctctctcatacactctctcaccaccttctcctcctctctcctctctacctccatactcccatctctcctatcccctactttacgcacttcttcctctctacccctctcct

SEQ ID NO: 216386 - DNA, 1015 bp, Homo sapiens
caaacccggaagcgggtcgcgtggagtgacggtcccaccgcggggatatctcttccaaatgcatgatgaaggagttctcatccacagcgcaaggcaatacagaagtgatccacacagggacattgcaaagacatgaaagtcatcacattagagatttttgcttccaggaaattgagaaagatattcataactttgagtttcagtggcaagaagaggaaaggaatggtcacgaagcacccatgacagaaatcaaagagttgactggtagtacagaccgacatgatcaaaggcatgctggaaacaagcctattaaagatcagcttggatccagctttcattcgcatctgcctgaactccacatatttcagcctgaatggaaaattggtaatcaagttgagaagtctatcatcaatgcctccttaattttgacatcccaaagaatttcttgtagtcccaaaacccgtatttctaataactatgggaataattccctccattcttcattacccatacaaaaattgggaagtacacatgagagaaaaatctttccaatgtaatgagagtggcaaatcctttaattatagctaactcttaaggaaatatcagataatccatttaggatagaaacaatataaatgtgaggtatgtgacaaggtctttaatcagaattgattccttgtatgccataatagatgtcacactggtaagaaaccttacagttgttatgagtgtggcaagaccttcagtcagacgtcatcctttacatgctatcgtagacttcatactggagggaaaccttacaagtgtagtgagcataacaagacctttggttgaaattcagcccttgtaattcataaggcaattcatactggagagaatccttgcaagtgtaatgaatgtggcaaggtttttaatcagaaagcacaccttgcacgtcatcatagacttcatactagagagaagccttacaaatgtgaagaatgtgaaaaagttttcagtcgcaaatcacatcttg

SEQ ID NO: 216387 - DNA, 839 bp, Homo sapiens
ctcgactttgaggatcccctccttgtaatccaagcagtcgcatcaggagctcttcgtagacatttgttcagaaaaagacaatttaagagaagaactaaagaaaagaacagaaactgagaagcagcatatgaacacaattaaacagttagaatcaagaatagaagaacttaataaagaagttaaagcttccagagatcaactaatagctcaagacgttacagctaaaaatgcagttcagcagttacacaaagagatggcccaacggatggaacaggccaacaagaaatgtgaagaggcacgccaagaaaaagaagcaatggtaatgaaatatgtaagaggtgagaaggaatctttagatcttcgaaaggaaaaagagacacttgagaaaaaacttagagatgcaaataaggaacttgagaaaaacactaacaaaattaagcagctttctcaggagaaaggacggttgcaccagctgtatgaaactaaggaaggcgaaacgactagactcatcagagaaatagacaaattaaaggaagacattaactctcacgtcatcaaagtaaagtgggcacaaaacaaattaaaagctgaaatggattcacacaaggaaaccaaagataaactcaaagaaacaacaacaaaattaacacaagcaaaggaagaagcagatcagatacgaaaaaactgtcaggatatgataaaaacatatcaggagtcagaagaaattaaatcaaatgagcttgatgcaaagcttagagtcacaaaaggagaacttgaaaaacaaatgcaagaaaaatctgaccagctagagatgcatcatgccaaaataaaggaactag

SEQ ID NO: 216388 - DNA, 830 bp, Homo sapiens
tatatttaggttaattaaagaaaataagaagcatcaggagctcttcgtagacatttgttcagaaaaagacaatttaagagaagaactaaagaaaagaacagaaactgagaagcagcatatgaacacaattaaacagttagaatcaagaatagaagaacttaataaagaagttaaagcttccagagatcaactaatagctcaagacgttacagctaaaaatgcagttcagcagttacacaaagagatggcccaacggatggaacaggccaacaagaaatgtgaagaggcacgccaagaaaaagaagcaatggtaatgaaatatgtaagaggtgagaaggaatctttagatcttcgaaaggaaaaagagacacttgagaaaaaacttagagatgcaaataaggaacttgagaaaaacactaacaaaattaagcagctttctcaggagaaaggacggttgcaccagctgtatgaaactaaggaaggcgaaacgactagactcatcagagaaatagacaaattaaaggaagacattaactctcacgtcatcaaagtaaagtgggcacaaaacaaattaaaagctgaaatggattcacacaaggaaaccaaagataaactcaaagaaacaacaacaaaattaacacaagcaaaggaagaagcagatcagatacgaaaaaactgtcaggatatgataaaaacatatcaggagtcagaagaaattaaatcaaatgagcttgatgcaaagcttagagtcacaaaaggagaacttgaaaaacaaatgcaagaaaaatctgaccagctagagatgcatcatgccaaaataaaggaactag

SEQ ID NO: 216389 - DNA, 549 bp, Homo sapiens
ccatttacgagcatgaaagctttgataatctgccctgccagtgtaaacccttaggtgtgtggaaaaaacagtagagactagtcacagaaggagtaaagcttagaaacaatggctgtaggccaggtgtggtggctcacgcctgtagtcaagcactttgggaggccaaggcatgggggttgcttgagcccaggagtttaggaccagtctgggcaacatgatgacaccctgttcctacagaaaaaaaagaaaaaattagctaggcattgtagataagatccttgactctgtgtgtggttgcccatacagtaatggaaagcttgtctcctcaaagtcaccatcttactggttaccgccatcactctaccactcttcacgaatatccaggtttcattcttattgagggattgcttatcccaataccaaggtcacgtgtggccatatggcttttcttcattttctctaacatggctgccaacaaatgacatgtagaggttggcctggaggcctgagaatacagcagcactatcagctgacctgagaggaacatcg

SEQ ID NO: 216390 - DNA, 417 bp, Homo sapiens
tgagatggagttttgctcttgtcacccaggctggagtgcagtggcacgagctcagctcactgcagcctctgcctcccaggttcaagcaattcttctgcctcagcctcccaagtagctgggattgcaggcacctaccaccatgcccagctaatttttgtattttttagtaaagagggggtttcactatgttgggcaggctggtctcgaactcctgacctgaggtgatccgcccacctcggcctcccaaagtgctatgattacaggcatgagcagccgtgcccagccttaaccattttttgaataccctttatttatagttggggaatttacagttagagaaaagactgattagggataagtggcatagttgattttgctgtttccaatgtattatgttattaattaagaaccccaaaa

SEQ ID NO: 216391 - DNA, 502 bp, Homo sapiens
tgggccaagtagggttggtagaaaccacacgagcactggcggtgttaagaaggcttgagtctcctagcagtagccaggaagataaacccagttgcctgctgtgtctggaggccagactgcttggccaaagaggcagtggccctttcctcctctgggagtttgaggatggtggaagggaaaattgcaaataacatccagaggaatgacactaaaattctagcattaagtaaaatatgtgttgtttaaactctgatttcctgaacagcttaaacccctaaaagtcagagcatctcatggtttattttaatctctatcaatttccatctgtgtctacttggagacctgctcttgacaagctcttcaaggtggctaactgtgcaatattacctctattaatagtctctctcaaacctggctcctaattgcactaataaggtgggtctgccatgactgtaaggaatccaaacaatactgctttccccaggccaatcacagtgtgttg

SEQ ID NO: 216392 - DNA, 295 bp, Homo sapiens
agttaaaatattcccaggttaaaatttttttaaagtaccaataatagagctaaatacaatgacatttgcttttaaaaggtggatattttatttctgctttttgaaaatacttatttagtattgacttggaagccaatttggtcctttaataagtaaagaaaataatatgtttaaaaatgtaaatgttttacaaatttgaaactttcataattgtattaatcagaaaacaagcacattgccattctttgaaactcatgtttctagacatgacagcagtaataaaaggatgaaaaca

SEQ ID NO: 216393 - DNA, 899 bp, Homo sapiens
  misc_feature (680)..(680): n is a, c, g, or t
  misc_feature (896)..(896): n is a, c, g, or t
  misc_feature (899)..(899): n is a, c, g, or t
gcaccatgaggcgagggccccggagcctgcggggcagggacgcgccagcccccacgccctgcgtcccggccgagtgcttcgacctgctggtccgccactgcgtggcctgcgggctcctgcgcacgccgcggccgaaaccggccggggccagcagccctgcgcccaggacggcgctgcagccgcaggagtcggtgggcgcgggggccggcgaggcggcgctgcccctgcccgggctgctctttggcgcccccgcgctgctgggcctggcactggtcctggcgctggtcctggtgggtctggtgagctggaggcggcgacagcggcggcttcgcggcgcgtcctccgcagaggcccccgacggagacaaggacgccccagagcccctggacaaggtcatcattctgtctccgggaatctctgatgccacagctcctgcctggcctcctcctggggaagacccaggaaccaccccacctggccacagtgtccctgtgccagccacagagctgggctccactgaactggtgaccaccaagacggccggccctgagcaacaatagcagggagccggcaggaggtggcccctgccctccctctggacccccagccaggggcttggaaatcaaattcagctcttcactccagcatgcacatgccctctttctgggaccaggctaacnctgcagaagcacagacactacagaccacagcattcagcccccatggagtttggtgtgcttgcctttggcttcagacctcaccatctttgacagcccttgaaggtggtagcccagctcctgttcctgtgccttcaaaaggctggggcactatgagtaaaagaccgcttttaaaatggggaaggcaccattaagccaaaatgaatctgaaaaaagacnaan

SEQ ID NO: 216394 - DNA, 549 bp, Homo sapiens
ccccccaaagatcattcgctaattaacgaaatgaaatattagttcagggtcttaaagttaataaggatcttgaaaactatatttaatccgattcactgtagagaaacacaattattaatgatactgtgagatgacattttaataattttacccagatagatatggagaataattaagtttacagttatctcaagtaccaaggaacaaacccttttaaacattagaattaaatttacctgaacacacaatatttacattctcataatgttggccaataaaaccagtaatgaaaatttgagagttttcaactaattaggcttttcatgagaacataaccaaagtttgtacataatataaaaaattatgcttagagggagaagacatagctatttttaaaccaaaattttcaaaccagtctgatttgtctcaagatttgccttaattggaactatcataaaatatgcccttaggtaccacatatcagaggagtttttattggccttttttttctgaccaccagttgtcattcaacagagcagccagttctgc

SEQ ID NO: 216395 - DNA, 493 bp, Homo sapiens
atgtcagaggatcccggaagactgacataaagggaggcaaggaaactagtgatgactggtatatggtgtctaagttgttgatttttttacagtgtgcatatatgttacctatttaaaaagctaaagcttaaaaccaaccaatctatgttcaaaatcaaaacaaaaaaattcttctgcctcagcctcccgagtagctgggattacaggcagtgccccacgtgcttggctaatttttgtatttttagtacagatggggttgcactatgttggtcaggcttgtctccaactcctgatgtcaatgatcttcctgccttggcctcccaaggtgctgggatttgggattacaggcatgaaccaccgcacctggcattaaaagcacccttaagtcaacgttgcagtgaatcacctgacgccaagagcatttggtgaggctggtagatgaaaggataagcagttttttgatactctgtcacccaggatggagtgcactggc

SEQ ID NO: 216396 - DNA, 389 bp, Homo sapiens
ccaggctggagtgcaggggtgcgatcttggctcactgcaacctctacgtcctggattcaagtgatccccttgtctcagcctcccgagtagctgggattacaggcagtgccccacgtgcttggctaatttttgtatttttagtacagatggggttgcactatgttggtcaggcttgtctccaactcctgatgtcaatgatcttcctgccttggcctcccaaggtgctgggatttgggattacaggcatgaaccaccgcacctggcattaaaagcacccttaagtcaacgttgcagtgaatcacctgacgccaagagcatttggtgaggctggtagatgaaaggataagcagttttttgatactctgtcacccaggatggagtgcactggc

SEQ ID NO: 216397 - DNA, 261 bp, Homo sapiens
atgtgtgggggcagctggtttggtatgtgtctgggcatctggttggtgaacatgtggatgtctgggctgttgggctggggacctggagggggtatatgtctggatggctggaggagtggaagaggttttggggtgaggtcactcatggtgtctccagcctcccattgtggtttcaggcttcttggctctcagcaccttgctgtctccccaacaagctatacaggtctgtcctgggcaccttctcagtcatgtcaccctctc

SEQ ID NO: 216398 - DNA, 431 bp, Homo sapiens
ccttggttcttctttccgcagtcagttctaatgtaagatatgatacacctttccatctttggaaccccactatatacccttatttctacatgttctgtactttcctgggaaggggaagtagaaaagggaagaggttaatgttctttctggaatgtccatccacaatgtggtgattctattggagaggtaaacaagactcctgtaatcagaagggacagctgatggatctggataagaaattcgaaatctcgaagcttatgaatgtgcaatagatgttatttaatgctcattgtaaattcagattttgggcttctttatacttaaaggaggctttgaattttaaggctaaaatagaatcatgcatcttctttggagtgtttcttaccgaattattttttattttgctggaagcttttattgaagtttaaact

SEQ ID NO: 216399 - DNA, 382 bp, Homo sapiens
gacgtgttggtttaacgcaattgaggtggaatttacaaaaagttcagctataatcagttatatactagaacccctagcccagggtaaagtagcctcctcaattgtgttaagagtcacatcagcagtttggaaagattgtgaaaggtccaaggctttggaatagattcagaaaagatagatgataggtagatagatggtgtgtgaaataaatagttttgaatgtaaatagaagcctagtggtaagtaagttaccctggtcttctgcatttctgaatacaggatacctataacttacaaactatacctctaaagaaagatagcactcattcttgtgcccattttaaggactaggaaaatgtttctctttgttgttcacaccatt

SEQ ID NO: 216400 - DNA, 463 bp, Homo sapiens
gagttcccacaatgtggaagcaacgaggaaggggtttctggtcccggttctgaaggctgtgaccttcagcgcacaatctatacaatgctgatagccccggcacctctctctctcgggtagttctaaggattaaatcagataatgcacacggaaatacgttacaaatggaagtgttgttgttcttccaagtttgcaaggagaggcagcggcagtgttcttgcagtgtgtctgagttccacgtgacttatattggattattatataaatcctgtaattgatctgtcatacttttatgtccattctttatgtcatatttctctctcacatatacatacacagttgtatacatacttaaatctctatgtattagcagtctgcacaacatataccttttaatatttatatttctgttcagttctgttcataccacagaatatgtgttataaactcttttattaagctt

SEQ ID NO: 216401 - DNA, 524 bp, Homo sapiens
gaattttccccctggtgtagcattaggtctaactgcataggggactgacttttaaactctggtgaggggctaccctgtgagggaccatgctggtgacagtcaggactcactgctgcaggcctccaggcaagaagaactttggggaccctattgaagaccagcaagggaacacggaagcagtacagacaagacaggctctcagccaggctatctggggtcccatctcagctcaatctatgacaagttgatggatggctctggaatttggagtaataattatctgcccagtccagccctggagccaattccactggaaccaacatggtctgtctcacctcccaccctaacctatctgattcaccacacctccagactctgggctgggccctgctattccttatccaggcccaaagagcccagagcacacatcggctatgaagtattgtctaaaaacatttatgaaaccttacaaaaattcaaaaaaaaacagcaatgaaaacttacatctccctcatcaagttcaa

SEQ ID NO: 216402 - DNA, 303 bp, Homo sapiens
  misc_feature (170)..(170): n is a, c, g, or t
aatagccggacccgtctcatcatacctaccaggaaggaatgttctcactcccaaattccaggcacagactttgccatcattcctgttcctggggatttaggaaagatagggtttttgttttgttttgttttgctgtatttagaggaaggctctcgctcctgtcacccagngctggacgtgtggatggcacagagcatacgcaccgtggacccccactttcaatgtgatcctcccacttcagcctcctaagtagataggactacaggcatgtgccaccacgcctggttaaagataggttttgtc

SEQ ID NO: 216403 - DNA, 477 bp, Homo sapiens
tcatcaactgtgaagaacatttcatactttatagtattatatttagaaggtgattaatcacaggtgttaagaaagaataatttttattaaaacactagcaatcaatcagtatatccttagtacagtacttgtaatcacattttaagccatgaaagttcttcgactgctctaggaagagccataatttccaagtagaaaaaataaattcttttcactaaacatttgattaagggaatgagccctggaggaccctttgaacatttctccgttcagaaatcaaaaggtattttaagaatgatatttatatttgaccaaggagttggataaagagaattactttttgactccatcacaaagtaaggcacttcgaagcttctttctaaaaaaaaaaggaatgttatttctgctcaaaagtgaaggtataataaatcatcgtgactctcaactcacatgtaaacattaaagctaatttgtctc

SEQ ID NO: 216404 - DNA, 248 bp, Homo sapiens
gcagttcatctttgaccaaaatgttatgcagcaaatgaccgtacttatttatcctctactttttaactttattggttgtttcattaaggtcagttttatcccagctagataatgactgcatagcagcttctgtagcatctacgacagtatagtccagttactatctcatagaatgttttaatgaatcttgattatttaagtgaaaatttaaatttaaataaaaattttaaaaaattttaccaaaatga

SEQ ID NO: 216405 - DNA, 433 bp, Homo sapiens
ttatgtcaaacaacaggaaatttttttcaggagtatagataaaaagtttccagtgaatttttttttccccacagtttttttcttcccacccactactcaaggtagttatgaatgttactgctatttggttacacagagataagttattttgctgtttagttatttcttatatttctgaaatatgcttaagtgaatgttgtattaaaatagctgtctttaaaaactctctatttaaaaatgtcttacaatactacattcttacagacctgtgtctgagccaattattgatgaataatttgtatagtttagaaagttatataaaaggttatttttcattttgttggggagatggttagttaaatatgttttatatttttaaaacatatctttttgtccttgtttatgcaaaggtaatagggaatggtacttactt

SEQ ID NO: 216406 - DNA, 398 bp, Homo sapiens
aaagtagccgtaagtgctatggggaaaatgaaatggataaggcttcttagactgcaagcagagaaggcctttcccagtggcaggaaagagccagccataagaagatcttagggatggcattgcagaccgaggcaccaccaagggcagaggcttctagtgaggcaggagaatagggtctggaggcagggaacctaaggccaattcatgctgactagatgtcagcgccaactcccttttcaacccctcctttttctgtgtggcagttgctgtgtggcggttggaaaatgaaagtacctctgattggtcctctcccacgaccaatcagactggccatgggccactacttcatttgcatcgactgaaccaatgggaaacttctagtgggtatttaaaccccg

SEQ ID NO: 216407 - DNA, 252 bp, Homo sapiens
ctgtatcggcacacaacctcctcacatgctccctcaactcccacagcactgacgggtcccaggtttctagcattttagcattatgagaacgttacatcaatgaaagcacagagcatgcaaccttctgagactggcttttgtcactcggcaaaatgcccttgagatctctcctggctgtcgtgcatcaatagttcattcctttctgcggccgagtttcactccaccacgaggctctgagctaaggcttcctgc

SEQ ID NO: 216408 - DNA, 480 bp, Homo sapiens
gtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaaaggatgtgaaggacctcttcaaggagaactataagccactgtaaccattttttaaagtgatctataaatacatttattgtactttattaggagaaaataacagtcttataccattatgtagagcatgatttcattcttctaaatgtactcatgtaaacacatatatatgcacacatagatctatagatatatctatatctgataatcctaggtaagtcagaagagatatactacatttcataactgaattgagtgtctgtggaactcctatagcagaaatcacacttcatttgaaacttcaaaattcccattaaaattctgcagcaatgaagacgcat

SEQ ID NO: 216409 - DNA, 400 bp, Homo sapiens
ctggcattcgctttaatctttctctattaaaaagaattccacagcactcagagaagagagaggaatttaaatatttctttttccacacaacccaaattcatctgactagcatgctgtttcacaagtttagaatacgcctggagcccacgtgcagttattttaagcccctggcttctctttctttgtaaacaccctgtctgggcccacaattacccaccttcaccataactggggaagtctcaggtggccacagtttaccttttgactttttgttattatagaatcagtcagttttgaaatctgattcatttggaatacacagacgtttgtcaccttgctttctgttaacagatgaacagagtttccaatgaattaatgaaatgaaatagaaatattgaca

SEQ ID NO: 216410 - DNA, 515 bp, Homo sapiens
aacaccctgcctagatcaattgggctgagcaaaaccacaggcagcaatcctcaagcccatttctattcttctggataaaaaagacattttttttttttttcaaaatataggggatgtcatctttttcccagccatcttgtgagggaagaagatagcaagacagaaataactccttataatcttttcaaataccaaagcattccacttcccatgcaatcattttgaacctctaacacgagcaaaaactatagctgttatggagaaaagaactcttagtttgaaaagatcgagtactagcatatagaatcccccaaaccactttaaattaatgagtcatacaatatatctgacatgttaccaaatcctccccagacccaaggctcaacagtttttgaaatctcaacacacattttctgaggaattgcagtttggaatgaaactagggcttctggtggagtgatctgtacagtagtcacaggatggtcctttcactgaataaatactttttgagcaac

SEQ ID NO: 216411 - DNA, 255 bp, Homo sapiens
attttacagatgaggaaactgaggcctagagagtcgagtcacctgcccagggtcacacagcatggccagactgccttgctgttggacctagctggggtgcagcctgttctgtcctgtcctcattccgtctcgcagcatttcacggtcatcattccatcatttcttcttcttcttttttttttttttgagacagtctcaccttgttgcccaggctggaatgcagtggcacaatcttgctcactgcaacctccgcct

SEQ ID NO: 216412 - DNA, 283 bp, Homo sapiens
tgtgagaatcactgcaaaatggccagaatttatgtttgtgggaaaatctgagtaattattgaatgactacccagcattgccaattaaaacaaaacttggatgagaccagtcttccaattctgtctgatgaaacataaacggaaagcctttataatgtaatattactgcctgagtgattattttcagaatacaatgatcagccaaatggcttctaattgatctcaaaatatttactgagcctctcagtgtgataatgttctgctgagttgctgatttaccccca

SEQ ID NO: 216413 - DNA, 551 bp, Homo sapiens
caagaaatgaccctaacatagccatcataacaataattccccaaaatcctctcactcatgatgcactgccatcccgcgtcaatccccagtctggcagccacccttctacctccctgcttccatgctgcttagggggccagtcagggcagctggctgtatccaagactgcccgaaatgctcactctgcaccccgaccatggatgctctgagatgcacatgcacagcttcccaggaccctcaccacaaccgctgtgcgaccttcaccatgacctggaggcccaggtccttcccagcttatctctgtggcttacttcaacgcaaagttcctgacatcccacccaggtcaccaacctttccccactgaacttcaactctatgtgcaccttccctcttgatgacctccttcctcatctccttcctcacatccccactccccttccaaagcctaacctctacacccaagctcccaagcccatccccctcactgtgccaaacccttctggaacaaacaggtcctctaggagcttaaggtctaaagaatttacagacca

SEQ ID NO: 216414 - DNA, 425 bp, Homo sapiens
ggagctgggacattctagggcaacggccattctaccccaagccgtagcaaaacaacaggagatctctgcacccttactcaggggtctcccttcacagtccccttcctggctctttcacccctggccttatgctcatcctctctgcaggcctcggggaccaaataccaagctgaagaccaagggccaggttaagagtgcttgttccccaaggctgtctgctcaggccctgcattgggactgggatgcctggcaggcacattggtgccacagctgatggaggaacgtccagacagggtcttcaggctttccctatcccctcctcctcccacccagctgttgactgcatgactggctgctgcctcaaggggccccagcagggggctgccccacagggggtctggagagagcagggagggtgccttcct

SEQ ID NO: 216415 - DNA, 279 bp, Homo sapiens
ctagtcttcagcatggtgcctatgacgcccgcaagagaatattgccaacatgttcttgccttgctagtgccagtacacaaggtatttgatttctccttcacatttctatgtgtaaaatggggcaggctgatgcggttgatatgaaaaagcataaataaaattatcatacgctttggaaagagatgttctgaataataacaagattttgttatttatgctgagcaatatgttttgtcatttctacagtatattctagtattaaaatttatacttgtgcaa

SEQ ID NO: 216416 - DNA, 543 bp, Homo sapiens
cacacaatgtttttatttatcctaagtgaatacctgagtgagattgctagatcacatggtaagtttttatttaactttataagaaattgccaaactgttgtccagtttctataccatttttcttttccctaccctcacataatctttgatttccaagtgttctaggttcttgctgacagttagtactgtcaggtttttcttaaatccattctcgtgtgaaccagtatctgattgtggttttaatttgcatttctccaataatgaatagtgttgaacatctttctgtatgtttcacatttgtataacttcattgatgaaaaatttgcttgtcttttgtccatttaaaaattatatgtatgccatattattgagacataagagttctttacataatctagatacaagtcctttaacagatatatgctacacacattttttttttcaggctgtggcttgtcttctcatttttttaacagtatattttgaaaagcagaagtttttagttacaatgaagtccaatttatctaatatttattttatggg

SEQ ID NO: 216417 - DNA, 365 bp, Homo sapiens
aaacaaaccaataatctactgaagtcaatatagttggtcttgctctgtcacccggcctggaatgcagtggcacaatcacggctcattccagccttgacctcccatactcaagcgaaactcctgcctctgcctccctagtagctgggactacaggtacatgccaccacattgggcccaaggccaggttttaaaaagttgcatctaagtattatttacataggattgattccttgtctgcaatatattctactccaatacaagtaggtggttgatgagttctaatacaagcttccatgttcactagctgtataaacttaggcaagtttaaattatatgtgccttagtttctttttttgagacagagt

SEQ ID NO: 216418 - DNA, 452 bp, Homo sapiens
gcctcccaaagtgctgggattaggattagaggcgtgagccaccgtgcctggccacaagtaatttttaaatggtgtgtgtgtgtatttagtttgctttttaaatgaacaatgatttggaaaaatcttaatccagtggcatgttactggcagtattttggattttcaaacaattttcaggtatttctagtaacaaagtagaggaatggttaacaaataacaaaagataatttcaggccactggcatctggctatggagtatgtgtttgtacttatttggatatgggtgtgcctgtttttctcaatattatttcaagtcaagaaatgaagtcattggccgggtgccatggctcacgcctgtaattccaacactgtgggaggccgaggcaggaggatcgcttgagcccaagagttcgagaccagcctgggcaacatagggagaacctatctctacc

SEQ ID NO: 216419 - DNA, 431 bp, Homo sapiens
ctagagggacaggaagcaaatatagcctacaattggtttagcttactatttagagaaattcttcaagctagatagtaggtagggttatttccctaatttgagaagaaggaattaggagtccaggtaggctgtggcagctggagatcacagggtaaaataccagagaagataagctacatagagaaagaactctagagatctgcacagagtcccccatgagtattcatccaagtactagtaagtgcatacatgtgatgaaagtacccaaggtcatgaaaagaaccacctaaaaagttatagatggaactatccatggtgtccatacatttcctggaatagtgcttgttctcaagagccatagtggaaaatctcataactcattggacattaagttgaatacatagatgaggtttacctcagtcacagggaaa

SEQ ID NO: 216420 - DNA, 1097 bp, Homo sapiens
tgtgggcagatggagacacccaggagaaagaagagggcgaattggaagaggccacccagaaaggacggtgtgtgacactagggagccaagcatggagagccgaggactaacgcttggaaggaaatgtggaccagaaggttccggatgagggaaggactggcggctacactctgccttccgagacaacgaggaataatctcacttcagtcagttcaacccttgtaaaacagctactgtgtgcaagacacggagggaaagctgaagtagagaaaccacagacgctgtcttcaaagggtttaatctaatattagtgatgagaaaaatagggtgcagagcttaaggcatcctggaaaaacgtatgtagcgccacatcgcgaaaatctctcttctgggacccctctcccaaaaacgtttcttcgccctcttctcccccttctgcctccactctttctggacttcagatatctttgagaagcctggacatcaatctgctttagaagactagaaactctgcctttatgtctttaagggaacaatagtccttaactttgatactgtggctctttagctctttttttccctatattttttatatagttttttggtattatttagacctccttaaccccacggtcataaaggtattctcccatcatttttttctatccattagcttcatagttttacttttttacattcagttatctaatccatctggagttctccttcccatatggtgtgagatagggatctaactatatttttctccatggggtgagcaaattttccaacaacccatgtcaaacaatccattctttccaaattggtttggggaagtttccaaatagacatgagtatgttctgagctctctggtttgttcatgtgtcagtaccacaaggttttgtcactgtgggtttttagttagtcatcatgcttgaagggcaagttccccattccaaattcttctgtgttaagattgctttgtctatccacgggcctttatcctcccttataatgtttagagtaagtttgtcaagtttatgagaactgtgttgggttgatgaataaatgcaaggaaaactggcaactgtgcagt

SEQ ID NO: 216421 - DNA, 533 bp, Homo sapiens
gtcaggatctcttgtactagaaatgggtcagaggtggggggatagaagttgattggatgaacaggggctgtctaagctcccagtggtcaggggatggccaatgcaggagaaaggtcagggtcaggactgcttggaagtacccgatatagccaaggaattagtccaggagatgtgagcctgggcaaatcagttttacttttcagtttaacctttcatgtccctggctctgagctaggcaccgaagtgggaagaggcaatgcaggagcggtggtaggaggctgcccctacaagatgtgtgcaagatgggaggtgacccaggcctgagtggggctgagggtagactactctgttagggattctggaattgatccttaattgaatccccaagaagtcctccactgctggcaaggtcaccaagtttgcagcaaaagccagcaagaaatgaagcccaccctcctctctgcagtgtcctcagctcctccttcccccccaataactaaacattcaatgaatgtatgtatttcctaaataaa

SEQ ID NO: 216422 - DNA, 272 bp, Homo sapiens
ggaggagatgctaagtttatcagggatgagggtaaagaggaggtcttagcagaaggcaccagaggtccatgggtgtgtctggggtctatatgggggctgatgtggaacacctaggccaatgtgggggtacctgagctgatgagagtcctggactgatgggtggctgtttctggaagatgaagagggcctgggatgatgtgaaggggactgaggtctacatggctggtgaggaggatctgggcccccccatgggcaatgctgtggtggccctg

SEQ ID NO: 216423 - DNA, 599 bp, Homo sapiens
tgcagaaaagtttgggacctttggctcaaacattctgaaatttccattcaggtagaaatggtgatctacactgttatcaaaaatgtgtttattttggctctgaagtctcttatgtcaaagctaaggaatttagaatgagagaactactttcataagaaaagactaggaaactcacctatttcaaaatctacctaagccctggctcagatttcatctggccaattatccacagggcactaaaaatgcagacagaggattttattttctttgctaagattgatatattcttgataaaactgatatattgttgaatgtatttgataatcaattcatataaggaagcctcatttcttttagtcctgtaggaggtattgaaaatatttgaagctttaagggacagcaaagaataaacatacagaaatttcaacagccatagttgtataaataccggcaaactgaaattctacaaattggagaattgtactcatccacagattaaaaatgagttggcaagtatagttcagttgtcaaaagaggataatatcccaatactcaatatgaataaaacatgtagggtgcatgtagccagaggcaagcat

SEQ ID NO: 216424 - DNA, 476 bp, Homo sapiens
gacttcattttctctgaatatagaactttaggttggcaagtttttttcctatctgtattttgaagatgttattccgttgttgcctggattgaatactttctggcaagatgtcagtagtcatgtttatatataatgtttcctttatataaagtgacctttttctctgggtgcttttaaattttctctttatcattcattttcaacaagttaattatgccttggtgtggagtttgtgtattattgtttaattggggttttcatgaagtttttaaataggtgggtttgtagtttttatcagtttaggaaattctagtcattattcacatttctttttctgttttgttctcttttttggtgttcctccttggtactccaattatacgtggttgattacatgatactttcccagggagacttagtttatttcattattatttatttcattttatgtagattctgatgctgtgtcttaaagt

SEQ ID NO: 216425 - DNA, 604 bp, Homo sapiens
aatgtaattcttgttaaatggaaaatcttgtttttaaaatatgaaggtttagagttttgtttacttttgtcatgtaactggttctgtatttctatgcatgccaattatacacatctctatctgcatttttttttctattttaaccgctgaaggaatatgattatacaatgccatactcaatggtggcagcatttaatttaagtaatggagaagaattaaacattgtagctggatctgtttctgtagtcgaggacaactgtgatgtaactttgaattaaacaaacaaaacaaaacagaagaagactatatatatattttttctttttttagagacagtctcactttgctcccaggctggaatgcagtggctattcagaggcttaatcattgggcactgcagccttgaactctgggcttttttttttttttgagatggagtctcagctctgtcgtccaggctggagtgcagtgactcatgtctcggctcactgtagcctccacctcccccaatcaagcgattgtcctgtctcagcctccagagtagctgggattttaggtgtgcaccaccatgcctggctaatttttgtatttttagtagagacgg

SEQ ID NO: 216426 - DNA, 396 bp, Homo sapiens
atataaatttatatttactcagaaattacaaatttactgagtaaatttatataatacaatataatagtcattaagatatttgaagaagttgccatgtaatacactttttgacacacctttcacagcacacatagcacatgtaataacttttatttgtgttttagagagagggtcttgctctgtagcccaagtggagtgtggtgatgtaatcatagctccatccttgaactcctgtgcccaagcagtcttcccacctcaccctcagagcagccagtattacaggtgcaccaagatgcccaattaattttttaaacagttttcgtagagacaaggtcttgctatgttgcccaggctggtctcaaactcctggcctcaagtaagcctcccaccttggcc

SEQ ID NO: 216427 - DNA, 407 bp, Homo sapiens
caattctcctatattcatatacagttttaacaaaatttgcattaaaataccagcaatgttttctgtagataagattattcgaaaatttataagaaaggtcacaaaaactaaactagcctaagcaattctaaaaaagaagaataaatggacaagaaccagtctactcaaggctaaggctttctacttagcaacagtgatcaagacagtgtgatattggcagaggattagacacacagatcagtggaacagacaaagaatccaaaaagagacccagaaaaatatggccaaatgatttttgatgaagatccaaaatggataaagaatgggcttttcaacaaatagtgcttgagtaactagggaagtgtgggcttacagaaaaaggtactttgtacctaacacattataaa

SEQ ID NO: 216428 - DNA, 505 bp, Homo sapiens
cctacctcatacccaaaaaaattcaaaatggattacagacataatataaaagttaaaaccacaaaacttgtccaggcatggtgtctcatgtatgtaatcttagcactttgggaggcctaggcacgtggatcccttgagctcaggagttgaaggccagcctgagcaacatggtgaaaccttgtcatgaggttttgagacccagtcacaaaaaaacttacaaaacttctagaagacaggaaaaaatatttatgaccaggcagtaggcaattttgttaggtcacagaaaccaagaaccatttttgttaaattagatttcatttgctcattgaaaaaaataaaaaataggcaaggcagactgggagaagatattcgtaacatatctgacaatttgtatccagaacaaataaataaattctgtaacatttaaaaagcaggcaacccaatttttaagacagacaaaagtcttagacactttgtgaaagtagttatacacacggctaattaa

SEQ ID NO: 216429 - DNA, 406 bp, Homo sapiens
tgagccaagatcgtgccactgcactgcagcctggctgacagagtgagattctgtctttaaaaaaaaaattgaccatctgaaccatttctaagtgtatagtcgtgttaagcacattcacgatgttgtgcggcaaatctccaggacgttttcatcttgcaaactaagcctcaatactcattaaacttagcttgacttttgatatgtaattttttatatgttttgtttcctttctgttttattaacatgaagtttctggagcagcagagctgaaggaacccaaacttggactgaagtgactctactaaggtaatgcctccttttgacatcctatctgggccagtggcagacccctctccctgacagtgctgggtccagggctccaggcagccaggggaagatgaagaca

SEQ ID NO: 216430 - DNA, 724 bp, Homo sapiens
cttttctttgctgggaaacttttcatgacaacctccgtttcattacttgttgtctgttcaggttttgggtaccaaaaataatggcaacaacaacttttcaagacatggagagcaaaataacacatgaattgaaacaagaaaatggcaaaatgtggaggaatgaagttaaaatatagcattttcattatattacactttgcttgttagtttgtttacacaatgtctgttgtcttcagtgtaaaataatgcattataagatatgataaccccaaatccaaaagcattcaacagatacataaaaataaaaagcaagaaattaaaacagaccaccagagaaaatcaccttcacttaaaggaagacaggaagaaaagaaagaaggaagaggaggccacaaaacaaccataaaagacataacaaaatggcaggagtaagtctttatttatcagtaataacattgaatatcagtagactaaactctctaaacaaaatacatagagtggctgaatagatattaataaaacaagacccaacaatctgttgcttacaagaaacattcttcacctgtaaagacacaaatagacttaaaataagagatggaaaattatattctttgtaaatggaaacctaaaaagagaaggagtacctatacttatataacacaggtatatttcaacacaaaaactaataaaagagacaccgattgtctctacataatgataaagg

SEQ ID NO: 216431 - DNA, 321 bp, Homo sapiens
cacggtggcgagcgccttaatcccagctacttgggaggcggaggcatgagaatctcttgaacctgggaggagacgtttgcagtgagccaatattgcattaatgaactccaacctggatgatagactgagattccatctcaataaataagtaaatacataaaataaagagaaaaaaagaaagatgaaagaaagaaaaagaaagaaagaaagaagaaagaaagaaagagaaagaaagaaagagaaagaaagagaaagaaagggagaaagaaagaaaaagagagaagtaatgtgctaagttgccctaacatcgatagtaagaac

SEQ ID NO: 216432 - DNA, 778 bp, Homo sapiens
agcattccaaaaaggaggctctgttaattcggtttcgatcaacaagtatttgctgagtgtctattgtgtccggtcagtgctaaggcctgagaatttagaagtgaaacagacccggtttccacccatgccacagaccactccacacctggtctggagtgacactggagggccaggcaggcacaggacagtaacttcgatataaggcagcaagttccacggtggaaggaggtggaaggtgcagatgcacgtacacacaggggttcagggaggcctccctggaagaaatgaagcctgcgaggccctgaaggatcagtaaacagagaggcataaggggcaggagagtaagatgattatgctacatgtaccttattgtgaacccaggaggatttggcctctgtcataaaaggcccccctgtgggttcataaacctcaatttacaaattgtgctttatatatcagttccttataagtttggttagcgtaaattggtttcttagaacttgatcatccctgagtgaactcacaaattcaagtttcagaatgtgcaaacctaagaaacaaacctcatgcttgtggttgagacatcgcactgtcaacatcacaaattctcagcacctgaatgcctggtatactatcaacatatattgttttaaatatgtaaataatagctttctagttatagagagtttgtccctacatttttccacttaatttttacaatcccattcccctgatgaaacaaccccagcctgggcaacatggcaaaatcctgcctcta

SEQ ID NO: 216433 - DNA, 431 bp, Homo sapiens
gcgtggtcgcggccgaggtactctgaaatgtagacatggttgtaaatatgttcaagatgaagaagctgagacatagaaaggaatgtaatttactaagctcacacagctaatacatgtgtgagtttttctcccaaagtatcctctttttgaaatctgtgagttttcataatattaacctggttttcattttctaaaattaataatccaatccctatgccattatacatgtgtgctatttgctctactataaaatacatttctatgatattgtataatttactttttgttctgtgtgtatattttgcctttccatgaatttgaaagcagcttaggacttaaaatccttagtatttctttttatggaagccccattgctactagtgatattacaggcctgattctaaacaagtgtttgctgatgataatgtcaa

SEQ ID NO: 216434 - DNA, 515 bp, Homo sapiens
agtgatgtgtgtcctgaagagctagcagtgaagtctgtgcttcatgcaggaactgacagttcatagaccatggtgaatgaaatctgaaccttgcccttgcggggactgcatctacttaactaaactgactaaagggtcatgattgaaattcaaacatattggaagcccaatatgtttgcagtatgtttcccatattggcaaaggaagaactatctgcttctcggtactgaatcttgcacaactataacaaggaaatgatagcacattttaaagacgacgacatggattttattttgtcaagttgtttttttccattgtgtaaactagcagggtgtggccacagcaagcactattgtttaatcattcagttgaaaactcagcccacacatctctcctcacccagtggacctgctcttttaggataattccatctagctcacaaagccgtactgaagatatttcctgtcttcatgcaaaacacttccatcatctccctgcccaggggaggaaatgga

SEQ ID NO: 216435 - DNA, 453 bp, Homo sapiens
agaactgtcctttgatggggcacgaataggagaggcatttctgggtacctctgaccttataccttggagaggtggtcccctgcccacttccttgttaaacttcttctaaactggtgtttctaatgttcaaacttcagaatttcacatggcccagtaggagttaaagtgatcggccaggcatggtggcttacgcctgtaatcccagcactttgggaggccgaggtggctggatcacgaggtcaggagatcgagaccatcctggctaacatggtgaaaacccatctctactaaaaatagaaaaaaattagccaggtgtggtgatgggcacctgtagtcccagctacttgggaggctgaggcaggagaatggcaggaacctgggaggtggagcttgcagtgagccgagatcacgccactgcactccaacctgggcgacagagcgagactccatctc

SEQ ID NO: 216436 - DNA, 392 bp, Homo sapiens
cctcgaacttctgacttcaggtgatccacccacctcatactcccaaagtgctgggattacaggcatgagccactgtgcccagcctacatgagtatttcttgattaatgaattccaaaagaaaaaatatacttgtaaagagtggcaacatgaaactcaggggatctgaattacagttctgtcactaatggggcatgtgacccattattagctattaatttctttttatttttagagacagaatctcaccctgttgcctaggcaggacggaatgcagtgaagtcatcatagtttactgtaacactgaactcctgggctcaagtgatcctcccacctcagcctcctaagtagctaggactacaggcactcaccaccatgtgtggctaattaaaaa

SEQ ID NO: 216437 - DNA, 459 bp, Homo sapiens
gcttttttccatcaatattataagcaatttttcatgttattaaaacaatccttataatcaccattaaaagattttttctgattataagaatatacaattgctatagaaaatttggaaatctggagaattattaatatgaggtagaaacaattctttggcccagaagcaatactgttaatattttattcactgattcaacaactatttgagggtctgcttttgggtagagaaagaatgttttgggggtgtttgttttagaggtggggtcttgctctgttgccgaggatggagtacaggagctattcacaggtgcaatcatagcacactacagccttgaactcctgaggcgggagaatggtgtgagcccaggaggtggagcttgcagtgggccgagatcgcgccactgcactccagcctgggcgacagagcgggactctgtctcaaaataaaaaaaaaaag

SEQ ID NO: 216438 - DNA, 522 bp, Homo sapiens
tgggaataggccaggcacagtgatcatgcctgtaatcctagcagtttgggaggctgaggcaggagggccacttgatcacttgaggccaagagtttgaacatgcagtgagctatgattatgccactgcactcttgcctaggcaacagagcaaaatcttgtctcaaaaaataataataataataataaaggaataatatcactgaacacataggatagttgtgaagattaattcatacttgtaaagtgtttggaacagtacagcacctaacatgtaacagtcagatattataaagtaaaataatcacagtgattcagtgatttacacatctacgctgaagattatagtgaagttaatagaagatacaaatgctgaactaaaatttatttacagatgtcagatattcaaaccattcgtggaaatgtaaggaaaatcaaaagaagtcttttgtacaacagataccacattacaaaatttgttggcctttataatccccaattagtgaaatgccatatatttgcaat

SEQ ID NO: 216439 - DNA, 691 bp, Homo sapiens
agccatcaccaccctctaattttaaaacattttcaccagcctgataaactgtatacctattagcagtcactcctcattcccctttaactactcagccttaaatacttaaatactcattctgtaatttcgttttcaaatatttggagattttccagcaacagtagtttactttctatctctatagatttgcctattcagtacatttaagataaatggaatcatacaatatgtggagttttgtgactggtgttttgttttttttacttaaaataatattttcaaggttcgtctgtgtagcgtgtatcagtgtcttcaagtgatagtatgcctatacatagtgtaagaaccttaaggtagtctgcttttcttctctttgtgttattgttacaaattttacttctgtatacgttataaaccccacagtgtattgaatttatttttgtctaaaaaaatcagttaaagatacttaaataataaggaaaaaaaaatttttaaattgacccatgtagttaccgtttttggtactcttcattatttatgtatggattcatattactatgtggtatcatttttgtttgcctgaaggatgttaacatttcttgaaatgcaggtgtactggtaataatcagcttttgtatgtctgaaaaaaatgtttattttgcctttatttttgaaagatattttctctggg

SEQ ID NO: 216440 - DNA, 350 bp, Homo sapiens
ttagatggctgattaactccatggataatctccctatggactgattgtccagccatctttgatgttctctctggaaaacattttctcatttttttgcaatatgaatagaatgatagattttccaaatcttcaagttctggttccactttaacagttttttttttcattttcttcctttctttctttctctttctttctttctcttttctttctccttccttccttcctctctttctttctctctttttctttcttctaaattgagacagcatcttggtttgtcacccaagctggagtacagtggctcagctcactgcaatctcgatcttctgggctcaagtgatccttct

SEQ ID NO: 216441 - DNA, 421 bp, Homo sapiens
ttagatggctgattaactccatggataatctccctatggactgattgtccagccatctttgatgttctctctggaaaacattttctcatttttttgcaatatgaatagaatgatagattttccaaatcttcaagttctggttccactttaacagttttttttttcattttcttcctttctttctttctctttctttctttctcttttctttctccttccttccttcctctctttctttctctctctttccttccttccttcctctctctctttctttctctctctctttccttccttccttctttctatctctctttttctttcttctaaattgagacagcatcttggtttgtcacccaagctggagtacagtggctcagctcactgcaatctcgatcttctgggctcaagtgatccttct

SEQ ID NO: 216442 - DNA, 601 bp, Homo sapiens
cacacaaacacaccccaaatacatacacacacccaaaacacacacacatccaaaatatacacacatacacacatccagaatacacacacatccaaaatacacacactcacacgtatcaagatgattacttagcattctgcaacctgctttttcagtccacaatatatgtgggaaaaaatattctaatgtcaatgaattataatatatactatgctccttgcggacttcataaatttccactatttaagcagtttccagttctcagttttaaacaataccctgatgataccctcatataccatctgcacagctctctaattacctccggaaaataagcagtgattactaaagtatatgaacatttaattttgacacagattaccaaaatgcaccccagaaaaaatttttaccaatttatcctcctatcagcaacccatgagaataagcaatccccaacatcaccatcaaccctgggaactgccagctttttcatttgtgctaagcaacaaacaatgaatatctcgttacttggcacttctttttttttttttttttttttttttttttgggaaacggggtttggttttttcccccaagcggg

SEQ ID NO: 216443 - DNA, 508 bp, Homo sapiens
tggagatgaggtctcactgggttgcccaggctggagcatggtggctgttcataggcgtgatcctagtgcactacagcttaaaactcccaggctcagatgatccgtctgcttcagtctctcatgtagctgggactataggcatgtgccaccacacctaactctggcctcatatttcattgagaaaacagatgcaggcagaacctaggcagggaacctccatcagcctcagtcatcacatccatctgcctacctgtatgtgcgcctggttcttgttatgcacaaattgtccctgctgctgttgaagcttggaccctagatcccatctcccttcagttactcagccttcactccagcagttcctttctctctcttgcttcatcagattttccatctcatatggcctttttttttttaacagcctatataatgccattacttttcccatcatgggaatgaacaaaaggaactctcttgatctaattccccctgccagcttctcccccacatc

SEQ ID NO: 216444 - DNA, 735 bp, Homo sapiens
ttagattcatggggacatgtacagtttgttaagtaggtatattgtgtgatgctaaggtttgagatatgaatgatcccatcacccaggtagtgagcacagtacccaacaggtagtttttcagcatcttgtctcttccacatgagctggtccacagatacaacagggcacaggtctaagctgaaaggagaggaagcgtgagccgtgctccaggagtgaatcctagcctaacagtcaccgacatgcctttccttctaccgaccgctcctccgaggcaacgtgttcatgcgctgttaactgttcacctcctaccattgatgtccctggtgctctcaagcacgtttgactcatcaaaaggagtttcacaaagctggttgctgtctttgcaggcctgtttgtgctccaacagggagctgagtttgtcatgagcagtgcctggctgtgtctgccatgctccctgtgtgtgtcccagctccttccctcttattccctgttgatccagccctctgcagaagtcaacaggggcccctcctgctttgtctttccttttcgcaagggaaatgttaggtaggagcaaggcggaaccggactgggagtgtcccggtggcatgtgctgtgggtggtcagcactcgtatgtggttttgaatttccctccagtctgacaaacctgttggagctgccttggcaacaaccccagaaggagaagtttccccctcctggccccacccacagaaaca

SEQ ID NO: 216445 - DNA, 826 bp, Homo sapiens
ttcaccatgcttcggtatctaaagtttttattggggtttcattatatatgtataattgattgaatcactggccaagtgattgaactaaatctccaccctaccccttactctgggtgtcaggctgactcaaagcaccagctatgtaatcacatggttgttctcgctggtaactggcctccatcttgggtcatctcatcttccagcccaaattcaggtgtgatccaagaggctcatgaaaaacaaagatatccctgttacttagggaattctaattattttgagtctgcctcctaggaaccagagacaaaagccagtcaaattctttactataaaacagaaagcatgtgaaaacatactgtgcacgctatgtcacacaacaaacacaagtctattgaacttgccaatggtggagtgttggttggtaggagaggtctgagggcatcattctttgcaaagtgtattctttctgtaccattttcttgaccaattttcaccttttctggggattattcctgttttgcactcaaactactcttaaaaataaagttacagtgcaggaaaacttctttagggcacaataaaggctaaactcgtggaaatggtactcattcatctgcacagaatgaagtctctcaagatgtttccttttattcctactcagttggtgcatgtacccaaaataaacattttgagttcatccaaacacaattcacttttgttctatgtgatggtctctgttttgttgtgtaaactggtgtctctttgcctgaagttgtagtgttgaaagatgagttctcatagtcatttatttagagtgttttagagc

SEQ ID NO: 216446 - DNA, 216 bp, Homo sapiens
agttttttgtgagtagagataaggtcttgctatgttgcccaggctggtcttgaactcctggtctcaagtgatcctcccacctcagcgttccaaattgttgggatgacagatgtgagccaccacgcccagcccataccctggtgttcttgatctcttgtttttcagtagcaaggcagctgcctcgcttctgtgctttctcccccttctctcaacccc

SEQ ID NO: 216447 - DNA, 230 bp, Homo sapiens
atgccgtcttcatgaagacggcatggggctgggggctcctctttcaaaggagcaagtgggcagtgagtgtgccacggactggcctgggctgtggcctccgggtaacccccatcccgactgtcccctctacctctttgtggcttcctctggggccctctttgaggatctttctgtttgtctttgttgctctccccatctgtttccctgtctgtttctggtctctttcctgc

SEQ ID NO: 216448 - DNA, 555 bp, Homo sapiens
atctgcatgctcttatttgtagacaactggtctgagtctttcttcctgggaaatgattaccttaatcataaagaaaccctgctggatgggcaatcttatttatataccttttctcctctgtttccatgggaatctcacctgtctctcatctccagaaatccccaaacagtattagaagccaattgagttcctccaactctgattattcctcctaagggcgtctgaaccaactattctttgctttgaatcccacatcttgcctttggcaaagtcttgtttgtgagagtagatttatttcttctgcatctttgactccgctttctctactgactcttttatctcttcatatgaacatattcattttatttttttctccagcttaaaataaaaaaacttttatattaacttatgcttatatttacttcattcatctcaaaatcatgctacagagatcaaagattttcttctcatactcatatttttagcacacattcaatcaccaatttactttaagttagctgttactgttctcttggttttgaaattttacataac

SEQ ID NO: 216449 - DNA, 139 bp, Homo sapiens
gggaggtccaggaggtagttaggttgttgtaaggagaggaagagcagattcaggtggcatttagggactggaatcagtgggatttggtgccagtgggggtgtggggtgtgagggacaaggatgtcaggcttgtctcgtc

SEQ ID NO: 216450 - DNA, 501 bp, Homo sapiens
tgtttcttatgtaaaattaaggactttgactaaatcagtgacattcatacgtttaagtaaatctcttttttttttaagaatggaacttttttaaattgcataaaaccacattatagaaaacagaagtagtgctgcctgactaaaggaaggatcagtgctctgaagctgtgactttcttatcccttaatccttcagcatcctctgtggaaccttagatttctgtgggacatagcttgaaaaggatcatttcttgaattattacttttataaggcctggatggtaatgctgttgtcatgttacctactctataaagcctatctataatgtttttgtcacagaaatgttatggaaaggagtctcaaaatattggtaaacctgttagtaaaaaaaaaaattgacttgacacctaaaatttctaaaggcattagatatcattatctttatcaccacaaactatctcagaccccgttctaggcatttagtgagagaatacctattct

SEQ ID NO: 216451 - DNA, 530 bp, Homo sapiens
acatttatttatttatttatttgcaatgagacctcataatatccaccaggctggtctcgaactcctgggctcaagagatcctcttgtcttagcctcccaaatagctgggcctacaggtgccagccattctgcctagctagttgatcacttttagggaaggcaacacccacaagatttgttggacctgaacttcttatggtgtgtctgattttaaatgaaatgaattttgctaaagtctcacaaatggttaactcttctgcctttattacatgttttaaatagttgatttatctcttagtttcttgcagcataattggtatattgcttctcttgctaacatgtcattttactgtaggtggttaactgaatgtattctctctgtaaatttcaacaagttgctcataaaattttcccagcagaaactttttgtttcgtatttaaaaactgaatacactgtcctttatttagagagtgtatgtttggaaaatcatcctgtttatttgtaaataaagatgaaccagccagtcaca

SEQ ID NO: 216452 - DNA, 533 bp, Homo sapiens
acatttatttatttatttatttgcaatgagacctcataatatccaccaggctggtctcgaactcctgggctcaagagatcctcttgtcttagcctcccaaatagctgggcctacaggtgccagccattctgcctagctagttgatcacttttagggaaggcaacacccacaagatttgttggacctgaacttcttatggtgtgtctgattttaaatgaaatgaattttgctaaagtctcacaaatggttaactcttctgcctttattacatgttttaaatagttgatttatctcttagtttcttgcagcataattggtatattgcttctcttgctaacatgtcattttactgtaggtggttaactgaatgcaacaatgtggctacaagttgatatgggatccactgacttaagcaacttagttcatctgatctgacatatacttacgatctcttagtctttcattttcaaacagaccgtgagataattcaaacctaaaagcaataaagtgcatatgaagtgtttgttcataaa

SEQ ID NO: 216453 - DNA, 390 bp, Homo sapiens
cgctcagaggcaggtgcccaatatatatttagtgaatgaatgaaagaaagaaagaataaatgcatgaatcaagcaatggccagagctgctgacaactcacaggggagagtgcaggggattagtgaaaactccccacctgagaagatgtcaactcccgaaatgctttggtacacggatgaggtcggtgagccacttctgcattctcttcacaaatccagcgtagtgttacttccttggctcactctccttcattacattaagaagcagcatgtgttgctggtgtctgttggatttccctaatacgaaaaacaggttgccacttgggtctgcagagacatttggatgcattgtatttaaattttgttttcattgaaaatttatagctgccac

SEQ ID NO: 216454 - DNA, 864 bp, Homo sapiens
gctctggaactgcccaggcactgggagggtgagcagatcgggggtacctgtggcatccctccaaactttctccctttgctgccagttaatgaacatggagggccctagtcaggtttgaagatctgagcctcttgtccagccatgctccccaggaagaggaagctccccagcagggagctccaggcttgttcagagctgcctgggctgctgctctcgtgtgctggccagtctggtggcttctaccaggaggcgactggtgtgcactgggccatcttttatccattgcgagaggacatgaggggccatctgattcttctgggaggcagctgcagactggaggacaaatgtccctggattactccgtataatcaatcacctggggctcagcccagtcccaggagttcctgagccttcctatactcagtgggctgtggctaaccaagcaagctgttttgtttccactcaaaaaccacactcagccacttcagaggtggccatgtccagtagaggaaaggccaagcttggagttgggagtcctgaattccagtcctgccacttgttagccgtgtcgcacgtgccattttcagagtctcagatcctcacctgccctgcccgtcccacagacacaattgagaatgtgaatctcaattgctctgaagatgtttcaaaaagggtcccaccatggaaacataaatgcctcatttagagaccccttgcctaaaatgtttggttagaactgttgccgagagccaggagtggtggtggcacatgcctatattcccagctacttgggaggctgaggtggaggatcacttgatcccaggagttcaagaccagcctggacaacatagtgagaccctgtct

SEQ ID NO: 216455 - DNA, 357 bp, Homo sapiens
gcaacagagtgagactccatctcaaaacaaaacaaaacaaaatatggtaaagggtcaagaccgaggtatgtaggctgggcacagtggctcacacctgcaatcccagcactttgggaggctgaagcaggaggattgtttgagccaggagttcaaggccaccctgggcaacatggcaaaatcccatctctacaaaaaatacaacaattagctgggcctggtggcatgtgactgtctgtagtcctggcttcgtggcaggctgagccaagaggctctcttgagctaggaggttgaagccgcagtaagctgtgatcataccactgtactccagcctgcacaacagaacaagacccttgtctt

SEQ ID NO: 216456 - DNA, 264 bp, Homo sapiens
ttcctcagagaccctttccctgaccccaaaactagggaaggtcccttagttatttgctctcacagaccacgcatttacctcagagcatattcactcattcagctgttacttaccaagcacctactgggagctatacactgttctatgtgctagggatacctctgtcagtgaacaacacagacacaaagatccctgcccttgtggagctgaaatctgaatagaggaggtgaaatatacaaaaattataataaataagtaaactag

SEQ ID NO: 216457 - DNA, 670 bp, Homo sapiens
gtgagactctgtcttaagaaaaaaaattatcttgcagaaccttctattccagctgaatgggttcgcacgtaaattttcatcaatttttattgagtgtctatgacgcaaggtttaggactacgcagtgcaaggcttagttaggactaggcagtggagacatgatatgactcagacaaccaggtcccctgccttctgggagaggagatgctaaatgaccaagatcacaattcaccactgaattacaactgtggtaagagttacaaaggagagtgcgctaagaacctgaccttttctgggagacacaggaaaagttctttgagcaagtaatgtttggacacgaaggataagtagaagttaaccagtggaggaaagaacattgtgcgaagatattttgtgttttcccttctctgtgcttttgtgtattcagttccatctgcttatacagcatgcctgtttcaagtatccaaatcctaactcaagatttggctcctggcctggcgcggtggctcacatctgtaatcccagcactttgggtggtggaggcaggtggatcacttgaaatcaggagttcgaggccaggctgagcaacatggtgaaaccccgtctctacaaaaatataaaaattagctggacaggtgcctgtaatcccagctactcagggggctaaggc

SEQ ID NO: 216458 - DNA, 538 bp, Homo sapiens
gggtcttcaaggcccctggagaagcgtgagacatttggcccccaaggaacaattgtctggaggacaaccagggctgcttcaaccaggatggagcctctggggcctcccatgtggatcaagagaaggctgctcacacccccggggtaggcagacactatgtttggaacagagagcacacagacagggatccttctttttatacttaacattgcaaggataatgtaagtacaccaaatgttggccaggcatggtggctcatgcctgaaatcccagcactttggaggccaaggcggacgaatcacctgaggtcaggagttcgagaccagcctggccaacatggtgaaaccccgtggctactggaaatacaaaaattagccaggcttggtggcacatgcctgcaatcccgctactggggaggctgaggcaggagaatcatttgaaccagggaggcggaggttgcagtgagttgaggtcgcaccactgcactccacactccagcctgggtgacagagtgagactccgtctccgaaaaaaaaaa

SEQ ID NO: 216459 - DNA, 409 bp, Homo sapiens
caaaaataatagctatacaaaaagaaatacattaaatttactctatagtagtagttattctttctgagaggtttacacagtattttcctgttcttttgtatgtatgtatttttaaaagaacgtaggcctggcgcagtggctcacgcctataatcccagcactttgggaggccgaggtgggcggatcacgtggtcaggagatcgagaccatcctggctaacacggtaaaaccccgtctctactaaaaacacaaaaacaaaattagccaggcgtggtggcgggcgcctgtagtcccagctaatcaggaggctgaggcaggagaatggcgtgaacccgggaggcgaagcttgcagtgagccgagatcatgccactgcactccagcctgggcgacagagcgagactccgtctc

SEQ ID NO: 216460 - DNA, 454 bp, Homo sapiens
atctcggctcactgcaagctccgcctcccgggttcacgccattctcctgcctcagcctcccgagtagctgggactacaggtgcccgccaccacgccaggctaattttttgtatttttagtagagacggggtttcaccgtgtaagccaggatggtctcgatctcctgacctcgtgatccacccatctcggcctcccaaagtgctgggattacaggcgtgagccaccacgccctgcccagctttcttcttcttaacctttatctggtatgtctttaagaaaaattttttttcaatagctttaggggtacaggtggctttttgttatgtggatgaattatgtagcgatgaattctgagattttagtgcgcctgtcaaaggaggagtgtacattgtacctaatgttcagttttttacccttagcctccctcccacccttccccttctgtcgtcttctc

SEQ ID NO: 216461 - DNA, 295 bp, Homo sapiens
tagtagaatctcagtgagcttttgtggaattgaataatctgttacataaaatcctccttcccaaaaatcaatctgtatcccctgaataaaaattgtaccattttaacaacagaagattactgcagccaagttatatcctgaacatttcactttagtttattagctttttaaatgttaataagaaaatgtcattaaatatatatgtacatacatacataatgccttctaaggtgctggaatcactgcccctatattattcttatgccatctctgaagggtcagaaatgacatttat

SEQ ID NO: 216462 - DNA, 579 bp, Homo sapiens
aaagcaagactcctcctcaaaataaataaataaataaaaaagacaaaagtagcatcttttaatcaatggactattcaataaattatgcttggaaacaacattttaggaagcaagtaaagctacagccctacttcattctttatgccaaaagacctttcagatacaacaaaggttaaaaaggaaattttatgataaaatactagaaaaaggctggataaacgcatttacaaccctagaccagggaatattttaagaaggacacaaaatccagagatcataaaggaaaaagactgataatctgactggctataggaaaactaaaaacttctgtagggccaaaaaataccaaataattaaaaagcaaatgacaaactggagggaaaaaatttatgaatataacaaaaagaactaatgtccaaataaacaaagaatgtgtccaatatgaaaagtaaacataacaacagtccagtagggaaaatggcagttgatgaacaggcaattaagagaaatgagttcatatataaatgaactcataaacagatttacaggcaaagatactgatccctactcaaaatgaaa

SEQ ID NO: 216463 - DNA, 413 bp, Homo sapiens
agcttctcctaggaagtactattgacctgaaccacattaaatggtcatgtgtcatcctcactgtagccccaccatgcaacatcactgggtagctttgttctggctgccagttgttatatgtaatattcgtagccatgagtcgtggcttcctggggccttggttaagctatatgaaactcttatgtaatcagcattccttcttccctagagaaaggattcaagtttttcagggtttgttcattgctcaggacctgacctttaagttgagttgaggtgtgaaagtcccaaagtggtcaagtttgaaagtcccaaagtggtcaagtgtagaggaggggcccaacacagtggctcacgcctataatccagcactttgggaggccaaggcaggcagatcacttgaggcgaggagtttg

SEQ ID NO: 216464 - DNA, 450 bp, Homo sapiens
attcccgtccagcaatgtggctatttttttaaattaattcagttctccctttgtttttcaggtaagaatttatctgtaaagaacaattttggcttttcccaagaatccagtgcaacactgaatagtagccggagggataacatcactattataaaacctacgattggtgctcaaggtattttcagacccctccctggatggatcagctgctcccacccagactgatggtcttgtggcttccactcaggaactgactcagcacaagaggacagctttgactccccattcctgggggaccagtcagcactccccactacctgccccccatccatgagattatccttaaaaaccccagtctccgaattttcagggagactgatctgagcaataataaaacggcagtctcctgtacaaccagctgtgtgaattaaactctttctctgttacaat

SEQ ID NO: 216465 - DNA, 478 bp, Homo sapiens
agcgaacaaaaacattaagacaattgtttttagaatatgcctatgtttatatactttgggtttctggttaccaagtataccaaagataaacattctacctgaagtcagatgatgcgtagtttacatgtggttagacagccttattcttttggtttatgtagttaaatgaatgtttgctgaaaatattctctcggcatttatttataagggaatctaaatttcttttttggtctaaaattttaaaatatcacctttttatttctggctgactgtgagtgaaccaattccttgataatctgctttttcagaaatttttaaataacttttaaaccataaaccaaactattaattgaaatttattgaatcaaatttgttttcttttgtgagttaaactttaaacccattttctccgaaagtatgcttttttttttttttttgctatgtaaaataggcacatagtttgggtttacttttaatt

SEQ ID NO: 216466 - DNA, 347 bp, Homo sapiens
tggctgtcgctcacctccctttcctgggatgagtgttccaagcacttgctttgatgatcaaacagtctcctttttgaaacacattcactctaggctttgacgacaacactgcatttcaaaaagtggtggcatcattaggaaagaaggatcctggctttgtgaccagcataggacatgacacctatttccaccaaatttcattgtgtttttttttttttttaatttttattttttttattgatcattcttgggtgtttctcgcagagggggatttgacagggtcataggacaatagtggagggaaggtcggcagataaacaagtgaacaaaggtctctggttttccta

SEQ ID NO: 216467 - DNA, 513 bp, Homo sapiens
ctacctgcaacattaattttaggggagacccaatagaaccatgagaaggatcaatttctaggcagttctgaccctactaggatttgcatcccacaaacccctgaaacaagagtggatttccattaaggatggtatactctaacatcttagcccctttcccaaaagtgagggcaaaactgtatgctgttccatgaccagccgggtgtagtccatggagcagtgcttggccacagccacctcccaggggagcgggtaacctgctgagtctgcatgggatgctgagcaaaggaacaagtgtccactttggacttggaataggatgtaacccttcttgtaaacagggaagtaaaaatgcccctcccagagccccagacaccaggcggggcacagtcccacatccaaatgcttgggttggagagaaacagagagctgagcagcatgcaaccccttttgctaccaagcaacacagccagccagcattttgcagtccacattgtggggaggtagtactac

SEQ ID NO: 216468 - DNA, 565 bp, Homo sapiens
tactctctctcgccttgttgagccaactcctctgaaaaggtggggccgcgcggaggagaagtagtggggcagagcaggggtgaagcgcagcctacagtcctaggggagccaacaaaggccgagatttgaggtcaccagctctaggcccaggctgagcctaatgttgtttagagtcacagactacgcagaagaaaaccaaggccggggaggggccgtcacttgcccagcgtcgtgctagatctcgggcctccgcctctggctgtgtagtgctccccactaagcccctcgtccccggagtgccacctgcatccacgctaactaggatgctggctgcaactcgtgtttcccgcggccggtgtcgcgggctacctcctccttggaactcgaaaagtgaaagtgtccggaacaaacagacgccgagagggaaacgaaaaaatctggagaaagtcatctctcagtgttaaactgtaaaaaaatataaactgtgtgtagcataccctttgacccagtaatcatatttcggggaaagaaccccttagaaattaaagcatcaattcatgaggat

SEQ ID NO: 216469 - DNA, 426 bp, Homo sapiens
cacaaggatggaacactgcggttgcagggaaaatgtgggaatgtcactctaattgaagacatttagggccccaaattggcattgctgaaaagactgtttgatgtcagctgtgtgagcctgcactgctttctcatcttcgatagaatgcatcttcacagtatgtgtgaagtggcattaaagtaaccagattggtgccagaggccacttagaaattagttccggtgctttggaatcacactttattatttgtttatgatttggggattttattttttgttaaagatacatttctttgattctttcgtagttcgtaagctggattattgagtattcacacacgtgtgtgagatgtgccacccttgaaccttgttacaacgtgggcacattattcacttgacatggattaaaaataaagatgtttcttta

SEQ ID NO: 216470 - DNA, 1058 bp, Homo sapiens
  misc_feature (747)..(747): n is a, c, g, or t
gtgtggtggctcacacctataatcccagcactttgggaggccaaggtaggtggatcacctgaggtcaggagtttgagaccagcctggccaacatgatgaaactccatctctacttaaagaaaaaaaaaaaaaaaaagaaagaaattagctgggtatggtggtgcacgccgtcatctcagctacttgggaggttgaggcaggagaatcagttgaacctgggaggcggaggttgccgtgggccaagactgcaccattgcactccagcctgggcaacaaaagcgaaattccatctcaaaacaaacaaacaaacaaacaaaaaaaccattttataactagttgtttttcaatgaaacaaagattctaatcattttactctatgaataagccctttctagttcagagatttgaaaaagtaatggagagttatcaataaatcaattaaatcagaaacattaaatgattagaatttcctctccttgttagtagtcaccaagtcatgctgattgttactttctacatcaagagaagataaattaatgtacattgaataactcccaccaagtgtcactatctcactctggactcacaactctggtaaaggattttttatatccagttataggccgggcacggtaactcacacctgtaatcccagtactttgtggggccgagatgggtggatctcttgaggccaggagtttgagaccagcctggccaacacagcgaaacccgttttctaaaatcaantatacttgacctggggcacaaattcatggctgaataccccatgcctcacctcggaaaaaaagaccttgttaaaaataaataaattaaattatccgggtaaatggggccggaatcaataaagggcattccctaacaataaccaaccggtttccaagggtttttccaaaaaaaaaccaatgcaaacccctaggggggtaaaaacaggcccgttaaaagggtggaaacacctgtcctcttgtgaaaccctttaatgggtgaagaccccactgtctctcaagtcgctctggcgagatatgccctctctactcgct

SEQ ID NO: 216471 - DNA, 1001 bp, Homo sapiens
gtgtggtggctcacacctataatcccagcactttgggaggccaaggtaggtggatcacctgaggtcaggagtttgagaccagcctggccaacatgatgaaactccatctctacttaaagaaaaaaaaagggaggttgaggcaggagaatcagttgaacctgggaggcggaggttgccgtgggccaagactgcaccattgcactccagcctgggcaacaaaagcgaaattccatctcaaaacaaacaaacaaacaaacaaaaaaaccattttataactagttgtttttcaatgaaacaaagattctaatcattttactctatgaataagccctttctagttcagagatttgaaaaagtaatggagagttatcaataaatcaattaaatcagaaacattaaatgattagaatttcctctccttgttagtagtcaccaagtcatgctgattgttactttctacatcaagagaagataaattaatgtacattgaataactcccaccaagtgtcactatctcactctggactcacaactctggtaaaggattttttatatccagttataggccgggcacggtaactcacacctgtaatcccagtactttgtggggccgagatgggtggatctcttgaggccaggagtttgagaccagcctggccaacacagcgaaaccccgtctctactaaaaatacaaaaattagctgggtgtggtggtgcacgcctgtaaccccagctactactcaggcgcctgaggcacaagaattgcttgaacctggggggcagaagttgcagtgagctgagatcacgccactgccctccagcctgggtgacagagagagactctgtcttaaaaaaataaaaataaaaataaaaataaatccagtgttaaatgaggagacagaaaatcaaattaaattgtccatttccctataactaagttaacaaaaccaggatttacacaaaggtctatatgaccaaaaaaaaaaaaaaaaaaaaaaaaa

SEQ ID NO: 216472 - DNA, 459 bp, Homo sapiens
ttaggcatttcgaaacatataaccattgagggtatatatgatcctgacattaaaataaatttattacaattttattattattacttagtagtattgaacatttactgagctcttcctatttgccaaacactgttctaagtccattaggtgtataatctcatttgtcttcacaaagactatgggttaaggtaaatggtagaagagcaataatctcctagacagattaaatactttatgcaaaggaagccctgtggtaaagagagagttagtatgaataaacatggaaacaagtccaaaaaagctggagtaagaagtgtcttggtggaaatggataaaagtgggaattaaaaggtgtgcaggggccagatcttttaaatgctctggttcaaccttacctttagaaacattctgttatacccattgagcaaaataaagcatcctttcttctttgtttcttga

SEQ ID NO: 216473 - DNA, 371 bp, Homo sapiens
agcgcaggttctgtacttatgaacaagctcatcataaggcattttgagcagtaatgtcctgactgtgcttggagactaacaagaggataaacatttgcagtttgatttgggtccttccatatctccttttctatccttcaaggatctgggaccctgtgttaaaacctttagctatcaaaactccacaaaataataccctccaaaacaacacaaacctcctgagctgcatggatcaatgttgccctttcctacaagcccctagtgaaactcccatctttcgtttcccagatctcatcctgagactatgaagaaattttcctctaaatgtaatgtatactaagtcaaagataaatgacagtggccttttctaa

SEQ ID NO: 216474 - DNA, 368 bp, Homo sapiens
atactgctaccaggctcagagccttcccttgcgctgaggcaaggcaaggatgaacaaggaaggggcaggactcaccacgtggtcaactgcgtgacccagaaatgcctctttgtgttccattttaaattctcatccagtggaaataaggaatctaaaagtctttgaaacgaacgctaggaactctgtctgtagattcccaggaggatgcagttctggtgggagaaagatctggccgtagggccccaggatccacctttgcatctctgcagcctcctggcccagtggccacgccctcattcttttcttagcttgtcgccagcctccatgctctgccccatggttccctccaccaggagcaccctcctctc

SEQ ID NO: 216475 - DNA, 495 bp, Homo sapiens
accagttcagactaaagccagaaagcgctggaagagctttctctgagatggaactgaaagcacactgatgtgtttgaactgagtaagaaaagaaatagacagttggaaaagagttgagaaatggagtactgacgagtgtattttaattaagaatgttttaaaaataaacctaactattaatcccagggaaaaccaaaagctgaggatgaaaaattattgtattatggataagccatgtctcaaaaatgtaaataataactattcatctaacatttgttataactacagtgtacggagaagacagggtatggagtagtatataccaataaatgtgggacgttagagaaaacaaaaagtaggggaaagagtgtaactttgatcttcctcctactccttccaagagtaggaggttagtggctgatacctaaccctgaaaaaaaaaaatcacattacaagcatttaggtcagagatctgttagagatggagattagccg

SEQ ID NO: 216476 - DNA, 411 bp, Homo sapiens
aatggcaggatcttgaggggctaaggaaagctgcagcactgaacagcagtgactgtccttggggatagaagaggggagggggagaatcatttggcaagcatggattacaaatagagaaagtatagatacccatatattttgccacattctttcctacagaagagttatcactgagctcttccctatggttcttcccaatctagaggggccccgagtggaggccacttgagtaatagcatctatgcccatataaacatataaacatacttgcttcaaatcccttttctgccacctgctgcagaaaaggtgtatatcaccaacttccacactcaaggcacatatttgaaatatgcttatagttaatttactatatcttccaaacagattgtctccatatgttttcagttacta

SEQ ID NO: 216477 - DNA, 553 bp, Homo sapiens
ggtaatccggaagagctattcatttgagatcatcctggggtctcttgcccaggatccttatcaaaacactaaaataagtactctttgatttcatgacttcacaatcactattttatcctgtcttcaacatgaaaccatcagtgtttacaccatcagtgtaaaaatgatcagtgaaagactataaaaaagatcaagcctctgtgtttaaaaacgtagctaaaaacatgtatatgacattcaagtaactgagaccaataaagatgttataaattagtctgggtacagtggctcatgcctgtaatcccagcactttgggaggccaaggtgggagattcagttgagaccaggagtcgagaccggcctgagctgaacgtagtgacatcctgtctctacataaaagaaatttaaaaattagcctggtgtggtggtgcacacctgtagtcctaaatacttgggaggctgaggtgggaggatggctggagcccaggagtttaagatgacagcgagctatgatcatgccactgcactccagcctgggagcaataactggtct

SEQ ID NO: 216478 - DNA, 578 bp, Homo sapiens
gttcctatttactactgtacagacctaagttaatgatgagctctaaggaagttcgttcttctctgaccccataatagcgatagcctctttcttcctatgccacttagtacctacagtcaggggtgatgttgaatgcttagccctagatgttatttggggcagaacataaaagttttcccttgttactcatgaagatcagtatggtgtaggttgctttgggccacactaaataagttgtccttgcctagaggagtctggttttgctgttaacaacttcttttccattttcataagtgttcatcatagcacaccataggtgtttactatttagcttttttctggttcttacataccttagttttctgaggttttgtttgattcttcattatccttcactccagctcctgcatctcttgatttggagacatttccttctttggctccgctttctggacattcaggcttaactcaagctaaacttttggtttatggcagtaaatatgtaaaggatttaattgatttgaatttaattgcatttaaccaaagcaattacattttacatgtaaatacatagggaa

SEQ ID NO: 216479 - DNA, 344 bp, Homo sapiens
ctcccacgtctaagctgtgcgtcggaatcatgcaggaggtgtttatttcttggctagttctgaagacatcaagagttgggcaggtgacgatgtgtgtgttaagaaagcactctgggtccgggcatggtggctcacgcctgtaatcccagcactttgggaggccgaggcaggtggatcacttgaggtcaggagttcgagatcaacctggccaccatggtgaaagcccgtctctactaaaagtagaataattagcctgatgcagcaaaaaagggagttgtcaaggctgaaaaaagcaagaaaaagaaggaagaggaggaagatgaggaagatgaagaggatgagga

SEQ ID NO: 216480 - DNA, 166 bp, Homo sapiens
cttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgagga

SEQ ID NO: 216481 - DNA, 656 bp, Homo sapiens
tcttgtgccacgcataaaatatactaacaatagttgatgagctaaaaaaaaattgcaaaaaaaactcaatgttttaagaaagtttatgaatttgtgttgggctgcattcaaagccatcctgggctgcatgtgggctgcgggttggacaagcttgctttagcagatggtcccgaagccagagatacagtgatgaatcagctcccacaaggctccctttgggcattatttctattttattttatttttcatcctatccttacttttattctttacaataagccttaatgattcctacattgattgatttttgaatgttaaaccaaccttacatcctaagaataaatcccacttggctatgatatattatctttttatatatcattggatttgacttattaatatttcgtgtaggggttttgtgtgtaggtttatgaagaagattggctggcagatttcctttcttgcaacagctttgtcagatgctgatacctaggttatgctagaagtggtccctctttttctatccccttgaagagtgagtgtaagattgatgtgatttctttcttaaatatttgggagaatttactggagaaattttctgtgcattaagttgaaaggtgttaaattatgtgttcaattaaaaactttttaattca

SEQ ID NO: 216482 - DNA, 270 bp, Homo sapiens
tttacctcttctttgatgtgtaaagcactgaagcagaaagagcttcctccctgtctgagaattattcacctaagagggtggcctgttgtccatgctggtgactaatacttggttcttagcctatcctttggtttcattttctctagtgattggaaaatagcaaagcataagacaagcaaaagatgggcggtgggtaagggaggttgtctgtttgtatgtgtgtgtactttaccttattttcagaataaattatctcccagtttagttgca

SEQ ID NO: 216483 - DNA, 344 bp, Homo sapiens
agcaaagtcatccctctgctccctgagataaatgcagatctgattgcctcctttggagaggttcatcagaaactcaaaacaatgcaaccatttgtctcttatctacccctgaccggaagctccctgcctgcttccagtcttcccgcctttgcttccggttgtcccacctttccggaccaaaccaatgctcatcttgcatatattgattgatgtctcatgtctccctaaaatgtataaaaccaagctgtgctaggaccaccctgagtacctgtggtcaggacctcctgaggctgtgtcatgggtgcacgtccttaactgtggcaaaataaacttcctaaattcac

SEQ ID NO: 216484 - DNA, 176 bp, Homo sapiens
cagtggagtttcaccaaagataatgcttaccttactttcaaagtattgccattccctctgaacatcatccaaacaggtaacttaatagaaagagaatattgccctttgatttcagccttattaaggataatacctcaatttcttatttatatacaaatgggaagaataattacttt

SEQ ID NO: 216485 - DNA, 263 bp, Homo sapiens
ccaggagcagctcggaccgcgctcagaacactcgggacgaggccgccgctccgcaggccttgcgggctggggtcccacgaaacaaaggcggcagccagtggccaggacgggcagcgtggttcacggggccgtggctccctcgggggtcgcgagctcggcgcaaacgagcccctctaccaaggtcgcctagagtcgcgaccccgacatgcggagccgccccaggggggtttctcccgggtccctcctgtcccgaggcggccgct

SEQ ID NO: 216486 - DNA, 397 bp, Homo sapiens
gcagcatgcaatttaaattaactgagagtccagtaatattcaatcttcaagttttgaaaaagccaattacttttatatctaaatagcagaaggtaagactgtatcctcaaggctttctcgagagcttttctttaagtgttcttgacagataatgggatccagcccagtggtaagcttcagatgcagggtgtttccttcaagctttttgttttgtatattgtttagataactgtcataaattggagagaaaagaggctgaacacagatgccgtaattgaagagaacagttttcatgcttacaatccatgatcaaataaaatctctggctatagtgaatttcaatggaacaaaaaagaaattgtggtttagaaagctattaagttcttgctaaagaagc

SEQ ID NO: 216487 - DNA, 417 bp, Homo sapiens
aaatcactgattctcctccatacctgtgcatccttcgacgtccagctctggacctcctcttgcttgaagccttccaggcttactttaatccatattgcttgtcatttattcagcagtcctgggaccatgcaacagcaaaggcagaactgttttgccttcctaccgaggtagaaaacccctgcaaccatgggcctaacacctgtagtctctttggaaatgttagtaaattggtagcccattctgcctaggcaaaatccgcctggcagttgtccaaaaactaagctatctctgacgaaggcggggcatgggaaagtatggattgtaaagcctaactgggaacatcatttactccagcaaacaaagatacggatgtcagaggatcacttgttctgctaaatgtagggagctggagtgaaa

SEQ ID NO: 216488 - DNA, 217 bp, Homo sapiens
ctaacttccacatttctggacccagctgaaccctggaaaacaagcatacctaagaatagaaagaaaaggtacaggcaagcaaggacccccaaagcttgaagtataattagagctggtggagaattaacaggagaggaaagaagagggaacacgaatgccccagtgtcatttctacaactacctgtgtgggtgtttgatgaacagtgtcatacagcaa

SEQ ID NO: 216489 - DNA, 452 bp, Homo sapiens
cttttcaggaatgcaggaagatggacacacggctggggaagtacaatgaaaggccaagtaggcagcctgttctcctcagatcagtcccccacgaacactcattcccgaggactcatccaatactaataagagaatgctcttgtttttgaagaattttctgaaagccatcctgacaaattaagtagagtatgctgaagatagtcagactttgtttttaagaattgaatattctggaagaggctcttcagtccaatctttagttctctccacagagcaaacgaagtgaagtgctgaaggcctggagcccgagctgttcccacacggactccaggacagttaaggcagggttgccttaactaaatctctgacaactgtttcttctgtctttctcctaaaaatggaatgcaggccatctattctagggaaataaaggattctagttatgtgaatcc

SEQ ID NO: 216490 - DNA, 635 bp, Homo sapiens
agcggtggctcacgcctgtaatcccaacacttcaggaggccgaggcgggcggatcacgacggcaggagactgagaccatcttggctaacacggtgaaaccccgtctctactaaaaatacaaaaaaattagccgggcgtggtggcgggcacctgtagtcccagctactcgggaggctgaggcaggagaatggcgtgaacccaggaggtggagcttgcagtgagccgagattgcaccactgcactcccacctgggccacagagcgagactccgtctcaaaaaaaaaaaaaaaaccatattattaactgattatttgatatcaccaaagatatcttattttctgttcaatctcaagacccatgtataagatcctagttaataagcaaaagtatatacaacttactctttaaaccacatacagttattttccttagatatcttatggtggcttaaagattttattatattatttcaggccagtaaaagatggaaatgctggtccataactgcaaaagtcaaatcagaatattttaacataataaacagttatgagtacacatgttctgaatctatggccagccagcccagtaagaatgaaaataatgagtcaattcctatgtgctgtcttttacactgt

SEQ ID NO: 216491 - DNA, 309 bp, Homo sapiens
cgcctataggacagaattgtcaaaggtgaaattctgggtaaagcaaaactccactcaacactaaccagcaactgctgagcttccccaacgccaactaactgggaggaaactgtctttgtgacattgccatttcgaatttatcatttgtctttttattagttgttgttttttgtttgtttgtttgtttttttgacaggttcttggtctgtcacgcaggctggagtgcagtggtgtgatgtcagctcactgcaacctccacctcccggcttcaaacaattctcctacctcggcctcccaggtagctgggac

SEQ ID NO: 216492 - DNA, 715 bp, Homo sapiens
tgtggccgggcttggtggctcacgcctgtaatccagtactttgggaggccaagatgggaaaatctcttagcctaggagtttgagatcagcttaagcaacatagtgacatcttgtatctattaaaaataaaataaagttagacaggcatagtggcatgcaactgcagtcccagctactcagaaagctcaggtggatcgcataagcccaggcagttgaggctccagtgagttgtgatcgtgccactgcactccaacctgggtgactgagtgaaacggtctcaataaaacaaaacaaaataaataaaatgatgatgaagaaacaccataagggcaggtgtggtggctcgtgtctgtaatcccagcactttgggaggctgaggcaggtggatcacccgaggtcaggggtttgagaccagcctggccaacatggtgaaaccccgtctctactaaaaatacaaaaattagctgggcatggtggcagacacctgtattcccagctattcgggaggctgaggcaggagaatcacttgagccagggaggcggagattgcagtgagggacagggtctcattctgccacccaggcttgagtgcagtggcgaaatcttggctcactgcagcctcagatttcccaggttcaagagatcctcctacctcagcctccctggtatcagggaccacaggcacacgccaccacacccagttaactttttgtat

SEQ ID NO: 216493 - DNA, 635 bp, Homo sapiens
tgtggccgggcttggtggctcacgcctgtaatccagtactttgggaggccaagatgggaaaatctcttagcctaggagtttgagatcagcttaagcaacatagtgacatcttgtatctattaaaaataaaataaagttagacaggcatagtggcatgcaactgcagtcccagctactcagaaagctcaggtggatcgcataagcccaggcagttgaggctccagtgagttgtgatcgtgccactgcactccaacctgggtgactgagtgaaacggtctcaataaaacaaaacaaaataaataaaatgatgatgaagaaacaccataagggcaggtgtggtggctcgtgtctgtaatcccagcactttgggaggctgaggcaggtggatcacccgaggtcaggggtttgagaccagcctggccaacatggtgaaaccccgtctctactaaaaatacaaaaattagctgggcatggtggcagacacctgtattcccagctattcgggaggctgaggcaggagaatcacttgagccagggaggcggagattgcagtgagctgagattgtgccactacactccagcctgggcaacagagtaggactccacctcaaaaaaaaaaaaaaaaagaaatgcca

SEQ ID NO: 216494 - DNA, 393 bp, Homo sapiens
ccgggcgccatggctcacgcctgtaatcccagcactttgggaggccgaggcaggcggatcatgaggtcaggagtttgagaccagcctggccaacatagtgaaaccccgtctctactacaaatacaaaaaatagctgagcattgtagtccctgcctgtaatcccagccactcaggaggctgaggcaggagaaccgtttgaaccagggaggcggaggttgcagggagccgagatcgcgccactgcactccagcctgggcaacagagggagactccgtctcaaaaaaaaacaacaaaaaaagagactgaggtggaggattgctggagcccaggagttggactatgaactatgactatgccactgcacttcagcctgagtgacagtgaaaccatgtc

SEQ ID NO: 216495 - DNA, 402 bp, Homo sapiens
cactcaaattctaatgttgattgagcccccactgtgtgtgagacactgagtcctgggaaaagaggggtggacaaaaccctgttctgacctttccaagatgaaatagaagctgttctgccaagcacggtggctcacacctataatcccagcactttgggaggccaaggcaggcagatcgcctgagttcaggagttcaccaccaacctgagcaacatggcaaaaccctatctctacaaaaaaaaaaaaaaaaaaaaaatttaccgggttgtggtggcgtgccctctttgttccccagtctaacgggggaggctgaggcaaatttgtcttgaccccaggaggcaaaggttgcagtgacccaagaccgtgcccatgcaccccagcccgggcaacagagcaaaaccc

SEQ ID NO: 216496 - DNA, 418 bp, Homo sapiens
cttgggtggtggctcatgcctgtaattgcagcactttgggagactgaggcagtcagactgctcgagcttaggaggtcacaggcagcctgcgcaacatggcaaaaccctgtctctacaaaaagttagctgggtatggtgccacacgcctgtggtcccagctactcaggagactgaagtgggaggatcacttgaacccatgaggtcaaggttacagtgagccatgatagcgtaacactgcacttcagcctggacaacagagcgagaccctttctcaaaaataaataaataaagatgatcacaaaaaaatacctatcaagtactatgcttattacctgcatgacaaaataatctgtatgctgacccccaggacacaagtttaccttttacttaatataacaaacctggcacatgtacccat

SEQ ID NO: 216497 - DNA, 561 bp, Homo sapiens
tcttatcaatgttaatttgatatatctataccgactaagcagtcatcaatatcatcttgatattgattattatattttggttctgtaggagaatatccttgtttgtaggaattacacacctgaacacttagggtaaagaagtatcatgttagaacctattcagagatgattctgggggaaatgctctgtaaatttgaaattatttcaaaaaatttttttaataaatgttctttcaggcacattcaccactagagaaattactttctttgagaactacaaagacacaacttttgatataaacctacagcagaataatgtgttttcttattgggattttgagatctattagatacaaaaataagcatgcagaggtttcttaagagatagctttttaaaaacacatttaacacacactgaagatacatacacacacagatatggtaaagaattttaaagtggctggtgtagttgtgcatctactgagatttataggattgtgacctaaaaacagttgggcatttttcaggatttaaaagcaacatcctgaaatttaaaaaaaaa

SEQ ID NO: 216498 - DNA, 458 bp, Homo sapiens
tgagtgcttatagaacaaatgaatgaaggagaggatgcataaataaaatttacgacttttgtctttactctcagagcatgctttatttctcctcttgtagaagaataagaatcaatgttgtaatatctgcctcgacttcaggccctccttcctacagatataccttcaccatatccatatttatctttttttaacccatacttatgaaaaagtatttatctttagctaatattagtagatccaactggggtttagatttcctctttctgcctctcctccatctgcaccctctcttttcctcagcaaacacactgaagtctctcccatctatgtacacatacacatttttatatccccaaacaactttccaattgattaactgtttctcaatttatcttcaaagccaagtacctagaaaaacatcatctaacataagtatctcaccttctcatctccca

SEQ ID NO: 216499 - DNA, 769 bp, Homo sapiens
tcaagttaagatggatccaccaattaactttattatagtaattattttactatgtatatgtatatcaaaagcatgctgtatatcttatttatacaattttcatccatcaaatatacgtcaataaagaaaagatggaaagaaaaagatgaaaatcacactggacagggttaggccctaaatccaatgactggtgatatgagagagctttggagacacacagactcacagaaagaagtctattaaagaagaaacagagattgtagttaagctgccacaaaccaagaaacttgctagcaaccaccagaagatagagggagcaagaaatgattctttttggagccatcggagaaagcctgacactatcgacaccttcagtttggacttctagcctccagaattgtgaaagaataaatgtttgttgtttgaagccacccagtttgtggttatttattatggcagccttaggaaattaacacactcctcatagatttaactttaatttgggtaaggagagtagttgaggtaacggtgggatgctgtagtgttgagttcttgaatataaagaaggcagaataagaattctgttcacctgagagatggaaatttaggacaaagaggaagaaggaaagtgtctagaaaatacatacatatgcatatacacacacgcgcgtatatgtttgtgtgtgtgtatttgccctgactgaacttaaaatcatcttaaataatgctgtcacatgataatattgttgaatgcactggtctcctcccc

SEQ ID NO: 216500 - DNA, 458 bp, Homo sapiens
gagccccctccagtcactggcaccatgcccacatctctttaaccccaaggggaaccctggcagcctgtgctctctcctcccttggggcagctcgagccaaagattaggtcaccaggagatccacagcacactggaggcctgctgatcctctgtgcttgggagtcagagctaattgtgcagtagacctacagatggtttgttgatgcagtaggtcaggggtgtgagatctccaggcagggcggtgttgccgtgggtgtatagctgatgtggcacccatagcctagggttttctgcccagcagacagctgtggggacttcccagttctttttgccttgagtggatctcaataagctattttaaagaagtgacaacttatcttagatcacaaagtaaagaatagaaacaaagaaaaaattttaaaaaaattctctatgctttaactccatccccaccacat

SEQ ID NO: 216501 - DNA, 592 bp, Homo sapiens
agcagaactggacaggaggaggggggctgacagacacgcaggaggagaaaggggaggacagatgaagcagagaagacaagggtggcagccaggaggaaattctgagactatgaaaagggagtctcaagaaaatgagacaaaaaggacagaagttgtcagcaggttcagacaagaaacggagagggagaaggggcctggctagcaaccctccctagatggcggcaacttctggggcatgggaggcacaggtgtgaaggaggcaggggtacctcttttggaagcagaatttcctaggggagagaccttaatgctggaaggccaagagctgaaataagataatggatgcccagtgctttgtaagctataaagcactatacaaattattgtcgttgttatctggttgtgatatcatttacaaagatactgcagaagtacatttagtgacatggaaagatggccaggatgaactatggagtgaaaagagcaggttacagataatataaatgatgccattttttacatttccatgtacaaattcagaaaaaatatctggaagcataaatatgcatctgggtgatgagttgtggatgat

SEQ ID NO: 216502 - DNA, 353 bp, Homo sapiens
gcttctggctattactttctcctaaattgctcataggataaatttcctaccccattataatataagccttggggccgggcacagtggctcacacctgtaatcccagcactttgggaggccgaggtgggtggatctcttgaggtcagaagttcaaaaccagcctggccaacatggtgaaaccttgtttctactaaaaatataaaatagctgggcgtggtggcacgcacctgtaatcccagctactcaggaggctgaggcaggagaatcacctgaacccgggaggcagaggttgtaatgagccaagattgtaccagtgcactccagcctgagcgacagagtgagattctccctca

SEQ ID NO: 216503 - DNA, 370 bp, Homo sapiens
acacttgcattaatattcttataaaagttcacttcccataaatatttttagaattaacatttattataaacatgacatagatgcaagttctaaatctaggaaatttccgtccctttgtctcctaagtccagcttagtgcctgtgctcagctgaggctccgtcaagaggtggcgggggtgagagatggatgggagtgcagttcactagcttcaaggatcccagctctggttggtgggacccagaataggcagaagaaatgagtggctcccagattggaggccccctctcagcagacagggagtagtagagtaaatgcttaggaaaagcaatctgttaattatttatccaagttctcctcttaaaagctatg

SEQ ID NO: 216504 - DNA, 414 bp, Homo sapiens
tgttttacctgaggatttccctcatggacctctttttatctggcaccaaagttgacttttaaattgttctaaagccactcaagcaaaaaagttgataaaacactctgctttcctttacaacccccaacataaaaaaattatttgttggaaaaaaatgttttcttacatgagatgaaacaatattgtctgggcgcggtggctcacacctataatcccagcactttgggagcctgaggcgggtggatcacttgagctcaggagatcaagaccagcctggtcaacatggtgaaaccctgactctgctaaagaaaaatccaaaagttagccgggcatggtggcaggcacctgtagtcctagctactcaggagggtgaggcaggagaatcactgaacctgggaggtggaggctgcagtg

SEQ ID NO: 216505 - DNA, 423 bp, Homo sapiens
gattatgccagggcaatccactgcagtgcctgggcacttatttgtaacctaccattccacaccttggattcattcactgtggtagtaccaacccactggtagttttctatgtgcgccttgttatttcccgattaagaggttttgacagagtgattttgacaaccttgttgtgaatctgaggacattttgattcctttttctgattaaacattaaaagatgaaattcatgcatcctcaagtcaaaatcccaagtccaaaatgatcacagcctaaacaatgatattaaaacatctaatttacattattctatgctctggttacttgattgtagtctgaatactttgtctgcttagaacttgtattccttcttccccattttcctgcctttcctggcttatgtccacttattgttcaagatatctc

SEQ ID NO: 216506 - DNA, 227 bp, Homo sapiens
tggggtgcaggcttgggaaacaggctgcaataatacctgtccaatgaatgaatggaagatgatgaaatctatcctgtcaccagaatgtagttggcactcagagctggtggaatgagtgaactctgagacttctcagcttagaattccctgactctcctttctacaggatagagacagaactttctcatatcaccttcaaggtcttcctgggcccctttcatgtcact

SEQ ID NO: 216507 - DNA, 699 bp, Homo sapiens
cacagtggctcatgcctgtaatcccagcagtttgggaggccgaagtggacggatcacctgaggtcaggagtttgagaccagcctgaccaacatggagaaaccccgtctctactacaaatacaaaaattagccaggtgtggtggcgggcacctgtaatccctgctactcaggaggctgagacaggagaatcacttgaacccgggaggcagaggtgcagtgagccaagatcactccattgcactccagcctgggcaacaagagcaaaactctgtctcaaagaaacgaaacaaaacaagaaaacacatttgataccaactcataaccaagtctggattacttctgtagctcattatcactgataaccaagagttgattaatcaaagtagactacctgtcagtctatgtacagaactaaagataatccttattcttggttgtcgagtacagttttaggaaatggatcatcttaaaatagggtaatacggcctggtgcagtggctcacgcctataatccccagcactttgggaggccgaagcgggtggatcacctgaggtcaggagttcgagaccagcctgaccaacatggagaaaccccatctctactaaaaatacaaaattagccaggcgtcgtgtcacatgtctgtaatcctagctactggggaggctgaggcaggagaatcgcttgaacctgggagttgg

SEQ ID NO: 216508 - DNA, 343 bp, Homo sapiens
atgatgcattttccagcaactcaatggagttctaccttaaagtatttaccattgatccaaaattggaggaactaccttagattcttttaataacctagaaaggattggagcttgtattatttcctaaaccataggcaggcagtctagcttccctgctggatcataagaccaggacagcagagattgggtttgtattgatcagtagtagggaagtattgattgtctaacatctagtaagttgtctttatcagtatagacatagacaaaatacatgttttatgaatgaataaataataagaaccttaagagctgtttttttcccatttaagaaaacaaaaaggaa

SEQ ID NO: 216509 - DNA, 546 bp, Homo sapiens
ggaggcaaatttctacctcttgtacttgatttcttggtgcgggaaagtgttgggggatttagccaaaagaggagtgcaactttccatccttagatgttatgctaaagtgactcggtgattgtacaatgcataacagtaaaacttttctttttagctaaaatgttaagggaattttaatggtttcttctgttgaatttgagacaatccatgccattccctaggtggctaacaaaatgcttgattctgagcaggtaagactggacagaagggtggcagagttaagataaaacaaatcctgaatcaaataacagatattttatattactcttttttaaaattaaatgtttcatgtcactatttctttctaacttagaattacatgatatggacagtggagagctttttggtgcattgctacttgtagtgctaaataaatgggccaaattatgattctaactggataataaacagttgctggtttttctccaaagctatactagggttttaatataagcctgatcttttttcatatgctgggtaagatga

SEQ ID NO: 216510 - DNA, 633 bp, Homo sapiens
ttactgaaatagttaaaaaacctaactaagcccctggtgcaatggtaacataaggaatttgcctttttatgtttggataaactcaattttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaagccccaattttgctactaattggaaaaaatcccctaattggggggcttttcaaaattataggggcgctttttataaaaccgattgctgtaaaaaaatctgggttacccaaaattaatcctctttacaaaaaaacccttctttctaatttcgtaaaatacaaaagacaccccacaaatttctttttcaaaaaaagtgcacccctctaatacccacaacaaaacttcgaggcccaatatttttcaaaaactccgataaatatttctttaaacaacattctttttctaaccaaatggcgcaattctgaaaaacctctttaaataaaaaataatccccctcaataagccctggcctcctccccatctacacgatcctctttctagggcgctccccccttggc

SEQ ID NO: 216511 - DNA, 287 bp, Homo sapiens
tgccatttgaccctttggatttctctgtgataggctgaatgaggcagactgcctgtcagaaaggattgcttgagtatcttgtcagaaatttcttttcattctttctcatccaaagtaagtcacctactaactgttcctgaactgttctcattggctttctgggagtaactccctagacagggagtctcaaaactgagaaccatgttcagaactctttggcttcctcagaccctgggaagggtccaccagctcttccttcccagctctttgcttggtccgctcgttcc

SEQ ID NO: 216512 - DNA, 464 bp, Homo sapiens
gctgtaggtatggctgatgccctgaagagttgaagttggcagggaaggtgcccagaaaattttggattgaagatttcatggcaagtctctggccagtggcctagcccgggtaagccatgctatgctcacctccccacagccccctctcgcctttttttttttttttttttttaccttgactggaagcacaagcagaaactgggacatgagcaccaggagaccagatttccatggtcccgttgggggcatggggttggggagaggttgcagaggagggctctggaggggagcaactgtcacagctgtgagaggtgggggtgagcaggcagtcagggctgttccctccagaatcctggggtgtcctctgcacttctgcgccaagctggagtgctagtgtgatggacaaggtggtaagagagctgaaagagcacgagcataacaagaaagacagaggcagaagcaaa

SEQ ID NO: 216513 - DNA, 261 bp, Homo sapiens
caatgccatcagtcaaagtacagcaaatgaaatgaaagacattcgtgagcaaagttgaagcgctagaaagataaaaagaagcttaagagccttaaagtggtgttaattgaaaatgtttatttcgtaggagacaagttgtattatgatgatttcttttatccttcagcttctttaactacatgctgggcaatattatattccccttatgtttcaaaataacaataatatgcctgtggactgaaataaaaacatttagactat

SEQ ID NO: 216514 - DNA, 252 bp, Homo sapiens
tgcttctctgaactcatgcctgcaccttttctgctggaagcctgaacaatgatgcagagatactgttttctttgttgtagaaaacagcagaaggtctgtgctcacgagggcaatattaggtcctcatcagctgtggcttgttatctccagcacatcaatgaatggagaaaataagatttaaacaaagatcagtgtctccattctctaacattttactcaaaatattggttaggttagactccacacccacca

SEQ ID NO: 216515 - DNA, 451 bp, Homo sapiens
tgtcaataacattatttcctaaactctcagaaggaaggatgagtttatacttcttacgtatgagagaagtgaataggaaaaccaccaccctgcctaaatgacaaaattacatacaacacttcagtgtgcccttgaactacagtaagtactcaagaacatgtttcttccatggaacttagctctaagagtggctacaaagatgtatgtaaatacctgtaaaacaaagttggaaattctcttgatctgcattatctattactgtatatggctgttaagcactgaaatgtagctagttcaaattcagatgtgctattaaagtgtaaaatacattttgaaggcacagtacaaattttaaaaaggatataaaatgtctcattattagtttttatattgattatgttgaaataatactatttggggtatgctgggttaaataaattatactattaac

SEQ ID NO: 216516 - DNA, 174 bp, Homo sapiens
tgtcaataacattatttcctaaactctcagaaggaaggatgagtttatacttcttacgtatgagagaagtgaataggaaaaccaccaccctgcctcccaggttcaagcaattcttatgcctcagcctcccaactagctgaaattacaggcatgcactaccacgcgctaattctt

SEQ ID NO: 216517 - DNA, 1179 bp, Homo sapiens
tctcctcttctgtatcacatcagttctatcaccaagtcttctaagtactctctccaaaatttacccccaatatattgaattcctctccatttctacagctcctgtgaggaataactaacagtggatatagttggattgcttggttcttgaaagttcacttgttccctcccatccctagggctgaattattgtaaccaaggaagtgagaattcagaaaggtaagtatcagggtagacttagagattgtaatactgaaatgcttactcccagagttgtatccccatgactctctaccctactcatcagtagagatacaaaagctaggtgatgctaggctgtagccccttgttcctgcagtgttcctttgtagctgatgtgcctggtctccctggggagtatgaattcagaggggaacatctgcatttcctgtctggagtgtagtcactataagagaaaagtaacaaaccgaacaacatggagcaggtaaagcaaaattattggaatagtcagaataaaatttagctataagcatattaaatattctcgaaaaaatagagcatgctagaaacatgaagcgagaaggagaaaccataaagaacaacaaacaggagctagttggggatagaggacacaatcattagagaactcaggaaatggagtggatagtatgtggatacaactgaagaacgtgtaggcaagctagaatgtccactcagatctcccacaagttatcacgaaaggatagaagcagaaaatagacaagaaaaagcaataaagtggatagagaagtgttaatatatgtgtaataaggatctcggagagaaaaaagtgataaattaagaccaagattttcttagaaatggagaaggagttgagagttgagattgagagggcttttaatgccaagggaatataactgaataagtgtatacataagcagttatattgagacctttagaatgtatttaaaatcataagttccaggaacaatgttacctgccagaaataaaaaaaagctagaaaggtttaagatgaaagaatggaaaaagatggccaggtacagtggctcatgcctgtaataccagcattttgggaggcagaggccagaggatcgtttgagcctgggagcttgagaccagcctggacaacaaagtgagaccctgtccctttaaaaaaaaa

SEQ ID NO: 216518 - DNA, 1361 bp, Homo sapiens
gctatttgaaaggtaagactttggttagtttggggccattctgatgtcttcatgagtgggaagaaaacttttgctatgacctaatcatatgtgatccagaagaattaccattaactttatttcagaatttagacttccaaatcaggttaatcctccaattaaaagaaagattcagagtgaattttttaaaaggcaaggcagttatatgttgcttacaagaaactaaacataaaggcacagataagttggaagtaagagggaaaaagacatgcgaatactaagtataagagatctagagcagctactgtgaatatcagacaaaatagacttcggaacaggaagtagaaccagagatgaagaacctttcattatgataaaggagtcagttcgtcaggaagatagaataatcaaatgttctcaatcaataaagagacctttagagtgtacatgaagcgaaacctgacagaaatgagaaaaaatgtcacaagtagagttggaaatgttaacagtccccctcagtaatatcagtaataggaaaatctggaaaattcccaaatatttggtagcatatctaaataaggcttccatcaaagaagaaattataaggaaaattaggaactattttcaatggagtgaatatgcaatatatcccacaattatttgtgggatacattatgatatgtatattgtgggatatattgtgcagttaaagcaccacttacaggaattatgtacagttggcccttgaacaatgtgggggttaggagtgctgactctcccctgagcaaaaattcacatataactatggagtctccaaaagcttaactgcccatatcctactattaactggaagccttaccaataatagtcagttaacacagatcttgtatgttatgtgtattatatactgtactgttagaataaagtaggctataaagacaaatgaaaatgttactaagaaaatcataaggaagagaaaatatttttactactcactaagtggaagtggatcatcacaagggttttcatccgcatcatcttcctgttgtctaggcagagcaggaggaagaggggtcagtcttgctgtgtcaggggcggcagatgtggaagaaaaccctgtacgagtgggcctgtgcagctcaaactcatgttgctcaagggtcaactgtactttttaatgcttatagcagaagcgaagaaaggtatgaaatcagtgatctaatcttttaagaagctataaattggcccagtgagggggctcatgctggtaatcccagcacttggcgggcaaagacaggaggatcgcttgaggccaggagttagagaccagcctgggaacatacaagactcccctctctaca

SEQ ID NO: 216519 - DNA, 571 bp, Homo sapiens
atcacctagacaggtaaaagatgagcaatttgagctaccactgcaatctagcgctatccccaaacagactactgtcctctcagcaaattaagtactcagaagtacttaacaggaagtacttaatagaaatgtgaaactaccagtcaagttaaaagaaaaaaattaaggcacccagctcaggtaagtgcatttttcaagtagttttcaacctagccagtgttccagaaacaatttcaacactctcctgaggatactcacctgaaacagcctcaagtttagcatccttctaagagcttcagtaaataacgtccttgcaagggatctatataacatgtttttcttacatagaaggaaaacaagatcacacagataaactttgtaacaccaaaaataattaaagctctgtggatatttatctgcattagtatcctcctcaaagacacactacaaatgaactatcatggtctcatctctgaaaaatgataagtcttaaattctgctcatatatttcaaagccactccttaaaacctagacaggccggcgtggtggctcacgcctgtaatcccagca

SEQ ID NO: 216520 - DNA, 867 bp, Homo sapiens
  misc_feature (549)..(549): n is a, c, g, or t
  misc_feature (610)..(610): n is a, c, g, or t
  misc_feature (629)..(629): n is a, c, g, or t
  misc_feature (681)..(681): n is a, c, g, or t
  misc_feature (779)..(779): n is a, c, g, or t
  misc_feature (804)..(804): n is a, c, g, or t
gtggggcctttgtatctcactcccgccacagcttgggatcggtctctgctgttttacgtcctccacctcgggagcccccggtgactgtcacagcctcttgccctgtgatctgcaggttctgggagacgcacagctaagatgccaggacatcctggaagctgggaaaagatggagtttcactcttgttgcccaggctggagtgcattatcccaatctcggcttactacaacctccgcctcccaggttctgacaacaaaggagattgtgacatattgctgggcctaacactaaggtgatgttagttatatgctttggctgtgcccttggaaggcattgagacatactgctgtgcccagcaccaagatgatgtaacgtgactcttctgcttcaggcctgccaaaagaaaagattgtgacagatcactggacccagcacctaggtaggattgtgacatatatctggccaagcgcacagatgtaatgatgactgtcataccttgaagaagccaatagcaagagagaatgttgctctcaggcttaggaaaatgangaagtctttctgtacaaaagtcataaagaattactactctctcacatatattacgccctantgtgttacagagaatgtcntaacagggcccagcacacaaagtgaagattggggtttgtcctatgcacactncaccaaaccttttacagttgtcaaccctggaccaattgacaagagtctgctaagtggaagggtcctgaaattacaatgtggaacacaagtcccgcaantttgggaatttgtgacctggtcaanatggtgaaacatcctgggctaacaagtttgggaatgggggactccattttcctaaatccaagc

SEQ ID NO: 216521 - DNA, 309 bp, Homo sapiens
gtggggcctttgtatctcactcccgccacagcttgggatcggtctctgctgttttacgtcctccacctcgggagcccccggtgactgtcacagcctcttgccctgtgatctgcaggttctgggagacgcacagctaagatgccaggacatcctggaagctgggaaaagatggagtttcactcttgttgcccaggctggagtgcattatcccaatctcggcttactacaacctccgcctcccaggttcaagtgattctcctacctcagcctcctgagtagctgggattacaagcacctgccaccacaccc

SEQ ID NO: 216522 - DNA, 441 bp, Homo sapiens
agctctgccaaggcactggacaaagaagggatgaaattaaagttagttctgggctgggcatggtggctcagctgcaatcccagccctttgggaggctaaggcaggaggactgcttgagcccaagaatttgagaccagcttatgcaacatagagagaccccatctttttttttttttttaagtaaaaattagttcctctacctgatactaatgacctataagacacgtgtaaggtttatacaggatgctatgagggaacgagacaattttatcaaattaatactgggaagttctatcttaggcctaacttaaatccttcatgttacagtttaagcccagtcccacttgggttaatacatgtttgtaaaaagctttcactccttacaatgaaaggtactagagcaaagccaagtattactaagctgagaaccagggctcacag

SEQ ID NO: 216523 - DNA, 600 bp, Homo sapiens
ccagacctctcctgcccacgtgtttctcccatcagaactgagagagatgttcaggcagttcccagacagcccacaagaaacacgcctttaagccaggggtgctcaaacttgttcccaagacgatggtgacatgctggggtggggagaaaccactgctatgccttcttcctgaccgaccagttgttttcatttatcaatctgagaatccatcgaaggtgatatcagggtgacataaatgaggcacttcctgtgacaaacttaaggcgacacttgctcccattgttgtacaaggctgaccttgcatttacatgggcttgagagcgcaccaccttgaattttgtgtcccaggtatatctcttgccctgtcccagtccaggccatggaacacatgtacagaagaaaccacagagtgatgtacccagcaatcaggggcctgccacctgagtccctccttcaggggtggaccaccccaaccctgactgaccctagccagggttttccgtgaagcttgccccaaacacttctcatccacttattcctgaggctaaaataaaaatcgtagccagaagcagttgtttcagctgtgatagcaagcagtgg

SEQ ID NO: 216524 - DNA, 752 bp, Homo sapiens
ctgggcatggtggtgcatgcctgtagtcccacctaccagggaggccaagatgggaggattacttgagcccaggaggtcgagggtgcagtgagccatgttcgcaccattgtactccaccctgggtgacagaatgagatcctgtctctaactaaccaactaaatcaagcaaacattgccaaaacatgatactgagagcacatacaccagtttttttatttagaaatgaatataaggatctgatcctcaaagtcctgtgtatattattggtatgtatatttggtatatattaataaacaattgtgcatgaacacacctcttactataaaatgaggtatacacctgggttgttatttgattttggtgatatgtattttaaataacaatgtctcttgaaggacactgtgtataggaaacccgtaaagtcatgtttgcattaatctttcttggaaataattaaattaatattacaaattaaatgccaattaaggcactttttttcttcaaacaaaagggaaataatttatatagactcaaatatttttaatattttgataatacttttcattttatatgtttcacatttcctttttggagaattttacatgcatcaaattgttttgactaagttcattaatatgaaaatgaatacgaaatgtatattaacataggaaacatttaaaacaaaacttgggtacttaacattttcataactctcagaaattttaagtattttatgtatttttaagtggtgt

SEQ ID NO: 216525 - DNA, 425 bp, Homo sapiens
ctggaaaatttagtgttattggaatcaaaggagaaaataatttcaagaaggaaaaggtggatctataacatttattgctatagagaagtaaaggagaatgtagattagggagcagttttaaaacaactgatggccacgttttacatattcttgatgtatatgttgaattacatgtcaaggatatgtaatgtaatttcattttttaaatatttttatgcagtatattttcacatttttgtgttttatgtcagatttagaaacttcaaggagatattaaaatgatacacagataaattttcatttttcaagaaacttattgtgaactgcttagttttttattcttctttccccacatcttaagtgcatgcatttgtttgattgtttttaattaaaacttgacatatatttttattatgtaattgaat

SEQ ID NO: 216526 - DNA, 696 bp, Homo sapiens
tacaaaaataaatgtaaaagcccctgctcttcagtctggagagggaaatagacgtgcacaaataatacaagtcaaagagggaaaagtactgcaaattcattgaacatagaaaagctggtctttagccttttttaaaaaggggctgataaaatatagtcccccatgtagtttatccataatacatagcgtgccacttacaagctaaaaagccctatgaaaaatgaggcgttttaactaccaccaccaccaacaacaaaaagcatcgtgagggaaatactggtaaattgggccttggtttgtgagaaacttcagcgcaggcctagatcctgggggaggggagaagaggaacgccttcagtgagtgtcaataatttttaagtttatacttaactactcattaagttctttttgatataagttctttttgatacttgttagtgtttcactttttttttttttttttgagacggagtctcgctctgtcccccaggctggagtgcagtggcgcggagtctcgctctgtcccccaggctggagtgcagtggcgcgatctcggctcactgcaagctccgccttccaggttcacaccattctcctgtctcagcctccctagtagctgggactacaggtggccgccaccacgcccggctaattcttttgtattttttagtagagatgaggtttcaccaggttagcc

SEQ ID NO: 216527 - DNA, 296 bp, Homo sapiens
tactatttgcgctgatttgtcatcccctaggcatagtcagaaataatatgaatgtccggccaccttgaaagcccttgcagtgtttagaaaatctgtactctccaatatgacagccacaagccacatgcgcctattgagcacttgaaaagtggctccttgagatatgctgtatgtgtacactctggattccaagacttagtatggaaaaaaaaatgtaaatatctcattaacaatttttattgattacgtattgaaatactaatattttcatatattggctaaaataaaatgtatta

SEQ ID NO: 216528 - DNA, 559 bp, Homo sapiens
agttaataatatatcatatagtttcaaatatcgaatgttcccaacacaaagaaatgataaacgtttgagagaatggatatgctgcatgctattatgtgaccactatacatttaatgtagcacaacatcactatgtaccccataaatatgtacaattctgatgtgttaatttaacaaatgctgttacaaagataaagccctgcattatgcataccaggcagacattggtgctactggaattccatcagtccaggcattggatcccagagaggattcaattctgctgttcccctttcttatctgggcccacggagcccttgcccttcaggagaaaagtctctccttgtcccagacttcaaagccacaggcacagaccagagcctgaggcaggagggtgtgtgtgcagcccagtggtgcaagggcagacagggctctgagactctgcctgctcctcagtgatcactccctcatctttgtcatcctccaattgggtctaaaggcaacacactttggatacctaaaaactgacaacaaccaataaatgtctttatgagaagtga

SEQ ID NO: 216529 - DNA, 340 bp, Homo sapiens
aatgtaagacctgctactagaagaaaatattggggaaacactcacagacattggtctacacaaagacttttttatataagaccataaaagcacaggcaacaaaagcaagactccaccaaaaaactgttagaactgaaaaatgaattcagtcagacaactgagattacatcaaaataaagtttctgtgcagcaaaggaaacaataacatgaagagaccacccacaagacgggagaaaatatttgcaaacaacccatctgacaggggattagtattctcttatataattatatatatgagaatatataagaacatataaggagctcagacaactcaatagca

SEQ ID NO: 216530 - DNA, 701 bp, Homo sapiens
ccaaatgttttctagagtagcataaataactgattcaccatactttttacacactacactgtcaattctagtataaactaaggacaaatcagataaactaaagtattactcaacatcaaacgaaaatgtcaccgtgaatggcactgttaacttacagcaaaggaaataaacctgaatcactgatcaaggatatcaaatctggatgatgcaaagtaaaaatcaattataaaatctcaggccactgcttcctaaatggccaagacccaaatccaattcaacactttcattaaatccagttctaccagcttcctgatgcatgatcctacagggatatgctcttggttcctttgtctgatatcacttggaataatgccttggcactcagacctaatgaaggaaggtataccatatccttgtccatttggtttcaattcaaatgcacccacatttacattttcccccaccatacccacatttcttagtgaataattactggggccggatgcggtggctcacacctataatcccagcactttgggaggccaaggcgggaggactgcttgaggccaggagttcgagtccagcctgggtaacatggcgaaaccttgtctctacaaaaattacaaaaaatagctgggtgtggtggcacgtgcctgtggtcccacctactatggaggctgaggttggaggatcacttgagc

SEQ ID NO: 216531 - DNA, 249 bp, Homo sapiens
aactgacgtcagagaattgatagatataggtaaaaagtcacacatctggtgttagaagtgaagtgttctgcaaatgtagagaaaaaggaactgtttttttcttctttactagtccaggatacttctgtgtattgcagacatgattcacagcaggcgctggtcaagtcagcataggtaaaacttagaaataaggttacactctgatataacattaaaggaaataatctctgggtgtggtggctcatgtct

SEQ ID NO: 216532 - DNA, 541 bp, Homo sapiens
aattggtcaaaaagcaaaggcatcgggtagattattatttctttctccaatgctgtaatggaaataatttccttaatgtcataaacccatttatttgtttaattaatttaaaaaatttaaaacttatagcacaaaaatcaaactgatagctttaaagaattcagcctttttctctataaacaggaaaacttctgccagccatttctcctattgaacaagcatatcattcacttagggagaggtatttgggtttgcttttctgttcttttgtgttgatgaattgcaggtttttcagaccccatactttcatcacataattttctgacctcaattatgcttctcagaatacaacaggtaatgagtaacggaattgttcatagtgcttttaaagttgcttttaaataatgagataaaaatatattatagaattttctaccagaacatcttgcattcatcaaggttggatatcaattggaatttcttaaatctatgccttaaaccttaacctttgaattgcttttacgctattactgaaaaaaaa

SEQ ID NO: 216533 - DNA, 789 bp, Homo sapiens
taattttttttgtatttttagtagagatggggtttcaccatgttggtcaggctggtctcgaactcctgacctcaagtgatctacctgcctcagcctcccaaagtgctgggattataggcatgagcctgtaataaatagcacctggcctattattttgagacagtttcattctgctgcccagtctggagtgcagtggcatgatcttggttcactgcaacctccgccttctgagtttgagtgattcccgtgcctcagccttccaagtagctgggattacaggcatatgccactgcgcccagctaatttttgtatttttagtagagacaaggttttaccatgttggccaggctggtctcgaactcctgacctcaagtgatccgcccaccttggcctcccaaagtgctgggattacaggcgtgagccaccatacctggcctatattatcaatttaaatgattttatgccaaattaaaaacaagtggtcaccctaccaataaatatacgtatatatctttttcttgaactttccctaaggagatgtttatataatttccaagttatgtaatgtgaccaactctacccttcagttttctcatcagtaaaacaaagataattgaagtagaactattccaaaactgggattaacaaattctatagttctacagctagttccatagaatgttaactaatagtccaacaatatgatatgtttgggaattgctgggttaaccaaaatcttaaaaactttttgtgggtaagactcttcagtattcctatcctaatatttgt

SEQ ID NO: 216534 - DNA, 273 bp, Homo sapiens
tgtatctgggcaggggcagagggagaagtggaggccattgttggcatcctgggaatgactcactgtagctcagagattttcccaccccaagaggaaccgatcagtagttaggagacttccttctgcaactcgggaatttataaccagaggagaatgagttttctctgctccttagaccataaagcaaataagcccatttactctccttcaaaatcagaacagctgctgcttttacttccttttccagctttgccttctcttccagctgccttc

SEQ ID NO: 216535 - DNA, 398 bp, Homo sapiens
gcctcccaaaattctgggattacaggcgtgagccaccacacccggccgtgtctgacactatgttcttattgcagggacactggtgccttcccacaatgcagcaaccaatatacctggtgggggtgaactttgcctctcattaaaaacatccagcccaggttctgaaaggaaattgcagagcaggataagtccaaccacctgatgtgtcctcacagacaattatgcctgactccctccacctgcacctcccaggctgctggtgggtgcaaatctgacaggcaggatgtctgctgtgtccacactgcagagagaacagagccagggaaggcagggggatatcaccagtcccctcaccctgaccccactgcaagcccagcccttggtgtctttcctcgagc

SEQ ID NO: 216536 - DNA, 245 bp, Homo sapiens
caacttggggcctggtatacactttgagtccagggtccacctggggactgacgtctgcctggaggactgacgtcctcctgagtgaggtgggaggatctctggagctcaagaggttgagaccacagtgagctgtgattgtgccactgccctccagtctgggtgacagagtgagaccctgtctcaaacaaataaacaaaaaagccacacaaattatatagctatacaaaaatattttgtttcttttt

SEQ ID NO: 216537 - DNA, 568 bp, Homo sapiens
tgaagatcttcacaacataaatcatatttacttggatccaaaaataatcataggttatcacagtaaagtgtacatcttatgggaagtccttgagtggtattaacttttaaatattatatttaggatatgagtatatattttctttcacacctgtacgtaagtaaactttggaataatttttagtaaaagcttatattgtaaaaattgtttatgttttgcctatttcatttattacattaggactcaatttttaagttaatacctacttttacatttttttatgttccttcatacattcctgaggtatgtaataggaaaggacatatgtaataggaaaggatatattttaattcatatgtattaaatgctgctaactagaaaccaggataatctagggcagcccattaaaccctgtatcagtcggttatcaatttttaaaaaaattaatgtgataagggccagtcaattgagatgcattaaataagaacatgacagctattcctggaataaagctggaataattatttaaaatacttttaaattacattatttaatttaaaattcaaat

SEQ ID NO: 216538 - DNA, 484 bp, Homo sapiens
tgcaacttccgcctaccggattcaagtgattctcttgcctcagcctctcctgcagctccactaccactcccggctaagttttgtatttttagtagagacggggtttcgccatactcttgaattcctgacctcaggtgatccacccgcctcggcctcccaaagtgctgggcttacaggcatgaaccaccactcccggcgagaacttttgaggtctgtctgtacaaaggcttcaatatcgttttccctaaaatgaggaaacagttggacacattacatcatggaattattcattgatggttattgatttccctgactttattagtaacacgtgaattttttaagattccacaaaaacaaaagaacaaaataaaagtcccaccatccagaagtagctactttatactttggtatttccttccagtcttttttatttttccctctgttatgtgtatgcataagaaatgttatcatactttattctgtc

SEQ ID NO: 216539 - DNA, 193 bp, Homo sapiens
cagagtggagtaatagacactggagactcagaagggtgggagagtgggagagggtgagggataagaaattacttaatggctacaatgtccattattcaagtaatggttataataaaagcccagacttcaccactacaaaataagtttacataacaaaactgcatttgcactccttaacattattacaaataca

SEQ ID NO: 216540 - DNA, 336 bp, Homo sapiens
cagactcaggcatgtccttcaggatgcattccagaagaaagccttgttatcctaggagatgacacctccatgcatgttattgtccctgaagaccttccagtgggaccaggtgtggaggtggaagaaagtgatattgcttatcctaaccctacgtaggactgggctaatgtgtgtgtgtttgtgtcttcatttttaacaaaaagtttacaaactaaaaaataaagaaaaagaaattttacatagaaaaaagcttatagaataaggatataagaaaatgttatgtacagctttagaatgtttgggttttaagctaaatattataaaagagtcaaaagg

SEQ ID NO: 216541 - DNA, 941 bp, Homo sapiens
tagaacataaaccaaaatgtgggcagtttgtagttggaggctgtccttcgtatgtgcaggtaaataccacttcaggtatcttcatgcatttaatcaaaactctgcagttcgtagactctgcacacatagcacaatgccttgcatacagcagttatccaataaaatctgatgaatgagtaaatgagtaatgatatgcatagttgccaaggagatgaggttccctgacatttattcacactgaattacctgtgcacaaagaatggcaactttataaacattgcctttcatcgaattaaagataatcatctgaaatgaatttgtagtgaaataatcacttgtctttttatttaatgaaaccaaaacttatgtatgtttaactaaaatataaaggtttgaaaatgtgatgaagaaaattttgtactgcaaaattatccggtaatgaaatcttagttagaatttagatttaaacaaatggaaaaaagaggcataagggaattatttagaattccattatgttgttcatgaggtgaaatgttagttagttaaacacagtcaccaagcactgcttacttaaattctaagaatagcctgtttccatcaaaagtgatttgttgtttatatctagcaggaaccattgaatcagcaactaattatttcaaggatctttaacatttttccatttaattccaagcttttcatggcaaatttctggacaggactattttttggtaaatgtttgacattttctttgcccactaaaacatttatttagttcagattgtaaaaataattgcatatgccttatgcctcttgatacatttattttttccaaaggccatcaatataactctggagaaaagatcccagccaagtctgtaaagttctaaatgtcagataaattgcactttttatttccctcctagaactttgtgaaagagact

SEQ ID NO: 216542 - DNA, 402 bp, Homo sapiens
agctaggactacatgtgtgcaccaccatgcccagctaactgttttcctatttttttgtagagatggtgtcttgctatattgcccatgctggtcacttaactcctggcctcaagtgatcctcctgccttggcctcccaaagtgctgagactacaggtatgagccactgtgcatggcctactacaaaccttttttacattaatatacaattcagcaacataaaaagggacttcaataaaaagaatgtgtaaaaataagaaactggtaacatcttagatagacagatagatagatagacaatctctctataaacatatcctctctctaacagaaaatgaaaacgaaattagaaatgttggggagagaataagcaaatgaaaatgaaaggccaaacataaaaacaa

SEQ ID NO: 216543 - DNA, 213 bp, Homo sapiens
gcctattccaatttcattttgctgttcaggcgtttgtttaaattatggcaggagcacatgacctcgggcatgggggcgccaagcatgccagagtatctagacacaaagcagggctggctgcatctccaaccccgccccaccgtctggactgctttctttacatggatctacacactgtgtgtacatacgaaataaaatatacagttttttcta

SEQ ID NO: 216544 - DNA, 567 bp, Homo sapiens
agtttaatgttgctaaaaaggtttaggactatctggataaaggtaatattagcaaaagtttgggcaatagccataattcaattatattcagcttgattatattaacatttttgcttagcacttactgtgtgcaaagcaatatactaggggatacaaaggttaaaaatgtcataaaaatacagttctgaccttcagggatgttacatagtttgaaaaatatatcaacagaaacatcatacaaaaaaaatcaacaaaaagcacaaaaatatccaagtggttagtaggagatttaaagaagttataaatgatatataattcagattctaaattgcctcactaaagaggtgccttgaagtatgcagcttgaaagattttgataaatgtcaatgtagcagtggtattttgtaagcaaagagatagaaactgaaaaaaaactgcatatgaaaagtatgataattattgtgaacaaatcattagagaatttcaacaacatatttgagctagcagcaggaaaaaaaattagtgaattttaatatagatcaagtagaaagtatgcaatctgaggag

SEQ ID NO: 216545 - DNA, 318 bp, Homo sapiens
attccagtgactgagcccagtgttgggggctagggtagaggaagagtcccttgtggacacggtgggagggagggaggcatgaggggacaagcaggatgccctgacagattttaacccagaagcatgaatccaggtctgaggtcagcaaacgttttctgtaaagggccagatagtaaataatttgtactctttgtgggccatccagtctctgtctacttgactctgccatcgtagggcaaaaacaaccacagacaataaataaacgaacgggcgtgtcttgtgttccaataaaagatggtttacaaacacaggcggcta

SEQ ID NO: 216546 - DNA, 458 bp, Homo sapiens
agctggctgactgcccacaccaccaacttgggcctctcctgcccactgctgggtaatgcaccatgggaaaaaggctggctttgtgacagtctaagtgccagagatgacaggcctgcctgctacccactcacaccctaccagtgaggtttgtcacctcttccacacagctcccactgcccccaagaggttaagccctgtcattttgtgtcattgccagatttcttatccatgtctctttttttgtagcaaagaattcagtgtcattaataacccctggtgatggccaagggcaggccccatgctatttgttatctgttggacacgcgttttttgatccccttctgatagacagaaaatacccatcttctctcttactaattggcagtatgtgccaggcttgggagttggcaacagccattgcttttcatcctttcagattacgtgttggactcctcatc

SEQ ID NO: 216547 - DNA, 754 bp, Homo sapiens
gaattaacactccctcagcacccacagcactccatgccccacgctaggaatcaaaagactccagagctctacttctagagggaaacaggatttttgcttgtttttgagacagggttttcgctctgtcacccaagctagcgtgcagtggtgcaatcatggctcactgcagcctccaaatcctgggctcaagcgatcctcccatctcaccttcctgggtagctgggactacagataggccaccacacccggctaattttttcattttttgtagagacaggggtcttacgatattgcccaggctggtctcaaactcctgggttccaaacgatcctcccaccttagcctcccaaagtgctggaattacaggcatgagctaccatgcctggcctggatgtttcttaaagttaatgcaataaactgtgacaggtgctggaagagaagtctatttggggcacaaaaaaagggtgtaatcaatcctagttggagacagtgggtacatcagggaaggccacagagaagggggcatttgaaatcctgatctgtgttcccagcctgatgaagaggggaggatttctaagcaatcacaaatgttctggcaattctgtgagctggggctctctgggcaatcacagctctcaaaatagccacccacacgtggaaaaacagtggaatcaagagaaagtcacaaacttaaagttttgtaaattgccatcttgaactatccactgactcaatctcacaatgccatcagttt

SEQ ID NO: 216548 - DNA, 442 bp, Homo sapiens
ctcctgttactgaaacagtcttcggatttgtctgctgccttcactttctattgtctacgctgtcgctgctgtgatccttctacaacacacatctgagattgccactctcctaattctaaatccttcagttgttttccactgctttcaaaatgcaatgcaatgggctgggcgcagaggctcactcctgtaatcccaacactttgggaggaggccgaggagggcaaatcacctgaggtcaggaatttgagagcagcttggccaagatggcgaaaccctgtctctgccaaaaacacaaaattagccaggcatggtggttggctgtaatccctgctacttgggaggctgaggcaggagaattgcttgaacctgggagtggaggctgcagtgagacaagattgcgccactgcactccagcctgggcaataaagctagattccatctc

SEQ ID NO: 216549 - DNA, 530 bp, Homo sapiens
actttcagtagagacggggcttcaccgcgctagtcaggatggtctcgatctcctgaccccgtgatccgcccacctcagcctcccaagtgccgggaccacaggcatgagccaccgtgaccagcctatttcttggattgttttaaagggtttgggtttgtttgtttgttttttagacagagtctccctcttttttgcccaggctggagtgcaatggcgcgataccggcgcagtgcaacctcagcctcctgggctcaagcgatccttccacctcagcctcccgagtagctgggactatagcatgtgccaccatgcttggctaattttgtttatttttgtagagatgggggtctcactatgttacccaggctggtctcaaactcctgtcctcaagtgatgctcctgtcttggcctcctaaagtgctaggattacaggcatgagccggctactccacttggccttcaaatagtattttttatacttcttgtatacttttttttttccagcacaaaatcattaggaaaaatgcaac

SEQ ID NO: 216550 - DNA, 262 bp, Homo sapiens
tttgggggttgaatgagtcacttcaaagggctcaaatgactggtgaatcttccagataaaaggagagaacacagactttcctgcgcattttaaagtgactgaggtgctccacactctgatttatcctttattaccctgtggcagcattagcatacccctgctaccacatgcatcttgcaagcagtgatgtgtcatcaatatatgcaccgtggcaatcacagaatgctcaaatatttattgaataaaaagagcaagccatacc

SEQ ID NO: 216551 - DNA, 170 bp, Homo sapiens
acttggttcatcttataaagtactacatctccaagacaggtcagctgtctgagacaacacattctagaaacaggtcaaggaaaaagacatgtgagtgggcaacaacttcacatgttgtgctttcctgatgagccttcatttcctcaaaaatctttccttgttggttctct

SEQ ID NO: 216552 - DNA, 468 bp, Homo sapiens
gaatagaaactgttgctaatttgttcaccaggccttttccctgagaaatataaactgttgtcactttatgtccttattcatcacttcaaattgtttgttttcctgaacatttaccactaatatggaatttcaaaactgttgggttgaaagatcaatagaagagtatttgaaatgtattttgtgaaatcaaatgttggtacgtgatggacggacatatgcttattttaatagtttttaaaataatcaagtatttactaagtgccaggcacaagcctaggtgctatgaatacctgttggtgttcaggaactacatggtccttggtcctctccctcatgaaacttatactcaagtaggaagtagacaagataatgtgaaatagtaacaaatgctgtgaatctaacacagtaataaaatagaatgtgtctagaactgggttctcttaggtaaggatggtcagaggggttatt

SEQ ID NO: 216553 - DNA, 595 bp, Homo sapiens
atagatcaggaaactgaggcacagagcagtcgagcaatgttttcatgttgtccaaaccatgctggccagtgatggctgaccccactgcccttgttcttacttactactctgtactggctcccaaggacctggaaggaggacgggcccttcactaaggtggagaaagcttgaagaagaagaggatttggaagagggcagtttcaagtccctccagtggagcatcctctgtgggagtccattattcacccagtaactgtccattaaaccagcaaaggccaagtgcaggcacagtcaacgagctcaggctccttgagggcctgtactctaagacaccctcacagggcggagactggaggaacgtggtgctggagagggaatagggccagaggagacatcttagaaggaaaccttcctctgttacaaagtcgaatgctggacagagcacagaaagcacaaactggagcctcagaagctggttctcaccacagtaaccaatattcacaataacatgaattcacttatttactgacttccactctgtgtcttttcagtaaaagcactcactgtcttctgaatatcgatctatactctccca

SEQ ID NO: 216554 - DNA, 444 bp, Homo sapiens
agaccctgtctaaacaataataatattaataaaaataaaataaatttatttatttcattagcccagagattggaaacgagaacagaaggtatatgcccaagataataattaatgtatagtgagataaccacaactcaagaaagaaatatggccaggcatggtggctcacatctgtaatcccagcactttggaaggccaaggcgggcagattacttgaggccaggagtttgagaccagcctggcaaacatggcaaaatcctgtctgtacaaaacatacaaaaattagctgggcatgatggcacatgcctataaccccagctactccggaggcttaggcaagagaatcgcttgaacgcaggaggcagaggttgcagtgagccgagattgcatcactgcactccagcctggtcaacagagcgagactctgtctcaaaaaaaagagaa

SEQ ID NO: 216555 - DNA, 352 bp, Homo sapiens
tgggaaaaacacttgttttattttacacatatctcactttgtgagtaaaaaaaaaaaaagattggaggccagattcagtggctcatgcctgtaatcccagcactttgagaggtcacagtaggcagatcacctgaggtcaagagtttgaaaccagcctggtcaacatggtaaaaccctgtctctactaaaaatacaaaaattagctgggcatggtggcaggcgcctgtaatcccagctatttgggaggctgaggcaggagaattgcttgaacccaggagatggaggttgcagtgagccaagaccacaccattgcgctccagcctgggcaacaagagcgaaaatctgtctcaaa

SEQ ID NO: 216556 - DNA, 332 bp, Homo sapiens
cactcgctgtgggatgagcttgcctgtcaagccatgtgtgacagaaatcacgtcagggtgtctcctgcatggatgcagacaggccacagctttgcagaatgttggaggctggactgtgagggttggttctatgccaaagacaccagagcttggaagccttgaggtgatcatattttaaaaatagttcatagtagcagtagcaacaatagtagtaataggaccaatagttagtattagtcatggtaatctgcggcccacctcattttattgtgcttccatgatactgtgttttttatgcattaaaggtttatggcaacctgtcttgagcaagt

SEQ ID NO: 216557 - DNA, 180 bp, Homo sapiens
aatttataaatataatatgtatattttaaaatacagtttatattatagagttatgttcctctgtaataatttctctttacactgaatcatgttcagtttttattatgcagataatttaatcttacagctttgatcttttttaaaaaataaaacagccatttggagtctaaattcagccat

SEQ ID NO: 216558 - DNA, 552 bp, Homo sapiens
tagaaggaatttttggtagtgcatgaatttctttgtatttttattggctacttacaatatcttaaaaaaaaagattctaaatcctttttcaattaccctatcagttcatatatttagcataatttaccaacatttccaaacttagcatggaaaagccatcaacatggcactaggtcatgggtcctgaatgaagccgtcagcaaggattaataaactgtgacagctgcccaaaagctttcattcttttttacttaaacatcagattgcaagctgaaactcagcataatccttgttgaaactagcccagctaacatggaagaagtcagaactgagaacagatgacagtaatagttattgcaaattcagtctatagaaataaattctagaatttaaatttacataaatagcaattcctataaaattttaagagtagtacacgaactgctactatctgtttcaacaattgttgttgtttttcctttttttagagacagagtctctcactttgttgcataggatggactcgaatttctaggcttgagtgatcctccc

SEQ ID NO: 216559 - DNA, 531 bp, Homo sapiens
ggatggggaagcaaaagtgaccattgttaactctaggtggttggtaagtgggtgttccttgttttattctttcacctgtaatgtatgtttatgttttttaaaagttaataagttggaggatgatagaagcattaaaaagtaggccgggtatggtggctcatgcctgtaataccaacactttgggaaactgaggcagtaagctcccttggggccaggagtttgagaccagcacaggaaacatggcaagacctcctttctcaaaaatttttaaaaaagaaaattagccagtgtggtggcttgtgcctgtagtcccaactacttgggaggatgaggcagaaagcttgcttgagcccgggagttagaggttacagtgagttaaggtcgtatcactgcactccagtctgggtgacagagtgagaccctgtctctaaaaataaacaaataagtttatgggggagagcggaaagaacaggtgccatgggatcataggatgagagggcagtacaggatgaatggtcctttcccccattg

SEQ ID NO: 216560 - DNA, 640 bp, Homo sapiens
tttgacccattggttatttaagagtatgctgttcaatttccacaatttgtgaatttcccaaatttctttctgttattgatttgtatcttcactccattatggttagagaacatactctgtatgatttaaatcctttcaaatttattgagaattgttttatgacccagcatatggtctatcttggaaaatgttcttatgtatttaagaagaatgtgcattccgcagttgagagaaaactttataaatatatattagattaaataggttgacagtgtttttcatgcttcctctacccttactgattttaatctatttgttctatcaattacttgaaggagggtgataaaacgtccaattataattgtggatttgtctacttctcttttcagttttgcaattgttaattcatttattttgaagctctgtcactgggtacatatacatttaggattattatgtcttcttgatgaactgatccctacagatcattatgtaaagttcctctttatctctggcaatactgccagttctaaagtctatttcatctgatatcaatttggccactccagctttcttatgtttaatatttgcatggtatatctttatgtttaatataaattccttgtagacaacatatagt

SEQ ID NO: 216561 - DNA, 285 bp, Homo sapiens
tacaaaaattagctgggcatggtggtgcatgcctgtagtcccagctacttgggaggctgaggcaggagaatcacttgaacccaggaggtgggggttgcagtgagccaagattgtgccactgcactctagcctgggtgacagagcaagattccatctcaaaaaaaaaataaaaagagagaaagaaaagaaaacactgatgacaaggaagggctctgaagaaaacaagttcaatcggatattaaaaatacactacacagctcttgaggcttccaagatggctgaata

SEQ ID NO: 216562 - DNA, 324 bp, Homo sapiens
gcattttccgtgagcaggacgagttcgtcatccgcgcagaggacatcctttccctcaaggtttgcattctgaaagagtggcccaggcagggtgatgtctaacccagggatggcaaaggtgtccacatgccatcatttcttccaccagcacccatatcacatgattgctgctcctttccattagcccatgtgtggccacagagccctcagcacagggctccaggcagctgctacagctgcccattgattggggttgatagatagatttgctacccctgatttaactcaagaaataaaatgctaatggtgaaaagtcaaaaaaaaa

SEQ ID NO: 216563 - DNA, 361 bp, Homo sapiens
attttattatttttgatgctattataaatgtaattgtttcctcaatttccttttaagattgttcattgctgatatatagaaatacaactcatttttgcatgtttttgtatcctgtaactttgctgaatttgtttattagccctaaggagtttgggatcttgttgtggtatgtttaggatgtacatcatatgtgaatagagatcattttacttctttctctccagtttggatattttttatttatttttattttccttgactaattatcctgggtaaaacttccagtataatggtgaatagaagtggtgaaagtgggcattcttgccttgttgtgctaatagaggggagcttccagtcttcc

SEQ ID NO: 216564 - DNA, 746 bp, Homo sapiens
aaccctcacatgtatggtcattgatttttgacaaaagggccaagtcaattcgatgggggaaagaatagttttttcaacaaatagtgtggggtaactggatatccacatgcagaagaatgaatttggacccttaccttacattgaatgtaaaaataaactcaaagtgatcacagacctaaatctgtaagttttagttacaaaccacttaggagaaacgcaggagtaaatcacaatcttgggttaggcgatgacttactaaatatgacaccaaaaacgtagcagtaagagagaaaattgctaagtccaatttcatcaaaataaaaaacttttgtaattatccagtgtaagatattttgtcataacagtcttggactaagacagaacttatatccagaatatgctgtataaagacctcttagaacgcaacatcaaagagacaaataatacaattaagaaatggaccagggatttaagcagacatttctccagagaaggtatacagatggtcagttagcacgtgaaaagatgcttaacatctctggtcatttgggaaatgcaaattaaaaccacaatgagacagcacttcactcccattaggatggttataactaaaaggaaaaatgggctggttgcagtggctcacacctgtaatcccagcactttgggaggcaggtggatcacctgaggtcgggagttcaagaccagcctggccaacatggttgaaatgccatctctactaaaaatac

SEQ ID NO: 216565 - DNA, 520 bp, Homo sapiens
cctggagacagaccaagttacttagtatcctgcacagtgctcctcgattgatggctgacagccctgtgactgcaactgtaggctccctggaggccctccaggaacaaaagaattagctttgaaagcaagttattttcaaatgtattagattggtctcatgggagtggaacaaataataatacagttgttttgctactaccacttgttagaaatatataagtagtccatggatatgtgattacaaaagaatcctatgtatgtatctagagtgagatgggaaagtgtcccgcttaccctccttctacctccaccacttcctggcccagaggtaatcactgctaacaggttacagcatgaatatgtagtctgtttttcataactctatagaaatatatgtacatatttatattttagaaacaggattatgttatgtgtgtgttattctgtgtcttgcttttgttcacttaatgtgttttggatatctttccatgtcagtttataaagttttatttttaatggc

SEQ ID NO: 216566 - DNA, 188 bp, Homo sapiens
acagagcaagaccctgtctctaagaaaataataaaaattaaaaaaaaattagagtcaacatccttataaccactacttacatctaccattaacatatttctttttttattttattttatttttttttgagacctcgactcactgcaacctccgcttcctgggttcaagcgattctcttgcctcagcct

SEQ ID NO: 216567 - DNA, 370 bp, Homo sapiens
gaatgttcctgtgagagcctctgacactttgggcccatccatgttgttttcttgctattaaaaacaactatcttgggcgatagaaggttactcctcaagcaagggaacatatttataaggctttgcacaatcagtgaacactgatttcgattgtaattttcaggcactaccgaaggagacatctccagtttctttacaaaggaaaaactgttgggtttggaatgtcaggacaactctgagtttttgtgcactaaatggatcaatggtgtgtaggttccaaagtatatttgtaaaataaaagccattcctttacacacaagtgaagctttcaaagttgaacttttatgtaaaaacaatcatggaaatttga

SEQ ID NO: 216568 - DNA, 596 bp, Homo sapiens
ggttatggacctacagaagatgtgcagggcctgagagcagccatctgcattaggtggggcagggagagcgggcctggcctctgtgctcagcagcccaggcagtgtcacccacccccggtgacacagcccgccctgctcccaagatctcaggccaggaagggtctgcccatcacagggagcaggacttcttgccaccctaagggcccagggagcagatgtggcccactcttcccaccccgaccaaccctgccacaccgacgccatcttcccgggtttgccatccagtgctgagagcatctctctaaaggcccctaagctcccctaacctaaggccttggcttgccaggagtgtcatggggagcaacgcacagacctgtgggtgcccagcatcagaagacacactttagggtcacacctgtggccttggcctaagtgggttagaggagcgtctggccacaccctggacttagggctgcaagctccggggtggcccttggcctccttagaagtccaagctgctctcttggagcagtggcacctggttcccaaggttactgtgcctgggaggtcccttcccagtagcaaccacagcctag

SEQ ID NO: 216569 - DNA, 463 bp, Homo sapiens
atctggggatgtctttttctggggctagtccatcttgtcctggataactaccctatcttgagaacccagtcttagtttcatgaaacatctttaatgaaaacagccttttgggatggtgctgctgcaaactgtggtctggctctcctcgcatgtgctctggctgccgcagaacagagctcaggccgctagggggcacctccacgtgccgcttttagcagtaccagccacctcaaagctttgccacagactgaatagctccttccgggggcctggatggcacccaggggatctgccgttgcttttttaatttatttttttacatttagctcattaatatctgttagatatttttatgtctgcattgaaatatgtaactttatttttcccccaaaggataactgttccaacattatcagttagcttgtcttttccccaccaacttaaaatacgactcttattttta

SEQ ID NO: 216570 - DNA, 259 bp, Homo sapiens
gaagctttctagagagaagaaactgttcatcatagtctcacaatccctcctcccattcccacaaaaagtagcagcagcagccttactctaaaagaagtccctcttcttccgatactctcaagcatccactcctgcccagggtccagctccagcagaatactgttacattcctaaacaggtagcaaacttactaaaatttgggcctgcctgtctacgtaaggacaagaggacattagcctttcaaggccagtggagggct

SEQ ID NO: 216571 - DNA, 526 bp, Homo sapiens
agtagaggacatagttactgatttagtccatagcatgtttagaaaaaggcctttgtgaaatgaagtaggggtttcttctggtttcctcctcctctcaagagttaactagtattcaactttttaattcaaaactctgcacactatttgaatatcttttgttaaaataaaacattctttacgtaaatgtcagtgtgttctctcttaaatgtaatgctaaaattcagtaaattttccacagtagaatatcaggtccattacttcctttggccaaaatgcaggactgttagaaatttaaacaaaagtgtaaacaaatcatgataattaaaaccgcttgtaaaggttcgtcaaacaacctcacaaacatcagatagtaagagataattattaggaacaaaattaaaacaccttggcccaccataaagacaattctaaccttgtcttttaaaatagaacattattattcagatattgttacttgaatcctgacgtcagcttacataactaaatacctcaagtgcttttaccc

SEQ ID NO: 216572 - DNA, 492 bp, Homo sapiens
caggggatctgcctaccttggcctcccaaagtgctgggattataggtgtgaaccaacgcacccagcctgtttttctttatagtcatctccttataactgtttcccatgcatgtaaaagagtttttaaatagcatgttgtctgcttcttttctgctgagtaaataaatttgcatttaagaaaacaattttgaatttatataggagaaacatctccttaaaagtaccataaacattagagcaaattattagagccaatcattgattcttcttgtctgaaaagttttaggaattctttaatattatttttgtacatataaacactcaatatttactgaatgaatgatcgaaatgaacgagcaaatgaataattagaatgaataatggtttaaaatccctagcaggcctttccatatctgaacttctttgctttctattataatttaataataagccttttggaaattaactcaaatatattccacttgaactacc

SEQ ID NO: 216573 - DNA, 411 bp, Homo sapiens
aatttggcaaatgtgaaagaatgtcagttctgagattaggatacagaaagtctctctctctctctctctctgtaatcaaccataggtgtgatttcactgtgcattacaaatatgttttagacataatttaacctgtggtatatctgaacctgtggaataaaaaaaaaaggcaaggactgttctcactgtcagagtcccctgtcacattctgtgccccatttctcagactgggaaaaacaaattgccatgtgtgaagagccctacggagagcttcatgtagccctgtgaagaggtccaggagcccttgaagaactgaagactgacaacaatcacgtgagtgagcttcgaagtgaatcattcaatgccaacccagtcctaagaaaactaaccatccgtctgaaagcttggtta

SEQ ID NO: 216574 - DNA, 469 bp, Homo sapiens
aatacataaatcaaaatatggaaggtatacattggtttagtctaaaaagatgggctgtcttgaagtgggggcttacaagtcataagtggattcagagattctttaatctgcagttggttaaaggaacaaaaagcttggagctagcagaaaggaatgtttaagttaaggttgctatgtcagggtcagccataactctgacagtttaataagattgatgggctatagatgtgacttaactcttgccttctgtggcctcagatcttgtttataatttggtaaaggagtctttgatcagccgggtgtcgtggctcatgccagtaatcccagcattttggaggcctagacaggtggatcatttgaggtccggagttagagtctgaccaacatggtgaaaccctggtctctactaaaaatacaaaaaattagccaggtgtggtgacgcacacttgtaatctcagctactcgggag

SEQ ID NO: 216575 - DNA, 611 bp, Homo sapiens
ttgagaaaaaagatcatctgtgtgaaatataaagagcaatgctagaaattcaaagctttgtctcttcaatagacctaattctgggaatgtagaagaatatatatgtatatattgacagctaaatgtctactgcatagtcctacagcatgttttatagatgacatctgagatatacaattacattatattttacttcagatttcatgtctgtgagtcctgactttcctaagctctgttcttctcattttctttatttacaaaatgagggcatgatccccccatgtcatattgttatgaggattgtattaggtaatatatataaagcattcagataggacgtgcacataacaggttcttaataactgctggtcttcgtcttttttctttttaactcctagggtacttacagtttttgtagaatggtaaagttagacctcaagatactatttaactctggctgtgaacatcttacgcatccaagtctgacagatttctaggcgactaaaggtttggtttaggaggataaagagtataggtgccttgctccagccagtcattcattgtatgcaaatgtaaccaccatcaataagtaacaatgctatggacccatg

SEQ ID NO: 216576 - DNA, 223 bp, Homo sapiens
tgggttctgctgttttaaattaccttttgatggtttgaaaaatccatgagttgttctagtgggaagcccacagtggaacattggaatctcagttcatggtatgatttttcagacagagctctcctgcccttggagaccaccactcaggggcttagcaaggcgacactctgccctacattctgtcctttttttttttctttttctttttcttttttttttttgc

SEQ ID NO: 216577 - DNA, 153 bp, Homo sapiens
ggctgcagtgagccgagattgtgccattgcactccagcctgggcgacaagagagaaactatgtctcaaaaaagaaaaaaaaatatgccagagaaaaaaaggcttagccatatgcagtggctgacatctgtaattccaacaactccagaggcta

SEQ ID NO: 216578 - DNA, 402 bp, Homo sapiens
taagtccatgtcaggcaaggattaagtcacacaccccatgggtcactctgacccagtggtttggttaacagacttccttaactgaaaacattcctttctgctgattcaaaatttttagacaaagttttactcttttaaccaattgcaaattgaagactctggagtgacctatgaccaggaagcccccactttaacatattctgcctttctgggccaaatcaatgtctaatcttcatgtattgatttatgactttttcataacttctgcttccctgaaatgtgtaaaacagagttgcgatctaactgccctgagaccactgactcaaggctttttcagtttatgtctttccctgggctgttgtcactcatactagctcagaataaacctctttcaaatagttt

SEQ ID NO: 216579 - DNA, 454 bp, Homo sapiens
aattcttattttctgtactatgatttttatagttttagtttattaagtgctcctggaatacaggctcctggaattaattagaaaaagaaaaaaccttcttaggcagcactaggagagaaacactgagcagaaagctatagcatgactttcgtgctttgagtctcagttcctatgaaaagagttaaattacaataaagtagcctggaatagctgctggtttttactgtcatctttaagagactggcaaggacgggttcttgctgcccccaaagagcattttttttgcatgttgatttatactcaggcttttgaagctatggtctcctttaaatgagaatttctgtttttacctagcacctgccattaagccattctttataatttctagtttcctggagaggaagcaacatattcaatacagtattcacacaaacagggaaatatttaaaagaca

SEQ ID NO: 216580 - DNA, 227 bp, Homo sapiens
gactctccattggtactgctgcttccatccagaatgagggttttcccactcaaaagcaaatacttctcttgtcttcagccaagggacatgcccagaaggcatcttttaaatctgttactctgaaccattgattgtcatggaattctgctgaggatggtaaaaggattggggacaacagggtgggtagtctggactatttggttgatagcctggagatcttgtactag

SEQ ID NO: 216581 - DNA, 532 bp, Homo sapiens
tctcgtttgtgttccctgcacttccttaccgctttagcctttgcacactattagttttctcaccaatctggaaattttcaccttatctctcagtgcagctttgcactaaaaagatttctttcctcaatcattcctatatggaatgaatatgtccattctattattttgagaagaattttgtatgtaggaaatcatttgcaaaccaaatgtaggcttttttaaaacttagatttaagattcttctaataagcagaaatatgtcaaacttcctctctcctaaattcaaataacttaattaccactgtaatctataaagtgcttgagataccacccaaggctgaatatacctaaatatataatatcaaattctttaccttaatcattttatacaaataaccaagatgtttttaacactttgaattaaattctattaagaaccaaatatgggctgggcgcggtcactcacacccgtaatcccagtactttgggaggtcaaggcaggcacatcacgaagtgcaggaaacaagaccat

SEQ ID NO: 216582 - DNA, 452 bp, Homo sapiens
gtaattgcatttaagaagaatataatgcttgatttctatagttcatcactgtggcttctttaaaagcttagggtgctaggtatacaaactttgagaactatagttttagatgttttttacatctagaatgaacatcttttagatgttagtatctatggttatgctgaaaaactttaaatattacaaataatgttttttggtctttggaattgaaaattccatggtaaagtacctaatgtatgagtagggaaaggaggacataataatttaccaataatgcataagaagaaaacctgttaagcaccattgcctaattagaaaggtcatttaaggattgttaaatgctaaatttaaatgtttcaaaataatataattttaaaataatacaaaattcatggtgttcttgctgtcatagattttgctaacagaaattcaaaatgatcagttctgct

SEQ ID NO: 216583 - DNA, 255 bp, Homo sapiens
atagagacttttcaatgtaatatttttatgtttttattgacagcgtttttgttttattttttcggttattaaaatccactggctcacataaactgacctatcaaaacagattcctgaatagtgcaacaccaatttgcacccatggacagatagggaaatccaaaactattagttattaggttttcagagagatggtagaaaatgtgaatctatgtgacttaaagggtcttgaatttattttggggaagatatttg

SEQ ID NO: 216584 - DNA, 313 bp, Homo sapiens
agctcatcggctatcattagtgttagtgcattttatgtgtggcccaagacagttcttccagtccgtggcccagagaagccaaaagattggacgctcctgctctagatatactgacttttccaaggaatgacaggggttaagatccgtttttaattggttccactcctggtggaaggctttcttctatgcatgtcaggttttctttgacttatcaataccttcatgaagaaacaatgaagtgaaggacattttaaaagcaggttgtataagccactaaaaaattttgaataatgcctagtctctgcatataagt

SEQ ID NO: 216585 - DNA, 180 bp, Homo sapiens
ctgcctatggaccagtcagcatgcacttccccattctgagcccataaaatccccagactcagccacacattggtactacccaccttcaggccccttctcacacagagggctacctgctttgggccccctctcctattgagagctgttctgttgctcaataaaacccttctccactgcact

SEQ ID NO: 216586 - DNA, 635 bp, Homo sapiens
ataaatatttcacagtgccaattcatattactctgaaattttttggtgatacattatgtatttttagtgcctagcttttcaaaagcaatttagttttcctacgtttattatctttattaatatcgtttaatcataagtgagaactctgaaattctgaagatgtctataaaatttcacattatgtagaccctattatgcaatttttaaatcatatatatagtttgtacattatatgaatactttttctgataagatttcatgatttttttgctttgtattttgcatgtgcttttctgattgttcattttcttcttcagtcgtatttctcagtttttctccctcagaccaagttaaactgtttttttcccaagagctaggaatcatatctgatcacactgggacttcccttcactgtcagtctaagagtttgcatttttgaggtttaggaaaagggaaaaaaaaggaagaaagaaagaaattgtatctgagaacaaagaagctgccacatggtccctcggtatcatgttattattgacacttggtagaaagaagtatagtggcatttcagtctagtctcccccaactggaaattatttttctttctgatttttagtcttttaagttctcgtaccaaa

SEQ ID NO: 216587 - DNA, 435 bp, Homo sapiens
agaccaggccatgtggctcagaatgtatacagcaagcacccaatgcatggctgctgatggttctccctataggagctagttgtcagcattgtttagtaagtgtggcatcctgttcctccaagtgagctggagccagaaggcactttgaggatgaggacagatggcattttctgaaagacagacatacacgctggtgagcacagaggttgtgccatgtttgtttctgggaggaatgttaaggggaatcacagcgcacacttctagtgctcctgggcatgtgacccaggcccgaaggaccactgtgtcatgtcccagacatcttctcactgcagcttcagcatctgttctctccactctaccctccatgcaaacagccaccatggctatgttcctcaccatcccagtgcccagtgcccaacctggagtaccgcagcc

SEQ ID NO: 216588 - DNA, 575 bp, Homo sapiens
ataaatctggaaagtcggattgtctcactctggaccacgctgaattgcagtggcataatcctggctcaccgcaacctccgcttttcaggaggttcaagcgattcttctgcctcagcctcccaaagttgtgaggttacaggcgtaagccactgtgcctggcctactttcttaataaacttgctttcactttaccctatggactcatcccgaattctttcttgtgcgagagctaagaaccctttcttggggtctgaatcaggacccctttcagctaactttaccaattaccacagatggtcacccttaattaccaggtgaatttagaatgaactatttgttacaaatagtgctgtcaggtcagcttacttaggacttgcagcttatctcaagaacatctatgttaagggttgtgtctgcttagctacataaaagggagacttttacaaaacagattacattctgttttgtaatctcttagtggattgcctgtggtgaatatcacattttgatttaatgcttattcaataataaaattatttttctactatctttgtggaaagacttattggagattt

SEQ ID NO: 216589 - DNA, 274 bp, Homo sapiens
ccctctgtttagttagtggaattgagaacaaggcccaggtggatgattgaggactaaaccccaaacttgccttggatcactccactgtttcaggacatcaagggctccagacattgagaaattttccctttaagttgcgatgggaatccagaaaacgccatatggacccctctatgctgtgaaatacttcagtactcaggagaagtcacgttctggttgctgcaagcgtgtgataccctgtcattaaaataagaaatagattgttatcctctgc

SEQ ID NO: 216590 - DNA, 466 bp, Homo sapiens
ctttccttgcatttttttcccagccagttctcaataacctgaaacttattttgctgatgtttgtggttattctccaccaccaccccagtcctcattaacgtgacttttcagacattatcctggagcttacaggcatgttttcctgggcaggatcttgtattcatgtattgaaaaagcagatttctggccgggtgcagtggctcatgcctgtaatcccagcactttgggaggccgaggcgggcggatcatgaggtcaggagatcgagaccatcctggctaacacagtgaaaccctgtctctactaaaaatacaaaaattagccaggtgtggtggtgggcgcctgtagtcccagctacttggaggctgaggcacgagaatcgcttcaacccaggaagtggaggttgcagtagagccgagactgtgccactgccctccagcctgggtgacagagtgagaccctgtctcc

SEQ ID NO: 216591 - DNA, 659 bp, Homo sapiens
cccaaagtagtataagctgcatgatgttgaagaaattacattggctcgataggagagccattcatctggctttgctaccacttaactctggctctggtcaatcttttcatctttctagtcctggttttcttatccgagaaaaaaatctttaatctctaaggtcctgtccagctttagcacttaaggataccacatactcttggtaaagtgtcttcagaactgtgtaatagaagttgaaggagcgctataattggtgattaacattcagccccttgttacttatgcaacttcttcagcaggcttgaatttctccccagaaaatgggttattttctatcacatcatcagtctgcaaatttttcaaactttttttttttttttttttgagatggagtctttctctgtcgcccaggctggagtgcagtggcatgatcttggctcactgcaacctccaccgcctgggttcaagcaattctcctgtctcagcctcccgagtagttgggactacaggtgcacgctaccatgcctgactaatttttgtatttttagtagagacagagtttcaccatattggtcaggctggtcccaaactcctgacctcaggtggtccatccacctcagcctcccaaagtgctgggattacaggtgtgagccacgaca

SEQ ID NO: 216592 - DNA, 597 bp, Homo sapiens
cccaaagtagtataagctgcatgatgttgaagaaattacattggctcgataggagagccattcatctggctttgctaccacttaactctggctctggtcaatcttttcatctttctagtcctggttttcttatccgagaaaaaaatctttaatctctaaggtcctgtccagctttagcacttaaggataccacatactcttggtaaagtgtcttcagaactgtgtaatagaagttgaaggagcgctataattggtgattaacattcagccccttgttacttatgcaacttcttcagcaggcttgaatttctcccctttttttgagatggagtctttctctgtcgcccaggctggagtgcagtggcatgatcttggctcactgcaacctccaccgcctgggttcaagcaattctcctgtctcagcctcccgagtagttgggactacaggtgcacgctaccatgcctgactaatttttgtatttttagtagagacagagtttcaccatattggtcaggctggtcccaaactcctgacctcaggtggtccatccacctcagcctcccaaagtgctgggattacaggtgtgagccacgaca

SEQ ID NO: 216593 - DNA, 1073 bp, Homo sapiens
ggtatttaacttaatctgaactgatgagagatataccaaagtatttgggagggatgtttttaaagcttacctcttttcctgagatatattatcttttccaagctatcctatgtggagagccagtctcaaaatgaagtcaacccaaaattgaggggttagtgagaaactcttaatgacactgtctgtcccttcgggtccatccttggcctgaagccttctcatggcctttttgatgatgtgggccagtttatcttttggcccaggctcttttgagtcaggtatctatacttgtaacagaaaaagccctaactaataagctattagtcttcttgaataaatttttaatatgtaggagttacaaatacattaggctctgtcttattaatggacagtaaaaggacaataacttttgtgtgtgctcttggaagtagcagctccttgtggctttaaagaaattctgttaaatacgtaggattatgatactgttttgtggaaggctgaatttaagtcctaaggttacatgagaattcactgagaagcatatctttaaatgtctgcttttaatgaagatatagattaattattcacttgacaaacttgttggtattttatgggagaattcagtgcatatagaggcttcaaaaggcagattgtccactgacaggttaggattctcaagtgtaattttttattactttagagccgtaattattttgtgagagacagtatctttgaattaaaatgagaaatgtttttcaacttagagattcaactcatttcagggatgtgtttaatccaaaaatagagagttcattatgtagtggtgaaattaaaacatttattaaaagcagtctttgggtttaagtaggtagatctcaaaagtgtctttttccttcttattggttaactaagggacacaaatacacaaccttctctaggaaacacttctaccattcttactagtttatgttttaatttttcaattttattaaattagtacatcttgatacgttaattttcatattgtttcatttcattataataccttcattagttatatgggattttactat

SEQ ID NO: 216594 - DNA, 125 bp, Homo sapiens
taaagaaataagactcatctctcctttattctttcctgaccatgcctgcctttgtattcctgacagccttgaaaggacacagattatgtggtaaatataataatcaccccttctgtcgtcttctc

SEQ ID NO: 216595 - DNA, 412 bp, Homo sapiens
aacccacctaggaggaagtaagagctgtgattcatcctggccctcctggcacctcctctcctcctcctttaccccatatgctgtcaatcatctagttctcccagttttacctccctaatgtctcttgaaccactttgcctagcacaatgctgcctcttgaccagtctgaaattgctgtctgatggatctcttgctatctagtcttacccctcccatcagtcttccacaccatagccagaaaagataaacactttcattatgtaaaaatatagaaactttgtatggaagatattcatttagtaaattcaataggcaaaggctgtatttgaaaaaaaactataatacagataaaaatatataacatataaggagcctttaaactttgagaagaaaaaaacaaacaatctaatac

SEQ ID NO: 216596 - DNA, 854 bp, Homo sapiens
  misc_feature (49)..(49): n is a, c, g, or t
acatttctatgttttccacctttttcagttttcctcgccatatttcacntcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaaattccactttttcagctgtctttggaggacgtacgtcatacggttttaatttagtaaaccaaatcctatgcatgggtttcagcactaagccaaacctcaccaactcctagttctagaaaaacaggcacttgggcaagcctg

SEQ ID NO: 216597 - DNA, 468 bp, Homo sapiens
ggtgtgcacagctaagcatgcttcagctcgctggctgcatcttttccagtggggactcactgtgcgtcaggagcacacaaagaaagctgacatttggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatacgacgcggccgcgaatttagtagtagtaggcggccgc

SEQ ID NO: 216598 - DNA, 316 bp, Homo sapiens
gcgtcgacatggtctctatgtgtgtacgtgtgtatatctatggcggggatgtgcaattttctcgccatattccaggtccttcagtgtgcatttctcatttttcacgttttttagtgatttcgtcatttttcaagtcgtcaagtggatgtttctcattttccatgattttcagttttcttgccatattccacgtcctaaagggaagagagactgacaacctgctcttgcaaagcctgtattcccaggctacagtataccactgtatccttacacaggaagaccaacagagcccatagatatggatacttggtcgacg

SEQ ID NO: 216599 - DNA, 824 bp, Homo sapiens
taaatccgcggccgcgtcgaccaaagtgtgtatttctcattttccgtgattttcaggttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaaattccactttttcagctgtctttggaggacgtacgtcatacggttttaatttagtaaaccaaatcctatgcatgggtttcagcactaagccaaacctcaccaactcctagttctagaaaaacaggcacttgggcaagcctg

SEQ ID NO: 216600 - DNA, 697 bp, Homo sapiens
  misc_feature (49)..(49): n is a, c, g, or t
acatttctatgttttccacctttttcagttttcctcgccatatttcacntcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttcccgacgcggccgcgaatttagtagtagtaggcggccgc

SEQ ID NO: 216601 - DNA, 775 bp, Homo sapiens
ggtgtgcacagctaagcatgcttcagctcgctggctgcatcttttccagtggggactcactgtgcgtcaggagcacacaaagaaagctgacatttggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaaattccactttttcagctgtctttggaggacgtacgtcatacggttttaatttagtaaaccaaatcctatgcatgggtttcagcactaagccaaacctcaccaactcctagttctagaaaaacaggcacttgggcaagcctg

SEQ ID NO: 216602 - DNA, 807 bp, Homo sapiens
gcgtcgacgtttttatcattttccatgtttttcattgttactcattgatatacactgttctacaaatcccgtttccaacgaatgtgtttttcagtgtaactcactcatctgatatgttctacagtgtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaaattccactttttcagctgtctttggaggacgtacgtcatacggttttaatttagtaaaccaaatcctatgcatgggtttcagcactaagccaaacctcaccaactcctagttctagaaaaacaggcacttgggcaagcctg

SEQ ID NO: 216603 - DNA, 622 bp, Homo sapiens
  misc_feature (49)..(49): n is a, c, g, or t
acatttctatgttttccacctttttcagttttcctcgccatatttcacntcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgctctgtttcctaggccctaagggctaaggatgtctctactatgtttctttcgtcgacgc

SEQ ID NO: 216604 - DNA, 547 bp, Homo sapiens
  misc_feature (49)..(49): n is a, c, g, or t
acatttctatgttttccacctttttcagttttcctcgccatatttcacntcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatacgacgcggccgcgaatttagtagtagtaggcggccgc

SEQ ID NO: 216605 - DNA, 781 bp, Homo sapiens
  misc_feature (49)..(49): n is a, c, g, or t
acatttctatgttttccacctttttcagttttcctcgccatatttcacntcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagtttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaaattccactttttcagctgtctttggaggacgtacgtcatacggttttaatttagtaaaccaaatcctatgcatgggtttcagcactaagccaaacctcaccaactcctagttctagaaaaacaggcacttgggcaagcctg

SEQ ID NO: 216606 - DNA, 601 bp, Homo sapiens
taaatccgcggccgcgtcgaccaaagtgtgtatttctcattttccgtgattttcaggttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgtttttcattgtaactcattgatatacacagttctacaaatcccgtttcaaacgaatgtgtttttcagtgtaactcactcatctaatatgttctacagtgtggtttttatcattttccatgtttttcattgtaactcattgatatacactgttctacaaatcccgtttccaacgaatgtgttttacattgtaactcactcatctaatatgttctacagtgtggtcgacgcggccgcgaatttagtagtagtaggcggccgc

SEQ ID NO: 216607 - DNA, 713 bp, Homo sapiens
gcctactactactaaattcgcggccgcgtcgatggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaaattccactttttcagctgtctttggaggacgtacgtcatacggttttaatttagtaaaccaaatcctatgcatgggtttcagcactaagccaaacctcaccaactcctagttctagaaaaacaggcacttgggcaagcctg

SEQ ID NO: 216608 - DNA, 635 bp, Homo sapiens
  misc_feature (49)..(49): n is a, c, g, or t
acatttctatgttttccacctttttcagttttcctcgccatatttcacntcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcattcgacgcggccgcgaatttagtagtagtaggcggccgc

SEQ ID NO: 216609 - DNA, 600 bp, Homo sapiens
  misc_feature (49)..(49): n is a, c, g, or t
acatttctatgttttccacctttttcagttttcctcgccatatttcacntcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgcgacgcggccgcgaatttagtagtagtaggcggccgc

SEQ ID NO: 216610 - DNA, 668 bp, Homo sapiens
gcctactactactaaattcgcggccgcgtcgatgatttcgtcatttttcaagtcgtcaagtggatgtttctcattttccatgattttcagttttcttgccatattccacgtcctacagtggacatttctaaattttccacctttttcagttttcctcgccatatttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagtttcacgtcctaaagtgtgtatttctcattttccgtgattttcagttttctcgccatattccaggtccttcagtgtgcatttctcatttttcacgttttttagtgatttcgtcatttttcaagtcgtcaagtggatgtttctcattttccatgattttcagttttcttgccatattccacgtcctacagtggacatttctaaaattccactttttcagctgtctttggaggacgtacgtcatacggttttaatttagtaaaccaaatcctatgcatgggtttcagcactaagccaaacctcaccaactcctagttctagaaaaacaggcacttgggcaagcctg

SEQ ID NO: 216611 - DNA, 375 bp, Homo sapiens
agattgttagagcccaggagttcaaggctgtagtgagctgtaattgtgccactgcactccagccagggcaacggaatgggaccctgtctcaaaaaaaaaaaatccatctgtcaataaaattgaggtcattgtcaagtatacctgaagcatagctattggtgtgttgttgatagaggttaatgtattctggtgctgtgctgtctgatatggtagctactatccagatgtagttattcaacttttgaaatgtggctagtctgaattaaaacatgttgtaaatgtcaaccatcaaatttcaaagatgaatagaaatggtaacatctcttaattttttaatgattacattgaattaaaatgacaatattttagatatat

SEQ ID NO: 216612 - DNA, 766 bp, Homo sapiens
attgatagcacattgctagattgttctcccacagctgtgtacccatttacattagcactgacagtccatgacagactctgtctttccattgaccacaggggtgccatcaaacacttaaatatttgccaatctgcaagatggaaaaaaattacaaacttgttttaatttacattgttcaaatttttcgtgaggctgagaattttttcctgggtttattggatacttttgctataaacggcctgcaaatgcccttaacacattattctattaagttagtcttttactcccagtgatttatgaaagcttcttgaaaatgatctttgtcatgactattgcaaatgtatttctccatttatcccttgccttttgatgtctgtttgtaccagcacaagaatagatagattaaatcaacaaaacagaacagaaagtccataaataaaaccaaacgtgcatgaaagctttgttgggatagaggtaggaaactgattaaactgcctggattcaaatggaaaaactgcattcaataaattgtgagattcttaccatttgaaaaatcaagaaaaaatctgattcctttctccttactccaaaataaatttcatgtaaatcaaagatttaaacacacaaacaaacaaaaatgaaatcccaaaaattctagaatattttttgagtgagaaagaccttttaagtatgacatatgggaagacataaggaaaaaagattgataattttaaccatacacacaaaacagtttaaactttatggc

SEQ ID NO: 216613 - DNA, 504 bp, Homo sapiens
actagtgggagaatgtaagtagtcgagtgtggcctaagagtcaaagggaagaagaatggcagcagaagctaaagctggagaggtggaggggggccgtgcccggggagcccaggtgaggagcgggactgatcctctgtagacatgggaaggaatcctagaggtttttccctcttgttccattgttttcctgagttccaccaggaaagtggccttggtaattgccaaacaatttttttttattttttattttttttagagacatagtctcattctgttacccaccgctgaaaatagcaaatgttgacagagattgtgaagcaattgggcttttcatgtcctattggtagaaatgtaaattggtaaagccactttggaaaacaatctgtcagtatcttataaagctaaacatatccttatatgtaactcaacaattctgctatagatattttccagcagaagtgcaagcacacatgctccagaagacatggacaagagtgtccgcgt

SEQ ID NO: 216614 - DNA, 144 bp, Homo sapiens
acatcaccgttaagctgtttctctgaactgaacaaaagaaatttcatcatctttggggctgagggggagcagagttagcatctttttcagcagaattcaaaaacatttatttcagcttcagcatatactttaaaacttactatt

SEQ ID NO: 216615 - DNA, 106 bp, Homo sapiens
cctcctgcaacccctggcgcacagcctcaccccgctgtaaacagagctgggattgaagtgcgatttcggtttctttttctttttttctaatcaaataaaaacacct

SEQ ID NO: 216616 - DNA, 551 bp, Homo sapiens
ggccacctccagcagggctgtgtgagctgggggcctcatggccctcccagaaggagccactcactggagacacctgggccttctctctcaaatggttttccaacaggtaggggtgggcatttccctgcagaggcccgggcctgcacccgaaggaggtgaggtctccctgggtctccagggccctagacgtggatgaagtcctgccgtggctacgggggctcttttcttgtcatcctgctcctgggtctctacgtgatgctcctgcgtcactgttctgggctcctcttcggccctaccctcagtctccttcgggagcctggctgggacctgcttaggtggtgaaggcagcgggagggcgaacttgcggacgggaggagggtcctcagggaccctgggtgcagcaaccttcgggagttcccaacaggtggctcagaggccacagcctgcaggaactccagagggtcacccttgtcatgtgggagaggacaaggggtgccacacaagctgcctggagaggagggcctaggaggccgccgcgggttgaacaggaa

SEQ ID NO: 216617 - DNA, 373 bp, Homo sapiens
cattgtggcttgcacttgtaattccagcactttgggaggccaaggcgggaggatcacttgaacccaggagtttgagaccaatctgggcaacatagtgggactccaactctacaaaaattaatttcaaaaaaattagccaggggactaaagggactgaggtgggaggatggcttgaatccagaaggcggaggttgctgtgagccaagattgcaccactgcactccagcctgagtgacggagcaagactgtctcaaaaaaaaaaaaaaaaaaagaaaaaggtgcgatgatgcagatattctaaagcttccctagtcacaagtggccatcaagtactcaagatatacttgttcaagccctggcgctaaatttttga

SEQ ID NO: 216618 - DNA, 539 bp, Homo sapiens
aggtcagtacttcatccatcttattgctgaatatgccggtttatttatccattcaccagctgatagacatagaggctgtttccagtttggggtgattataaataaaattgttatgaacatgcatgtacaagtctttgtgtgctggacatgtcattgtttctcctgagtaaacatgtaggggtggaatggtgggtcacatggtgttaaatcatttcgctgattttactgagcagtcataatactgttttctgtagcggttgtaccattttacattcccacccacagtgcacaagagttccagtttctccacatcctagctaacacttgttatttatttatttttttaatagtagccctcctaatgggtgtgcagtggtatctcattgtgttttaaatttgcatgttcctaatgataagtggtgttgagcatcttcttcctcttctttttttttttcagttgagatggggtctcactctgtcgcccaggctggagtgcagtggcgcgatcttggctcactgcaacctccgcctcctgggtt

SEQ ID NO: 216619 - DNA, 160 bp, Homo sapiens
gacagagtgagactccatctcaaaaaaaaaaaaaaaaatagtatactgagtctctatggtgtagtttaacatgttcctctatcctctgtatttcctgtaagttggaattctgtaagttttatctagaacttggtcagattcaggtttgatgttttttctc

SEQ ID NO: 216620 - DNA, 507 bp, Homo sapiens
cgtctcactcactccctcccacgctcagacctgtgactttaacattactaaaaatttcaactccttcatgatctgtttcaaggcatccacttccttaaccatcccttcttttcctaggtttctccaggtggcaccttgatcctggactccaacagctttttacccctctagagtcctatcctctttcccctggaaacccttctctgcatgtttctgttttcctcctgaatcagcttgggttccatggttctcagtggaagcagtcctttgcatgttccctcagatctgttgcccattctcacttggctgtactcacggggcaaactcttttttaaatccctgaacctctagcacttccttccacagctccattctttttttggagagagagagtctcactctgtcacccaggctggagtgcagtggcatgatcttggctcactgcaacctctgcctcttgagttcaaacgattctcctgcctcagccacccccactgagtagctggg

SEQ ID NO: 216621 - DNA, 371 bp, Homo sapiens
ggacagtgtcagcattgcacttccctgggcaggagacttttcaggtggctaattccacaggaagatagtgtcaggtataggtgccggggcagcggccggactgtccccagacacagcgtgcgctcgggcagcaaggccgggcggcagaggcagcactggcctgggcgctgctcctggcggccccccagccaccagggccctacctcccccgctgcttaccccatcctggagctgggcacgcttggggcttcagaccttcacgtggccaccggagctgctgtctcaggacccctctccggcacagctgtttgtctccaatacaaggactgtcctgtgagtgtgcagggccctgttggccgtgctgggaaccc

SEQ ID NO: 216622 - DNA, 409 bp, Homo sapiens
cactagtttcttttaaatgcttatctattaagtttctcattagcatctcctatttatgattgtactacattttctctgggattttattgccatacaatagataccagtaatttaaagtgcctgccttccatgactgcacagttagtcaaacattgccgttttctagacaaattatttgttaacgtacattaatgttgccaactagattttatgagtaaacatttctttcattattttcttgcagttctacattagtgtgttttttagtgtaagttccttaatatgagtttattgttttttggttttacttatgtattataattttagacaatttgcaattctgtttgtatactttaagtcagtgtgggatttaattaaaagataaatgagccatatgtctatcacaatc

SEQ ID NO: 216623 - DNA, 586 bp, Homo sapiens
tggctgcaaagcactcattctcttttctggcaatagcacactgattttctttcagagaaccattctttcacctctctctgttcataaaattaacgtgaaactgttccctggctaaaagaattaacagataatttgggggtggagagctattcaggtcttcttatccacttcgccacagtaatgattccaggataagcacatgacccaagttggtccagtcagattaaattctgagacttttgctaaaattattaaaggaaaaattttttccctcttatgtagtttctaaactactaggaacaaccctaaaaaaaaaaggcccatctaagaataaaaccaaatagaggaaaacaaaaacaaagagctgaaagaggaagattgattcctgatgatacattttagcccctggatccagctatgcctgaaaccattactgccagtgaatttttcagtcatgacaatcaattgtctttttttgcttaagccagtttgagttgcatgcctttctataatgtaactgttttctgtcagttagagaatctaactgatacaacgaatgccaaagtgttagacaatgagctagatg

SEQ ID NO: 216624 - DNA, 368 bp, Homo sapiens
tggtcaagaaggctctttggagaagtttgaactgctctggacctggataggtgactaaaatttaagtaaagaggatgggaggttcaaagaaagggaacagttcagcaaagagactgtgacacacgtgttcgcaggcagtgaggagagatccagaaagacacaggttcaaacccaccatgtgtactgcctgggggacctgggtcagacaacgtaatctctccaagcctcagttcccccatctgtaaagtgggaataatactgtgaattgttggaaggattaaaaaacaagcaaataaaaataacccatgaaaatagcctggcagatagatcgagaccatcctggctaacacggtgaaaccccatctcta

SEQ ID NO: 216625 - DNA, 520 bp, Homo sapiens
gcaatgggttgcttcctgtccccacaaattgtacttttctgtctccttggaattgggagcaccacccaccagtcctctgttggaaccccagcttctttccttccaggtagacgaggactgagctctggataactggaataccggccaccccagaggtgcctggtcagccggacctctccacctccttggaggctagaaaatgggcagaaagccaggtttttccgccatcccaggcacccttttgctaggatatgagtgaatctttacagtccctgctttcgtggaccaatggccaagcagccttccccacttggccctgggtttggctggtacgccctgcagaacagctgcctgggactgtctctccctcttctgaggaggactgtatgcagggatccactactccatctgcccctcctttggccagaatgtcggtgggacctaggtcctcttcgcacaagacctgaagacctgcagacacacttacctctcagaggtccgtgggaggtatggttcctca

SEQ ID NO: 216626 - DNA, 529 bp, Homo sapiens
ctgataaattaaatgactcacccaggatcacacagtcagagccagctggcagcctacatcagaataccaatccaggccatagtccagtaacgttgaaccattggtttcttgtgggttatccttgatggctttgtaactttcacatcccaatttttactctgtaaaatataggtaataaacctgtatcatttgatgcatagaaacaaaaaaaatgaggctgggtgcaatggctcacgcctgtaatcccagcactttgggaggccgaggcgggcagatcacctgaggtcaggagtttgagatcagcctgaccaacatggagaaaccccatctctactaaaaatacaaaattatccaggcgtggtggcacatgcctgtaatcccagctgcttgggaggctgaggcaggagaatcgcttgaacccaggaggagaaggatgccatgagccgagatcgcaccattgcactccaccctgggcaacaagagtgaaactccatctcaaaaaaacaaacaaacaaaaaatgatgatcac

SEQ ID NO: 216627 - DNA, 798 bp, Homo sapiens
ccgcatcaaccatgtaagcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattagacacaagaaggaaagcagaacctacctttggaggtcatgaccctcgtacagctgttcagcttcgaagcctcagcacagtattaaaacgcctcaaggaaatcatggaggggaaaagccaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatga

SEQ ID NO: 216628 - DNA, 679 bp, Homo sapiens
ccgcatcaaccatgtaagcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatga

SEQ ID NO: 216629 - DNA, 715 bp, Homo sapiens
ccgcatcaaccatgtaagcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattagacacaagaaggaaagcagaacctacctttggaggtcatgaccctcgtacagctgttcagcttcgaagcctcagcacagtattaaaacgcctcaaggaaatcatggaggggaaaagccaggatagtgacctgaaacaatactggatgccagatagccaatgtaaagagtgctatgactgtagtgagaaatttacaacctttaggcgcagacaccattgccgactatgtgg

SEQ ID NO: 216630 - DNA, 421 bp, Homo sapiens
gccaccttggccccctctaaactttgtacactgacaagcatgggagaggggctgagggggagccaagggtgacttggcaggggtctgcaagtgcccctcagcaggaacagcttgggtcccgtggatgacattattgatggtggcagaaggcaggctcctgggtggaaaggtgcaggtccagtgaagtaccacctttaagccagggacagcctgaagcctgggtgccggactgtcacttctgggtggagtccatcgcccagaatgagaactcatgatgcttattctgggccatccatggcccaatcagcatgcacttcctcccttctgaagcccatgaaaaccttggactcagccactcacagagacattgaatcgacctgcatgtggaaaggagctactcactgccagtctcctgagggct

SEQ ID NO: 216631 - DNA, 456 bp, Homo sapiens
atagtggttcctgtccctaggcagcttgctatctagaagaggagatagcatttataaaataacttattgaagtgatttagtgattgttcaggagatgggaagaacattcaaggaatatatttaagagacttgtgtttttttcttaacacatggttggtctttgttccctattcttccccttttctttgggtaagaaatttaccattttaagtctaaaagagaaatgagtgtcctcttgcttggcattaaatttggtttactagtaaaataaatgaagaaactcagtacaaatggtctccagagtgtaagtgatgagcatttctgacgaatagaagttagttttttggattttgatagaaataatgttgtatatggacttaggaggctaagacaacaggatggcttgggattaggagttcaagaccagcctgggcaacatagtgagatcctttctgt

SEQ ID NO: 216632 - DNA, 386 bp, Homo sapiens
atgggctcatacttatttctcatttttatgagaaatggagaaaagtcatgcaaataatggttcaagatcagtagtaatttataaaagataattattcagtaggcttagcacggtgcctcacgcttgtaatcccaggactttgagaggctgaggtaggcggatcacctgacgtcaggagttcgagaccagcctggccaacatggtgaaaccccatctctactaaaaatacaaaaattagccaggcatggtggtgtgtgccttttaatctcagctacttgggaggctgaggcaggagaatctcttgaacccaggaggcaaaggttgcagtgagctgagttcacactccactggactccagcctgggtgacaaagtgagactccatctc

SEQ ID NO: 216633 - DNA, 471 bp, Homo sapiens
ctcagaagctacataccaggattcgcaaaggggacaaatccatggataactgtggacttcaaaataaggagccctgggggaacaatgcagtctgaggttgagctgcaaaaactcagccctcaaggcctttgggggtcctgccagtcccctcagaggggcccacagtggactctacttggcaaacttgccagtccagggacatggaagcagagagcgggggcatggagtcccccacctggagacagactctggcctgggcccactcaatggcccaactaggccaaaggagcgcaggcaacaggaaggggacaggcaccagtgcggctgagcaccaccacgcagcaggcccgggccagggagcatgtcctgccttggccacctctctgaggacttgggggtttctctgaaaagttaccagcctctaatgtttaactgtagttctcctctttcatgggaaagtgtagatcagac

SEQ ID NO: 216634 - DNA, 697 bp, Homo sapiens
caggaggatcacttgaggcccggagttggagacgagcctgagcaacaaagtgaaaactctatctccaccaaacataaaaaataaaattagccaggtgcggtggcttgccctttagtccccagctattggcaaaatgaggtagaaagatagtttgatcccaggagtgccaggctacagtgagctacaatagcgccactgcactccagcctaggcaagagtgaaaccttgagttttttttcttgtttttgtggggggacagagtctcgctctgtcgcccaggctgtagtgcaatggtgtgatctcagctcactgtaacctccacctcctgggttcaagcgattcttctgcctcagcctccagagtagctgggattacaggtgcccgccactatgcccagctaatttttgtatttttagtagagacagagtttcaccaggttggccaggctcgtctcaaattcctgacctcaggtgatcctcccgcctcagtcttcctgctgcaattcctccctcccccactctcctactccttatgtttcctcatcttccctacctctctcctactatcccaatcgccctccgcacattcatacacgaccccctcatcccccatcctccactctctcacttcccctcccatcctcctcctccattcatctcttcttccttccactcactttccctacactcctctcccc

SEQ ID NO: 216635 - DNA, 500 bp, Homo sapiens
ataaataaggcaagataggattagggaaagagatggtcagctctgaagccactaggagaaatacttctttgactgatggagaaaaatgaagaaaaaatgaacagcaagaaagaactgggacataattgcagctcatgccatttgtctttgtcctctaacctcacctgaaaccccagtaactatatcaatcacacaaataggcactctgtacttggagttggactttttttttctacattgcttattacattatacaaattccatatacaactcattgaaatggttagttctttaagcttgattatgtcaattcccagtgaccaacctatgagcaaatccattccatcttatcccacacttccaaacctacctaatttatcctatcttcttcctggctttttgtcttttctgcttttcttacttttcttgaatcattaaaaatgtttgcacacttgttatgtgtcagttcttcatctcaaagaattatagtaggagagata

SEQ ID NO: 216636 - DNA, 391 bp, Homo sapiens
tcggaccgtcttcatcatacctaccctacctataccgtatcttggctccagaggctgcctactgtatcattccattccatcctggattctcctatagggagccaagtacacatgatagccccacaggtcttggtcacaatacctatcatctgggggccaatcaaggaaaactgtcaacatgaatatatgaagctcttatcaatgaataataccaattcctggctagatcgggattacatttgcctgcatacaacttgggaattcaaaataacaatgatttatacacacagtttatttctctcatgtaaaagaagcttacacagggacattatcttagttcatggcttctatcttcaaggtcacttggcattggtaggtatgatgaaggacg

SEQ ID NO: 216637 - DNA, 331 bp, Homo sapiens
tgcctggcattttgctagattttagggctacatcagtgagcaaaacaaacatgatccctgcccataatgttgtttatagtctggaggagagagagccattaaaagacaatttcacgtggctcacgcctgtaatcccaacactttggaaggccgaggtgggcagatcacgaggtcaggagatggagaccatcctagagaacacggtgaaaccctgtctctactaaaaatacaaagaaattagctgggcttggtagcaggcacctgtagtccccgctacttgggaggctgaggcaggagaatggcatgaacccaggaggcggagcttgcagtg

SEQ ID NO: 216638 - DNA, 169 bp, Homo sapiens
gccagcccagacttcgattctagagcacacccctgaatcctgttctcacctcagttaactagcttctcattacctgggtgctgatgggctttaggatcaactcccataaatggagttataattccattattagggaaaaatctgtttgaagtgttcaagagaagccata

SEQ ID NO: 216639 - DNA, 392 bp, Homo sapiens
cacccccaactcaaaccttgacattgaggcaggacaggggatacttcaataagctggtattgagaccttggggtttggaaacagagtggatgccacccaaatctagaatccaggagcctgaccaaggagctgcttttgcagaggagggtaacacgcaggttaaagagctcaccacatttcctacagagactggtggctgccttaaaagagtgcacttcagagcctgaatgcctaggtctgaaactctgacacttaacagctgtcggtattgagaaagttgtttagcctctctgggactcagtttcctcatatgtaaaacagagataataaaagtacctacctcataaaatcgttgtgagaattaaatgggccaatatatgtaaaatggtacc

SEQ ID NO: 216640 - DNA, 443 bp, Homo sapiens
gtcataagggtttcttctactctagcacaggagaggcaacagaggtggagagtaataggatgggatcaaaactacagatttgggttagcgttaagtcagtgatatccatatccctctactggggccatgtccttttctttattttttataatgaagcattgattagatgttctttagtctccaactcatggcggatttttcttcttgtatgtttatgtagtataaattccttatatttattctcttagaattttatctttgcgaagtgcttgtttaactctgcctttttttttggcgaggtggttgtgtgtctttatttttatgtgtaggagaccatatttataccaataccttaggatataagacaaacccacttaatatagaggcttaatgcaaaagcatttattgagctcaaggttccatggttagaaaattagcctggg

SEQ ID NO: 216641 - DNA, 445 bp, Homo sapiens
ttggggtttttttggtaatacttattggtaatacttagtacctatttgatttaagccattctgtgggagtattactgtatacattatatatctggtttttcttcaagtacattgaaaaatcatcatcatttgaaatctagtcactgatggagttgtttaggaggtaattagtaaaatatacctgaccagtaaatactatgacttagtttccttgctaaccttacttagtagactccttttcttttctcctttcctttccttttccctttcctttccttttccttttcctttactttttctcttctcttctcactcttttcttttctttttccttttctttcttttttttgagacagggtctcgctccgtcacccaggctggagtccagtgagctgagattgtgccactgcactccagcttgggcaacagagcgagactgtctctc

SEQ ID NO: 216642 - DNA, 424 bp, Homo sapiens
agtatctaaaggttctttctccacgtcctcagcaacagttgctatcttttgacttttcgataagtcatcctaacaggtatgaagtgatattgcagtctggttttgagttgtatttccctgatgaacagtgatattgagcaccttttcatataccttttggccgttggtatgtcttctttggaaaaattatctgtttggatccttttctcattttttaaattgggttgctattgagttgtatgggttccttatacatttttgatattaatcccttattggatatatggtttgcaaattttatctctcatttcttaggttgcctttttattttgttgagtttcctttgctgtgcaataactttttactttgatgtagtcccagttgtttacttttgtttgtgttgtctgtgcttttggtgtcatat

SEQ ID NO: 216643 - DNA, 464 bp, Homo sapiens
actttgggaggctgacacgggtggatcacctgaggtcaggagttcaagaccagcccgaccaactaaatacaaaaaattagctagatgtggtggcatgtaatcccagctcctctggaggccaaggcaggagaatcgcttgaatccagaaggcagaggttgcactgagccgagattgtgccactgcactccagcctgggcaataagagtgaaactctgtctcaaaaaaaaaaaaaacaaaaagttaacaaaacgggcttctctagttctaaagcaccaacacagaggtgatcaaaatactctaagaagcactgggaaacattgaggggatggttcaaacatcagagctaaggcctaatttcccaacagtcattatttctgtggtattcggcatattagagacgtataggttcctcacctaatccttgttttgtcattttatttttaatacatatgaaagtcataat

SEQ ID NO: 216644 - DNA, 491 bp, Homo sapiens
catttcctcctgggaaatgactctcccacaacatacccaggccgggtgtgagaagagggcttcccctccctggctaagcaagggggatgctcctctgcaactgaatctggaaccggctgaccccaaagttcctgtgtccctgggacccacctcttcctgcatggtgtggtcagcaattcctccatcaagcccccgacaaccctccagacaccctggtctgcaggggcaagtggaggccagagaacgctccgacacaggtcatgacccaattcacagcaagaaacagaaccccaacctcacatcaccccaacagcactccttttgctctgcaatccccaggtgacgtaggtctgtccaccagggagtgggcacacagggtggccacgacgctgctcggacaccgcagtcatgtccctctcagtggcctccaacactccactggctgggtgctccctggaccccgacccataacaagtgtccctgtgatgtag

SEQ ID NO: 216645 - DNA, 369 bp, Homo sapiens
agaaaagagtataacagttgcacaaagcatagagaagatgcttgctctgtattgtaagttacagggcaagaacacaagcactgttcaaactccccctgataagtttcttacaaagaaataaaacgtgtagaaggaaagagaaaaagaaagttagttcttagtgttcctaatgtaattacagtgtactcataagtacaatatatttattttactattttttaatttccctatgtagtaaaggtttttaatgttttggcaaaattttttaaaactcgtaagacgataataatttttcctattgattattaagattgttttgcgtggtttcagcttgcacagtcatttttccaatcccattttaccatagaa

SEQ ID NO: 216646 - DNA, 381 bp, Homo sapiens
agctcattcctgtaatcccagcactttgggaggccgaggcagaaggattgcttgaggtcaggagtttgagaccagcctgagcaatatagtgagaccccatctctaagaaaaaaatagaacaattagcctgccatggtggcacatgcctgtagctattttgggggctgaggtgggggaagatcccttgaacccaggagacagaggttgctgtgaacggtggaggttgctatgaacggtggagcgccactgcactccagcctgggtgacagagcaagacttcatctcaaaaaacaaaaagtaaaatgtgaagcacagccaaaacatgttttctaagacctgcaggctttagatagttctggtcacctgatctggcccctcccc

SEQ ID NO: 216647 - DNA, 561 bp, Homo sapiens
agctctccaagccctgttattttggatttttatggaggctttattacataggcacagttgaccaaaccattagtcattggtgatcaacttaaccttcagcccctctctcctccctggaggttggaggtggggctaagagtcccaaccttctaatcacaccttggtctttccagtaaagagctgtcattctgaattacctgggggctgccagccatcagtcaaccattagcttacaagaagacatcactgtggagtctttaaggattgtaggagttgtatgctagaaaacagggtcaaagaccaaatatatatttcacaatatcacagaaggtataggccttggagagtcctagccatatgtgaaagtatcagacctgtctctttactctttttaacacaaaatttcttcccttgttgcagtctccattaaaactcagaattgaccaggtgtgatggttcatgcctgtaatcctaacatcttgggaggccgagacaggagaatcgctcaagtccaggagtttgagaccagcctgcacaacataggaagaccctgtctctata

SEQ ID NO: 216648 - DNA, 271 bp, Homo sapiens
gagacagtcttgctctgttgcctaggctggagtgcactggtgcaatctcggaagaaaagaaaagaaagaaaaaaagaaaaaggaaaaggaaaaaaggaattcaaatcagataatgtctcctctccttaacagtctccaatgatttcctattaaactctgaataaaagccaaatagatggaacagaatgtgtaaatgcacgaaggtgtgctactgtaagcggacaggtatggctgcagtatggggtgtacatggtgggtgcagagaagatga

SEQ ID NO: 216649 - DNA, 599 bp, Homo sapiens
atgtaatatgcttttgtcatagtaataataaggggattatgccccagcatgaagcacattttaatttcgtatttgttcagagaaaagatctaatggtttcatatcccttcataggatgtagtctctcggtctatcttaatagagaattgtctttcattatggaagtagcaacagaaccagaatcatacatttgatgcatgtaggcatggttggcctttggcctggacacaaaacatactttgatacatggtgtaataagctacagaagcttctgatctaatctgccattcatctttctctatgttcatgtgagataaaatcaggatacagatgtaggcttttggaagctgtgttggtcttactaagtacccctcgggaatagaaggccctgacctgtgtcttcacactgcctctcttgttcattactcagttcttcttctggaggtgccctgctcagaggacctgggctttcaagggacattgtttagggttggccaaagaggctgaaaagggatttttccagttcacctatgcataattcgtgcttcaaggccagaaaagctgagagtacctcacctcccaccccattctctcctttg

SEQ ID NO: 216650 - DNA, 467 bp, Homo sapiens
ttgacaaagccattcatgaaaaccttgtagccaggatggccatttgtagactggatgggtgatatttcaggtttctgggtatgtaacacatgcatacctggtacccgacagtgcttgattgagggatccctgttgtccttagtgtgtggtgagggacctgttctagccaatattttttatgagtaacttgaacaaagaaatttgcttgttatatttgcaaattgtgcaaaatagttagtattaattatatgaaaaatacatatttaagaattgcataatattctattgcagtattaattttaaaaacacaatttcaatgtatttgcatttgtccatccattaatttatcaaatatgtatgacacctcatattcaatgtcttatattagttactgaatgagtagaaggctagcaaaagttgtaatagaggggcaagtttgcaataaataatttagtaagatgttaaaa

SEQ ID NO: 216651 - DNA, 353 bp, Homo sapiens
gtcaacgggacggtgggctgggattcacatctgccctccctcctgccagactttttttttccacacaccaccacctccccttcaaaaccgatagtgctagtaatagtaacacaactgtcaggtattcaatacaaataatttttttgtataatcccagttgattgcttcagcagtaaataggggagaattgtgctgatcctgaaatgtcagagtcgaaagaagctgtaaaggccttcccctgcgaacctgttgcttcaatcttttcagctgtattccaggtcggttgtgttgtaactcatgcttgagtgcctccttgtcactagggaagagcgaaaaactaacatttactgatc

SEQ ID NO: 216652 - DNA, 107 bp, Homo sapiens
cctgggcaatgaagtgagaccctgtctctatttaattagtaaaattaacaccacccatgtactgtctgcaggaggcaggtgggctgtgctataactgatagcaccca

SEQ ID NO: 216653 - DNA, 449 bp, Homo sapiens
ctataaataaggaaattgatttgtcatttctagttcactttaatggtaatttaactctctaatttacacattgcatacaattgatatttattgaattcctctttggacagcctaacaatgtacagacactgggaagaaattagaggaatagtctctatcttcactaagcatatgaggtgggacactttttattgcttactttggctaggcatccatttacatactaattcatttaattctcacaacaaccctatgaggcaggtactgttagtgcccctattcatttagcgtggaagcaattgaagcacagaggcactacatgacttgtcctggatcatatagttagtaagttatggaactgcgattcaaacccaggcagtctgcttcaagaacctgtgctcctgatcactactctgtactgcctcttgttccagaacagtattaagaaa

SEQ ID NO: 216654 - DNA, 717 bp, Homo sapiens
tttatgcgaacttgagccttcaagcctccaggtggcagtgttgctccacttgagagtttctgatactacctccctaacaagcactgtgtaaagccatctccgagactcgcagaacagaattttggttaagtctgaacctgacgtttctgagatttttgacactgaaaatgttttattgctggttgcttctcctaccacaacctcaaaggaaacatggctactactgaaaggaagaaaatttttgaatagttaaaatggaatttatagccattcaaagaagtacattaggagttagcattttaaaatttctgtggccttttagaaaggttggaatgttgtaaaacaattaataataggttttcataatcaaaggtgatgagaggcaaggaaagaatcatttctgtgccccatctcatccacagcagcaatggattttgactagtataggagggaatgaaaggaggctatattaaaagtatgctctattttaaagttttccatgggggaggaaaagtttacaattagtacaagccactgaacctggtcattcaatgtcttttcaataaaggggagttcacagggtagtaaaagtatgagtttaaaaagcaaaagtccaaattcaggtaaaaacatcctcaaaagttggttagattgaaaagaatcaatatgagttttactttgcagcgtatttcaattgagacttacttcaagtaggga

SEQ ID NO: 216655 - DNA, 785 bp, Homo sapiens
tttatgcgaacttgagccttcaagcctccaggtggcagtgttgctccacttgagagtttctgatactacctccctaacaagcactgtgtaaagccatctccgagactcgcagaacagaattttggttaagtctgaacctgacgttctctcgacgatcttcttgaacacgtggaacaactgtctcttatttcgcatgcgttggctctcttccatagcaacaaagccttccaaaagggaacacaattggcttactatactgtgcaagagcgagaagaaaactcttcgagcaattcagcttcaacaaggggcaactattagtacgcacagttcaaacagcaacagctaccacttcaggcagcttagcattttaaaatttctgtggccttttagaaaggttggaatgttgtaaaacaattaataataggttttcataatcaaaggtgatgagaggcaaggaaagaatcatttctgtgccccatctcatccacagcagcaatggattttgactagtataggagggaatgaaaggaggctatattaaaagtatgctctattttaaagttttccatgggggaggaaaagtttacaattagtacaagccactgaacctggtcattcaatgtcttttcaataaaggggagttcacagggtagtaaaagtatgagtttaaaaagcaaaagtccaaattcaggtaaaaacatcctcaaaagttggttagattgaaaagaatcaatatgagttttactttgcagcgtatttcaattgagacttacttcaagtaggga

SEQ ID NO: 216656 - DNA, 313 bp, Homo sapiens
gagttccgggggtggtgagggtgtgaaagccaggtcagtcagtaggaagacaggatgtcagattgagagactcccctggccggggaaacagacttggagaagggggagttttggatgagacagtccacttccgagtcacaaaatagcttgtgggtgtctgtttactgttactcagtgggagtggctggggacacgccacctgggcagggctttcgtaattctgcatcacttgtgaaggtcacagattcccagcacaacggacacacccatgttcatagtctgaactcctaaacacatcttaaaccaaaataaa

SEQ ID NO: 216657 - DNA, 742 bp, Homo sapiens
gaaggggagcatttcctcctgatcaggctgaggtttctctccccagaagttccagccctcgagttttcaagaatcagagctagaattccattagttagggtcaagagaacaacagcaacaaaaagcagtctggaagtctcaaaactttccatgtatataattcaacgaatttttagtttatttaccaagttgtccaaccattgccacaatctaactttagaacattttcatcaccctaaagggtatggaatattttgtatctaaaattcctctttgctgctccttgggaaagttttctcctggatttgaatctgcatgagaaaccttatcagtcttggctgggtgcagtggctccctcctgtaatcccagcactggagcttgcagtgagccaagatcatgccactacactccagcctgggtgacagagtgagactccgtctcaaaaaaaaaaaaaaaaaaaaaattagccgggcatagtggcacacgcctgtagtcccagctactcaggaggctgaggcagcagtattgcctgaatttgggaggtggagtttgcagtgagctgagattgcgtcattgcactccagcctgggcaacaagagtgaaactccatctcaaaaaaagaaaaaaaagaaactttatctcttgttcttcaaatttccttttccagtaagcttgatcatttaatatccagatgacaaccgtgtggtctccagcattagtataattctttctttggcctta

SEQ ID NO: 216658 - DNA, 414 bp, Homo sapiens
acccgggacaggcagtgatggagcagggacttagtttgccttttagttcttgtatgaaaagaagttttgaggtgaatgtgattcacgctaacagtcggaaactctgggcggggcgcggtagctcacacttgtgatccctgcgctttgggaagcggaggcggccggagctcttgagcccagcagtgcggaccagcctgggcagcgtggaccagcctgggcagcgtggaccagcttgggcagcgtggctagaccccatccctacaaaaattacaaaaagtagtccggcgtggtgggctcctgtgggcccatctactccgtgggctgaggcgggaggatggcctgagcccgggaggtcgaggccgcagggagtcgagatcactgccctccagcccggtggatagcgagacaatgaaa

SEQ ID NO: 216659 - DNA, 595 bp, Homo sapiens
tgtccccatgatatctttgttttaaagggagattaaaaagagttggagagatgttaaaggcttgttaacaccaaatggagactcattttgacttagctctgaaagagagtgggaaaggcagtacagttcactctctgggactcaatgtcacaatgttacccaatgcctctccatgcatggcctaaacccttggtattcatcccacaagttgcaaatattgcacaaaggatccctaggtttctctcctagatctgaggtcttgcagcaagcacatggtttaacatctggatctaacacggtgaggaagcaagcaggcaagagaaccctcccagtgtccaggatttcattcaataccctcaacaatgctgagagatggggactattcctatttgaccaaaaaggaatgtagagctcagcaagacagtgacttacccaaaatgacacaataggcccatcccaggactcatggatccaatcaccatcctctgctcttcccaccccactttactgatttccatggggcaagcaacaggagaggcaaagccagaggatatgaagaacgacagggaccctaagcaaaaaggctgctctgtgg

SEQ ID NO: 216660 - DNA, 299 bp, Homo sapiens
ctgtatttggctttttcaatatttgttaaaaagatcccatcaaggaaacaatgacatgaatggaaaagaaaccactctcccaaatctgacttgatctcttcttagctttcagtggaggttttcttgtacttggaaatgacccttttacacagaaatgctttattaagaattaagaagtaaggccgggtgcagtggctcacacaggtaatcccagcactttgggagactgagactggcagattacttgaggccaggagtttgagaccaacctaggcaacatagccagaccctttctctaa

SEQ ID NO: 216661 - DNA, 516 bp, Homo sapiens
tgagacggagtctttctccgtcgtcaggctagagtgcagtggcgtgatctcggctcactgcaacctccccctcccgggttcaagcgattctgtcgcctcagcctcctgagtagctgggattacagatgcctgccactacgcaataaggaccagttttttaaattcatcttataaacacggtcactctgtttttgaaagttttacgtcatttggctttcaggagcccacatcctggcttgccttctgtctcattagtcactcctcagtctcctgtgtggaattgtttgaaaccattttcctaggtgatcatatttagttttatgtttatgtttgctggttttttttttttctttttttgagacggagtctcactctgtcaccagggtggagtgcagtggtgcggtctcggctcactgcaacctctgcctcccgggttcaagtcattctcctgcctcagcttcccgagtagggggactacaggcatgtgccaccatgcccagataatttttgtatttt

SEQ ID NO: 216662 - DNA, 528 bp, Homo sapiens
gattccaagctaatctttaacctgaagtgtcttaatcatacttaataaatccttagatgcagtggaaagaacctcgctggcatttcgatgccacactcaatacaggggcatttgaaaggatagaagagctttatttcataggatttcactcgattgaacttgtcaagaaaattcagaagatgttagcttaatctacaagtaataaatccatagtggaccgttgatgcaatgaaggtcgtccatgtgcattccttgagttgcaggaaaatgctcttgatacaatttttcctgctttctctaaaaacatgcattggaatgaatgtgagaggtaatgctggactgaacactggccgaagtcattatgaggtagtctctattacagctttagaaatgattgcgcctatgaagcacagccattactggactttacattttaagatatgagcacagtctgggcacggtggctcatgcctgtaatttcagcactttgggaggccaaggtgagaactgcttgaggccaggagttag

SEQ ID NO: 216663 - DNA, 550 bp, Homo sapiens
gatacatacatcgtatacatgtatctgtgtgtaaacatgtatctgtgttaccatatcctggggttcctttcccagcttgtagccaatagccaaaagttcagaattctgccttctgcggaccctattatcaatttagaagctacttacctaagtaaatccatttacattacagcatctatttttaaaatgtagtaaaattgctgtgtaacacaaaggcttcttggagaatgaaacttcaaaaccagatttgaatcataaaaaatacttcttcacggtggctcacacctgtaatcccagcactttgggaggcagaggcagatggatcacgaggtcaggagttcaagaccagcgtgggcaagatggtgaaaccctgtctgtactaaaaatacaaaaatcagccaggtgcggtgatgggcacctgtaatcccagctactcgggaggctgaggcaggagaatcacttgaacccagcgtggggaggggtggaggttgcagtgagccgagatcgtgccaccacactccagcctgggcgacagagtgagactctgtct

SEQ ID NO: 216664 - DNA, 889 bp, Homo sapiens
  misc_feature (193)..(193): n is a, c, g, or t
  misc_feature (197)..(198): n is a, c, g, or t
  misc_feature (200)..(201): n is a, c, g, or t
  misc_feature (203)..(203): n is a, c, g, or t
  misc_feature (208)..(208): n is a, c, g, or t
  misc_feature (213)..(213): n is a, c, g, or t
  misc_feature (215)..(216): n is a, c, g, or t
catgtcccggtagcagaagcagcagcagcagcagcagccctcggccgttcgcggtagacgcatgacggagccggccatggcgattgtcgatgccgctgaagtgggctgaaggaggaggacaaagagcccctcatcgagctcttcgtcaaggctggcagtgatggtgacaagcataggaaactgccccttttcncagnngnncntcatnttctntnnctcaaggagttgtatttagtgtgacgactgttgacctgaaaaggaagccagcagacctgcagaacttggctcccgggacccacccaccatttataactttcaacagtgaagtcaaaacggatgtaaataagattgaggaatttcttgaagaagtcttatgccctcccaagtacttaaagctttcaccaaaacacccagaatcaaatactgctggaatggacatctttgccaaattctctgcatatatcaagaattcaaggccagaggctaatgaagcactggagaggggtctcctgaaaaccctgcagaaactggatgaatatctgaattctcctctccctgatgaaattgatgaaaatagtatggaggacataaagttttctacacgtaaatttctggatggcaatgaaatgacattagctgattgcaacctgctgcccaaactgcatattgtcaaggtggtggccaaaaaatatcgcaactttgatattccaaaagaaatgactggcatctggagatacctaactaatgcatacagtagggacgagttcaccaatacctgtcccagtgataaggaggttgaaatagcatatagtgatgtagccaaaagactcaccaagtaaaatcgcgtttctaaaagagatgtgttcatgtcttgctctaagaatttgct

SEQ ID NO: 216665 - DNA, 804 bp, Homo sapiens
ccttagtcttcctagggatgggatgccttccttggaaagagcttctggttctgcttgaacttttaggtggtcagtgtagcatagatggtagtgagtttatgttgactgtgaacttttgtttcaaagcacacctgggcagagacaggtgggttgatgccgagaaggctgagagggaggaagtgtgagccaagggaagagatgaacgtgtgtctgagaagggggggaccagggcagcccggcaagaagaggccgtcactggcagccgctctgtcactgctggggaaagaatgcccagggcgctctggcaatggagtttcactcttgctgcccaggctggagtacaatggcatgatcttggctcaccgcaacctcctcccggattcaagcaattctcctgactcagcctcctgagtagctggattacaggcatgtgccaccacgcccggctaattttgtatttttagtagagatggggtttctccatggtggtcaggctggtcttgaactcccaacctcaggtgatctgcctggctcagcctcccagagtattgggattacaggtgtgagccaccgcaccaggccacagtatgcgtatgtttaactttttaagaaattgtccaaatgttttcctaagtgtttggtggttgtaccatttaagttctcattagctgtgtatgaaaattccagttcctccacatccctgccagcacttcgtatagtcagtcttttttattttagctattctaatagttagtggaatgagagatcttgtatccatttttttaggctgctttcttcttatta

SEQ ID NO: 216666 - DNA, 374 bp, Homo sapiens
aatgttgcctttatgctaatttttatatttcttgcttttgaaaacatttaaggctgggcatggtggctcatgcctctaatcctagcactttcagaggccaaggtgggaggatcgcttcaggctaggagttcaagaccagcctgggcaaaaaagtgagaccctatctctattaaaaactgaaaaattagccaggcttggtggcgcatgcctgtggtctcagctactcacaaggctgagacaagagtatagcttgaactcaggagttagaggttacggtgagctgattgtgccaccgcactccagcctgggtgacagagtgagactctgcctttaaaaaagaaagttaaaaaccatttaagatatttctgagctca

SEQ ID NO: 216667 - DNA, 1004 bp, Homo sapiens
  misc_feature (968)..(968): n is a, c, g, or t
  misc_feature (970)..(970): n is a, c, g, or t
aacaaactggttgctgaagccatggtttccctgggaaggtggacccacctgtgcggcacctggaattcagaggaagggctcacatccttgtgggtaaatggtgaactggcggctaccactgttgagatggccacaggtcacattgttcctgagggaggaatcctgcagattggccaagaaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaagagagagttgagaccaatctttatttgtactggccaaatactgaataaacagttgaaggaaagacattggaaaaagcttttgaggataatgttactagactttatgccatggtgctttcagtttaatgctgtgtctctgtcagataaactctcaaataattaaaaaggactgtattgttgaacagagggacaattgttttacttttctttggttaattttgttttggccagagatgaattttacattggaagaataacaaaataagatttgttgtccattgttcattgttattggtatgtaccttattacaaaaaaaatgatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctntnctgtaaataaaatattttataaaactaaaaaaaa

SEQ ID NO: 216668 - DNA, 423 bp, Homo sapiens
aatccctagacagttaatgccagagtgtttgaaccaattaaaccaccaagatgagcagagacaacattgattaatgttctacttggaaatcaagttttatatttaggtctgtggaaaaagaaaatgaggcagactgctttcctcaacaaaacccttattttgaagtaactttggtcttagagtagacaagtgaaggtgggaggaacagttcctctctttctccactacaatccaatttttccatagaaaaatatgaaacaggctgggcgcggtggctcatgcctgtaatcccaacactttgggaggctggggtcgggggggggcgcggatcacgtgaggccagaagttcaagaacagcctggccaaagtggtgaaaccccgtgtctaatacaaatacaaaaaaattagccaggcgtggtggtg

SEQ ID NO: 216669 - DNA, 999 bp, Homo sapiens
aaagcacagggtcacaggaagactgacgggcaaagacacagttacagacctatgaacagagccacacgccaaacagggacaaaccgttgagcagttgggaagatgtggcaaaacaggacttatattccttatggcaacgatgggctgagctgagtgtctgcagcctgctttaggcagggcacggctgtgcagtctgtcatcgtccctcgtcactcccatcaatgctggcaccaacctcacttctatttatcgcctcatctgatcggctgtttcttatagcagaaacgtctgcaaggcatgtgaatttgtaaccatcaccctcctcacagggttgctgtgaggatccggtggactgatgcatgcaaagccccgagcacagtgcctggtacacggcaaaagctgaatacttctggccagccctaggaatatttccttgggagcagagggctcttctggaagcttctggaagatgaatggcatcttcgcacacctgctccgaacaggcattgtttgggactcagcgccctctggtggctgctctccccactcacacttagcctcttccttggttggggggacactttgaggcctcattcctgcccctccccttcctttcacatggaggaaagttctagaatggggtgggagaaaactttccacttgttctgcatttcctttacctccttcctgaccttaggtctgggcacaggaggaggggcttggaggtggaggctggagcttctgggggtcctggctgcatgactctaaggagggtggtgccttcgtccccacccaacccccaccgcatcggcccattctcctcccgaagcatccctgggccacaggttcccaaggccacctccagactgggcccgcgagtggggcggccctggtagcgtatccacagaagttattatgaggtaattttatttctttccattttaggtaaaaatagtaaatacaagataatcttaataaaggtaaaaatacatcatttgg

SEQ ID NO: 216670 - DNA, 619 bp, Homo sapiens
tcctagaggatcccggttatacggagaatattctgtccccacaccccaactttctatatattggagctttttattatagaagcccttggaagaatctgcatgcgttagggccacaattgaccacccactgacacagtcaccctttaccactgtaggacatgattcaagacagaagcagagccccacaatgactgtatcctcaggctgactttggcgctgtcttcctgcagcatccaccctgttgttgaagcagtctgggagcaatactatcttccatgctccagcccccacctcaacccctattcctacccccattttccaaaagaaagagagagagaactatatcagagtgtgagttaaacaggtattcattacctcttgtcttaaatgtcctgtgcgtagcactgtgagggatagaagaggagtaaaccagttgttgctctcaaggaacttgataagaagatattagaattatacttaaattcataatacaagaaggcagaatggcattcagttggtgtgcttaaaaaaccgtcggccaggcgctcatgcctataaacccatcactttgggaggccaacatgggcggatcatgaggtcaagagatcgagaccatcct

SEQ ID NO: 216671 - DNA, 432 bp, Homo sapiens
caaaaaaccttccttttcctattgctttgaagtgccttttctgttgtatattgtcaatatatgcaaagatcttttatgggctctttattatattggtttttttcctgtgctaatgtacactctcttcattacttcatgatcttcaaaaaaatttttgatatataatatcaaagtcctttcacatccttgttattcatcaacagcttgtggctcttcttggttctctgctcttctttatatattttagaaatagcttatcacgtttcactaaaaaaagccgaacacattgaaaatttgattggagttgcgatgaatctataagctattttgggagaatttatatcatagtgggcctttcaatccatgaacatgatatattgctaagtccttttaatgtcttaataaaattttattaatcaccaagaaggtctt

SEQ ID NO: 216672 - DNA, 385 bp, Homo sapiens
taatcccagcactttgggaggccgaggcgggtggatcacgaaatcaggagatcaagaccatcctggctaacacggtgaaaccccgtctctactaaaaatacaaaaaattagccgggcgtggtggtgggtgcctgtagtcccagctactctggagggtgaggcaagagaatggtgtgaacccgggaagcagagcttgcagtgagccaagatcgcgccactgtactccagcctgggagacacggcaagactccgtctcaaaaaaaaaaaaaaaaattagccgggcatggtggtgggcacctgtaatcccagctactcaggaggatgaggattgtgctactgcacttgagcctgggtgacagagtgagactcagtctcaaaaaaaaaa

SEQ ID NO: 216673 - DNA, 354 bp, Homo sapiens
ctaaattttcactgtgatttaattttgttttatagataagttagaagagtatcacttaatttccaaacgctgagtttttttatagttgtccttttgttattggtctttacttgtttctgttgttatcagaggacaagatttcagtcctttgaactgtgttgaggctggctttatggcttaacatggtctattgtggtaaatgattttttgtgcacttaaaaaatatgtatattcagtaatttttgttgattttgtgtgtgtgtatgaaattctatgatttcctgaaagagttgtgttaaattttaagttaaaatatacaatcacaattaatggtttattccttattttagttct

SEQ ID NO: 216674 - DNA, 129 bp, Homo sapiens
gggggctcctgagcttggcatgtgtgtatacttcagatttgaaaacttgctcacacactgtgttaggtccagggtaactgtagggcaggccactgagtaagaggtaagccagaagtcttcagttgttag

SEQ ID NO: 216675 - DNA, 450 bp, Homo sapiens
gggaccagcattccacgaaggcagcccttttctagatggagaaaacagaacctgaagacacccgtttccctaaactgctcttgctcatgtgcttccgaggcgatcgatcaggcagtgtcggtctgcagctgctaagccaagaagatctgggaaggagtcagtcagggagccttgggctggagtcccaggggctctgggagtggctgccagagcaattcactttgacctgggtcaccctcaacttaaggctcataactcccctagatcctcagggtccacactaaatgtgatgaaatatgatgcaagccacatatttacttttgcattttgtagtaaccacattttaaaaagtaaaacaaaagaagtgaaggtaattggaataatatcagagatttaaacaaatctatccgaaataccaggtctacaagtataaaatattttaacattaac

SEQ ID NO: 216676 - DNA, 710 bp, Homo sapiens
ccttacgggtgcgcgcttcggtcctggaggccttatcctaacctcctctccatcagcgccacccgtctggggcccgaaacgagggagctttccctctgtcccccagcctttggactgtcaccaaacaagccattcgttcatcaaaaatacttattaagcgcctaccatgtgcctgacaagggagatgtaacggtgagaaaaaatagggtctctctctctgccacccaggccagagtgcagttgacgcagggcaggggagccccgaagtggagcatagcgtgtccggaactggtgggttcttggtctcactgacttcaagaatgaagccgcggaccctcgcggcttccgaggcgatcgatcaggcagtgtcggtctgcagctgctaagccaagaagatctgggaaggagtcagtcagggagccttgggctggagtcccaggggctctgggagtggctgccagttctacaaggcctggagctgatacgaaaaacctcccttctttcccaaatgctccccagcttccccgttcactgaaggccctgcagtcaggaacagtcaggactttgcacccagttgttgtgggtgtttggccgactcttcctcttgtgtgattcatggaccctcagcattgcatcacctaggagcttttggaattgaagactctcagggctcacccggaaggacctcctgggccagaatctgcatttta

SEQ ID NO: 216677 - DNA, 484 bp, Homo sapiens
gctgagggaggagaatcgtttgaacctgggaggcggaggttgcagtgagctgagaatgcaccattgcactccagtctgggtgacagagcgagactccatctcaaaaaaaaaaaaagagtgctttagtccctaaaatgattttacattcaaactaatccttctcagagtgtacatttctttagcagtatcatcagctattaggttggtgcaaaagtaattgcagttcttgcctttagtaatggcaactcaaatagtattttggcctcatgcagtgtggtggactagagcttacttaaccttgggctcttagaatcttacgttggggaactgtgggcccagggcccctgttcttataaagctttattggaacataccatgcccattcgtctgcatgttgactttggctgcttttgcatcacacagtgcccaaagagtaaaatatttgctttcaacccatttaagaaaagtttgccaactcctgaag

SEQ ID NO: 216678 - DNA, 424 bp, Homo sapiens
cacagaggataccctcagggcccagccattgaaaaataaatgggtccattcttgtatggcctcaggggaagcctttctgccaccagagccctggactagggctgcccaccaagccaccccttacaggatctgactgcaggccagattaaaatgagaccctcacaacagggggcatccccccgctcccccccatctgccttccttctgctatcactcactcactcactcactttcaatcagtctctctagcttcctttggcactgaaagtactaggtcagaggttgcggtccctgagactgaaccagcagaatttggactcgggcctaactgcccgagagaacttggtgacattggctctgccatctccaagtctctttcctaagcttattttcccaacgtggccagggtgtggcccacagtgct

SEQ ID NO: 216679 - DNA, 549 bp, Homo sapiens
agattaatttttaaatgtcaaatcctccttttctgcctatttttctacatacatgattctaggctggttttctagctgaaccttaccattaattgctgtgacttctcaagtactactacaacatcttctcaagtacttctacaatatccctgttaccagcagagatgaatggtcaattatcttgaaaaactgtagtacatacaatgacattctgatgtagttgtataaatagttgataaccagtaacatttattactcagatttatcgcctacttcagtaaaagattacttccaaaaactctattcactctcaatcgataatagtttgccatcactgaagatactcagaagatacaccaaagagttctgaaacgggagtctaaatacattttgagaaactggcatcagaacaatgtctagtcccttttgaactattaacacactagtgaatatatttccagcaagtatatttgtataataaacacgtcctttaaaaaaatctttgaaatatggtgcttaaataactttcttttgtaaccttaaagtatc

SEQ ID NO: 216680 - DNA, 491 bp, Homo sapiens
catgtgtgtgtgtgtgtgtgtgtgtgtgtgtgtgtgtgtgtgtgtgtgtgagaggagtttcgcctttgttgcccaggctggagtgcgatcacacaatctcggctcaccgcaacctccgcctcccgggttcaagcaattctcctgcctcagcctcctgagtggctgggattaaaggcatgtgccaccgcacccagctaattttgtatttttagtagagacggggttcctccgtgttggtcaggctggtctcaaactcccaacttcaggtgatccgcccacctcggcctccgaaagttctgggattacagtcatgagccaccacgcccggccgggaatgggttcttcagcaaaattataatgtggatcacttgcacttgtaattcaaagacgtgtcacatattaaatattgtgcaattcagttttggataagtattgaattcactcttatacttacataatgccgggaggaatttatatcattttatattaaa

SEQ ID NO: 216681 - DNA, 343 bp, Homo sapiens
actagggggtgtactggcagggtggatttgtatcttatttcctgcacatagaaccagtattttcctgagagaaagggtcttttgtaactaatctttggagtatgacaaaatctaatagtccttaagaaatagagaactatttcctgcctcagctgaatgggttaagttcaatattttgagcctgtaactccagagatcagattaaaatatgttaatctttcttatcagaagttggtatagtagttagctattcaaagaactaacacttctagattctatcaactgacctagaagctcctttaggctgagaccccatatagacataattggaaaataactcaga

SEQ ID NO: 216682 - DNA, 230 bp, Homo sapiens
ctaaagggcttatatcacttctgtcctccttcccagccaagtaaagtaaagcaaaagagaaacaactttcaaaaggactgaaacactatggactcaatttccatgtgctgcactaaatggggtccttagagcatcccgggctgtctttgctctgattttatcagagtaaaaaatttaaattttgcttatgataggctgaagttcttataaggaggagaattctggaagaa

SEQ ID NO: 216683 - DNA, 400 bp, Homo sapiens
tcactgaggccaggaacatttcctagggcctcagctttggtccttctggatgaagcctcagggggactttcctctgataatggactaaacgattcaagatgaccttaatgaccaccctgtttaaaacagcctccttatttctccaatacttcttctccaaacattgatgtttccaccataaggtcagctcctctttttcttccccttatggcaaggcttatggagaaactacaccacataaatgaagactaggagctcaaaattccagaatgacctgggaccatggaaaattagtattttgccttctacagtaaagtcacactcttgagcaaaggaggaaaaaaaaattatcacagtccctcaatcagcaaaaatctaggcatggaagactaaaagaagt

SEQ ID NO: 216684 - DNA, 482 bp, Homo sapiens
aaagtgaaaatgctcaaaggggggaaataaggtatgagaccaccacttctcctgttgtccttcccagtttctccccaacctccccttttccctagtttgtaagacagcaaaaaagggagaaagcaaaaagttggaaaaaacagaagtaaaataaatagctagacgaccttggcgccaccacctggccccggtggttaaaacaacaataatattaacccctgaccaaaactacctgtgttatctgtaaatcccagacattgtatgagaaagcactgtaaaaactttttgttctgttagctgatgtttgtagcccccagtcacgttcctcaggcttacttgatctattatgactttttcacgtagaccctttagagttgtaagcccttaaaagggctaggaatttctttttccgggagctcggctcttaagacaccagtctgccaacgctcctggctgaataaaaaaacctcttccttctttaa

SEQ ID NO: 216685 - DNA, 477 bp, Homo sapiens
tactttcagaatggttgtgaagagtgtgtgtgaatatagctgtccatcagctccggaccatggagaaagtcatcagtggaacagaaacaccagtgtaaggggtttgctttgtttcttaagctggcctttagtccagttgccttagaacttaaacttcctatcttacagaccagtcgttaaggtgaagccaagtcttttctctttgtccatcaaaggctgatccacggagttcactggtcacaaaactgtcttctacaatcagggattgcattttaaataaaattcatgtagtagtcttaacataagcatgtctcaagcatggttacctctcaaaataaatggtcttaaggcaatggcaacctagaggaggtgccctctgtctttcatatcctggtctgatttgttgtatagatgacagtatggaagcttgaataaggaacagctgaacagaagatgccttcctgtgaacctggggtt

SEQ ID NO: 216686 - DNA, 1079 bp, Homo sapiens
  misc_feature (946)..(946): n is a, c, g, or t
gaagtgtgtgcatagtttaccacacaacagcatatgagtcatgtcaccatcattattgtcatcacccatctttatagtaacaagaaggtagttccttcacactctaacctaagccctttttcttcatcttcacctggctttggttcttttgctacagttactccagcctctctccccagcctttatcttccaaattttctgctgtgttgtttcaacagccagtgacttttctgttcatactctattgatgatgaagtaaaaattgattttgatttgtttctgatttcttttccttagtaagtttgagttgaacctttagttctctctcctcatctcctcgctttctacaaaggcaattcctggtgttaagtgaaagctgttcctgttagagcctactgtttgccattaataagtgataagggaggttgtcagccagcattaatactctgtttatgaaattacagttactgatgcagtattttgtgaagttcttaagatataaacggcacaagtgatttgataagttatagctccagagacttccttacatagtatgccagtatttctttttcccctctcaacgggacacacataacattaaattaagtttgtcttggttgccatttactttaaacggatctggtgcctgtgctcagatatgtttatgagagtataattgacttctctgaaagcattgagattgagggagtagttatatcttaccttagtctcattgatgattcatggaattgaaataattaaaaagtacttattacatgcctgattgcttcatgaccctttgataaactaccaacactcatatcaaatgtctcctgatttaaaaaaaaaaattttttttatacatatatagacaagttctcactgtgtcaccgaggctggagtatggtggctttcacaggcatgatcatagctcactgcagctctncgcctcctgggctcaagggatcctcctgcctcagcttctcgagtagctgggaccacaggcacctgcgtctagctaaatgcctcttgattttaatggcatgtcttgtcttcatagcatattccacaaaaaactc

SEQ ID NO: 216687 - DNA, 383 bp, Homo sapiens
catgaaatccaatagtcaactacaacatggtttgtgtgagtgaaaagaccccagaataagaccacctgggtgagcctgtgcctggtggtctcaaagcatccccctcctcccatccacccctgctctgccctgtatcatggggggtctggcctctgcaggctatgagccccgggttcctgtgtctctggcttctgactgggttggaccaatgggaagcctggagggacatgggtgtgtacaggagtctgggtgggcttcttgactctgtttgttgggctgtcttgcctggaggctctttccttctacaagccagctcctgccacagagacccaccctggttctagcttcccttcagtgagtctgattcctgggctctgataact

SEQ ID NO: 216688 - DNA, 425 bp, Homo sapiens
ctgaaataagaaataatctagtgataaaattgttgatgttctccttcactgtaatccattccaaatatagtttattttgctacagagcatgttctgtaatgtaaatggaaataagattgttaaagagggaatgatgtgaacataacttgggtgatgagaaggctcctaagggattttccccctgcattttgcactgccagcatttacactgcagcagagtgcaaaatatgctaacaaagctgcatacagcaaaccttagaagaatacagtactgtacaccatgtccattcatcctatcttcccaggaggttgatcatgtgcaaaagaaacaatgacaagataatgatccaaaatcaccagccatatctttgctgtggtatgtgtgaaacttgcatctacttattacataaaatgctacacctgta

SEQ ID NO: 216689 - DNA, 368 bp, Homo sapiens
tgctgtgtttttcccatcaaccaagaaacactatctttctttttcttcctcgacaatcattactgcaaaagggaaatagtatcttttacttgtaaattattatctgtgcccctctacttgaatataagctccatcagagtggggactcttcatttttgctcactgctgtttatctgcacctagaacagtgcctggcacatcatgggtgctcaagaaatcatttctgaatgaacgaacaaaagaataaaaatcattgtaatcataaaatttaacagttgaataagaaggcttgcaagtaaacttgcaagtcaagaatccctagatatcacatctgtagcaactaggaaattaggccttggtcactttaa

SEQ ID NO: 216690 - DNA, 374 bp, Homo sapiens
tctgatgtggtgtcccctaccaccccacacacttaattttccaggccactgattcagaattcaatggtgactatcttctccttcaatttgtatattgatctttttcattcaaaaattgtgagatttttaggcccaagaatttgagagattttgtagtatgtttgaacctcgagtgtcttgttaatttttgtctaagttgttctctgtctccaccagcagttctatttttatttaggagctacatattctggatattgttcttctatcattgctagatcccctagttttcttcaccaacttctgactcactcttagacctgagattcaccccttggggtgccctcaatagaagtattctgcttccacagatcatc

SEQ ID NO: 216691 - DNA, 433 bp, Homo sapiens
cagtttatttttaataagtagataatcagaattgtgtcaagataacatccagtgagacttgaacagaatcactcctgaatagttgactcagagtctctaatagccctagaaaactgacgagaaatcatcagttcctgataaaattacacaattctacttcaaccaaagaggatcaaagccagattggttggactgtcattcttctgtttatttattttgtgtattttttgagacagagtcttgctctgtcacccaggctggagtgcagtggtgcaatcttggcacacggcaacccctgccttcctggtttaagcagttctcttgcctcagcctcccaagtagctgggattataggcaggtgtggcaacacctggctgatttttgtatttttagtagagacagggttttgccatattggccaggctggtctcca

SEQ ID NO: 216692 - DNA, 553 bp, Homo sapiens
ctgttctgctggtgtttgccttcctcctgtgcaggtgtttcctgttaacctgccctggcagttcagcctactcagaccagcagtaagttctctttctctggcaatggcattttgtatcaacaacagctgtaggtcagggaagaggcatttcaggagccagaatcgcgggaccctcatttattctgataaagtatcacttggaactgttttctttgagattctctgggaaaaaaaatatcgtgccctaatgcagtgttttctaaactgctgattatgactcattaatgggagcaagaaagtaatgtattagactgcaactagaaatgtttttaatggaaggaatttgatgtaaatagtagaagatacaaatgtagcacatacagcaagtgtcctctgtgttcaaggttttgacataaaatatgtttcttcctccgagttggcgtcaaacatttgacagccattactctaattaactttcagtattttttaagctcctttgattcccctctccctttttccttctaatgataatttaagaatttttttttttttt

SEQ ID NO: 216693 - DNA, 495 bp, Homo sapiens
ctgttctgctggtgtttgccttcctcctgtgcaggtgtttcctgttaacctgccctggcagttcagcctactcagaccagcagtaagttctctttctctggcaatggcattttgtatcaacaacagctgtaggtcagggaagaggcatttcaggagccagaatcgcgggaccctcatttattctgataaagtatcacttggaactgttttctttgagattctctgggtgggagcaagaaagtaatgtattagactgcaactagaaatgtttttaatggaaggaatttgatgtaaatagtagaagatacaaatgtagcacatacagcaagtgtcctctgtgttcaaggttttgacataaaatatgtttcttcctccgagttggcgtcaaacatttgacagccattactctaattaactttcagtattttttaagctcctttgattcccctctccctttttccttctaatgataatttaagaatttttttttttttt

SEQ ID NO: 216694 - DNA, 500 bp, Homo sapiens
tggcacgaggtcgagtcttgagtttgactatatagagaaaaggttggcaaatattttctgtaaaggccctgatagcattttaggcctgtgggacccataggtctgttttatacatgtgtatatatatgtgtatatgtgtgtacatgtataaataaaacaacactttaaaaatgtaaaaacagctcttagtttgaggacctacaaaaacagactgtggagtgggcccatagccctagtttgccagcctcttatatggacactgattctcagggaagagctatttgttatttaactttctactccagccactctcaactataacagaatcaaattatgaatctttgccattgccttctgcgtttctgggaaacagtagcagaaaaaaacatgaatgttgagattggtatgaaaatggcaggaaaacactgagctcattttaatattatacttttgttgtgggttagccatttaaagttataactgattcattgccctctgga

SEQ ID NO: 216695 - DNA, 705 bp, Homo sapiens
tggaaatgcgtccggtcccagtgtgacggggaagagccgcgcctgaagctcaacttccgaggctctcatcaatctacgcttcctttggagcgtgcagccaccaggtggcagccgaggccacgggcagacagaaaagctcccgaaactgaaggactgccaggcagcagagttccggagggctcccaggaccttcaaccagaaagagacagagcatatgcgcatatccctgcaaggaatgtactatagagccaattttaccggcaaaggaatggaagatctgaaaggctaggcgatcccacaagcatcgaggagcaggctggaatttgaaccaatcggcatgattcccaagctcaagcttttggccacccctgcactgccagggacaaaaaaaaaaaaaaaaaaaaaccctgggaggagagccaagctagggagtcaagaccctccagccaggtctggatgggaggcaggtgcctccaccctggtcccagagcaagttctgctggcttcagccacctgacttccctgtgaagttgggtagaggccagagcagactgtgtgtgattctggccccagccccagcacctctacccccacctttactacccctaggctgcgggaagaggctttgcccagcaatagtcctgatctaatggatccttgaagcacaataaacagatagcatttctgcatgtgtcactctgagta

SEQ ID NO: 216696 - DNA, 608 bp, Homo sapiens
ccacgggcagacagaaaagctcccgaaactgaaggactgccaggcagcagagttccggagggctcccaggaccttcaaccagaaagagacagagcatatgcgcatatgtatgtctgagcccgtgcacggaggaggagtatgaacagacaccgcgggacagatggctggagtttagtcccttccttcggggctcttcaccactccttgggcttcccttctcctgtccagccctgtcctgggtgcacagagagggaagtcactccattcctgcccttgaggagctcccagacccagggcaggagcaggatgcagacaagtagacagcaccctggggtgggtggagtgagtggggcaggtggggcgggtgcaaagagagggaggagcaggggctgaagttgcccggaggaagtgctgaacccaggagtggggaaaggagcatctgggaagaaatggcatctacgctgatcatggagggctttctggcaagtctcaggagcaataataacacggatgtcatctctgtttcctcccagcagccctgcaaggaatgtactatagagccaattttaccggcaaaggaatggaagatctgaaaggctaggcgatcc

SEQ ID NO: 216697 - DNA, 487 bp, Homo sapiens
ccactgccaccagtcttagacgatagcactgaagtgagtgaatctcacggcctcccatggaaactctgtgcgtcttttaagggctgggctgggactggagtaggactagtgagggagtcttctcaggtacaagttttaagggggcatcaaagaatattttagtgcaatatatacatatatacacatatatatacacacatatacacacacacacacacacacacacatatatatatatatatatatattttgttttggagacagagtgtcactctattgcccaggttggagtgcagtggcatgatcttcgctcactgcaacctctgcctcttggattcaagtgattctcctgcctcagcctcccaagtagctggaattacacacacccgccaccacacctggctaatgtttgtatttttagtagagtcagggtttcaccatgttggccaggctggtctcaaactcctgacctcaagtgatccaccca

SEQ ID NO: 216698 - DNA, 555 bp, Homo sapiens
ctatggtacagcacgaggcaatggggcactgtccagccataccaaaaaagtgagaagcctcgctatatatggagtgattgccaggagacacaactaaatgagaaaagcaaggtgcagggccgcatatattagtgtgtgtgcatgtgtgtgtgtgtgtggtgtatgtattgcaaaaagaaagactggaaggtagaacagggtagatgagacagggataggattgagacttctctacatacactttttaatacaggatatgttgtatgtgttcaaaaataaaattaaattaaaaaacaaaattagccttaatgttgaatataaacatgaataaatgaccctaatgatatatcaaattggtaatatgaaaacaaagaaaaaattatttaaatgagtttaatatactattctaacttcacatacatagatatgtttgaaggataaaaatcttcaaaaaatcttgttacttaactctagttttattgttattaacaatattgaattgtaattttgaaacttttttatattatacaataaatcaaggtaaatgtgtaataa

SEQ ID NO: 216699 - DNA, 401 bp, Homo sapiens
ctttagctatgagacattgggccggtcacttattctcttcagaggattaaaaggataaaatattttaaaaaatatctatctatctatctatctatctatctatctatctatctatagatagatacacacacacacacacacacacacacatagagttcttatacaaaccctcattaaatgtaatccaagttgtagacccacagtactgatttaggtaggcaaaatatcaaattaacaacaacaaaaaaataccagacataaaaaatgtgtctcatattctggacacatcattattctctgaaatatccacagaccactctaatctgagcacaccctaggtggaccaggaacacaagtaatgtgaatgactgcaataataaaatgagtatgttaaactatca

SEQ ID NO: 216700 - DNA, 264 bp, Homo sapiens
tcataagtgtccatcaaaaggaagattagttacaaaagtctgaaaaagaccttgtattttatagacccgttatactagtattgttatcttacttgatgaaatctcttaggcctcctaaatttccatcattaaattaaaaactagggcaggcatagtagctcatgcctgtaattccagcactttgggagcccaaggcaggaggatcacttgagcccaggaattcaagaccagcctgggcaacatagcaaactctgtctctattag

SEQ ID NO: 216701 - DNA, 649 bp, Homo sapiens
tttgtcgctgcagccccatttgttgctccagttgaggtcctgactggtgagtccctcctgccatgtctacctctgagaagtgagacctggcccaacatagccagagtggagcttgtgacggggcagccctggaccctggattcatcgggagtgccttggtgcctgaagaatgggtggctgaagccgaggcagaggtagcccctgaggatttccaggaggcaatagaagctgttttggaggaggaggaagatgaggcctgggtccccatcgagaactggtttttttcagctagtagaagaggaggaggagctaggagaggaggaggaactgggagaggaggaggagctgggagaggaggaggaagaagaatttgaggaggaaaaggaggaggaggaatttgaggaggaggaggagggtgaagagggggaggaagaagaagaaggagagggggaggaagaagaagaaggagaggaggaggattatgaaggagaggaggaggtttatgaaagagaggaggactatgaaggagaggaggaggactatgaaggagtggaggagggctgtgaagaagaggaagaggatgaagacaaagaggaggacgaggaggaggctgaggatgaggacaaggaggagaaggaaaaggacaaca

SEQ ID NO: 216702 - DNA, 163 bp, Homo sapiens
catgctgtggtccctaaaaccttattaaagaatgatgaacaattgccctgattcagccctactttaagaataaaggatgactccttcaggtatctgacaaaaaaaagacagacaaacacacactcacagctgggcacggtggctcatgtctgtaatcccagta

SEQ ID NO: 216703 - DNA, 177 bp, Homo sapiens
caagcccacgtgtgggggctcccaggacagggctcgccttggcagaatggcctctgggaagaacggctgtttcaatgtagtttttggagtaggtctttttcacgtgattcaagtataaaacaccagaggtgaaaaatcacttcctgccctttgcaaataaaagcaaatacaaatttc

SEQ ID NO: 216704 - DNA, 419 bp, Homo sapiens
  misc_feature (13)..(13): n is a, c, g, or t
gattacccatcgncttgtaaggaaagacagagatgaagttatcctgactgctgagatgagcagtttaccctaggaggacctgtgggactatgttttggtaaagaaaagttgagctgctctgtgggagtgaggttccaatgaagccaaatgtacaaggtgtgtgttctatggcctaaagacccgtagatggtatcacaatggcatgagaaaggttcaaagatacatgttatttgggggagcctggggaatgtggtgactgctaaagggtgtggggtttctttctggggtgataaaagtgttgtaaaattggtcgtggtgatagttacacagctctgtggataaaaagcattgaactatacactttaaatgggaggactgtatggtatgcaaattatatcttaataaagaagttatcaaaa

SEQ ID NO: 216705 - DNA, 445 bp, Homo sapiens
ctatactttttatcattattttacagtgttgaacttctacttacaaaaaaagttaacgtgtaaaacaacctctggcaggttcatcaggaggtattgcagaagaaggcattgatacaagggataacagcttcatgtggggtattgcccctgaaagtcttccagtgggacaagaaggcagctgccatagaagaagtctgactacctgacaccaccctgctgtggggaaaacctatgctatccatgtggaaccaccatatggagagagagaaagatgtccagccatcccccagttgttcaaggcaccccaactcaggcaccagacacaagtgaagaagccattttggattttccagctacagacgatgccacttgatcacagaggagcccccactctgcctaaattgcagacttgagcaaataaatattgttttaagcactgatggtt

SEQ ID NO: 216706 - DNA, 498 bp, Homo sapiens
gagccaccacactggcctcatatgactttcttagtgtcagatacatgctttttctcacaacaatcctaggtggtaggtgctattattaccctccattatcattttacagatgaataaacagatacaaaatggtaaagcaaagttaaaggggaattcatgtctacttctaagtgcttgaaagcatgtcagtaacattcttgtcactgtagctggaggggtcccattcttatgttctgctctgaagcatctggaggtgctcctgaatatcctcagggaggggcacttgaagaagagttcctttattatgagatgaagctccttggtaacctcacaggccagggctataccagcaagtgactgtgcttcctcaccctcttcagacaagtgttctatgtagtggttcagaacatccataacaggctttatctcagtaataagcaaggtgtaagagaataaatgtcagaatttatcctgaagcatatccttcctcatcttttc

SEQ ID NO: 216707 - DNA, 441 bp, Homo sapiens
atttggtgttagacacaagagaacaggttccctgctgacaattttcagaggcccgtgcccttcggtcttcaggtgaggctgggcttgagggaggttttgtggaacggtgagaagaacagcgtgactaaggcacagaaggctgagtgatgccctgcagtgcttttgtagggttggaggccagctgggaaagaaggaacccttgcgttagagaatgggaacatgccttaggatatagaaatggcaaatctgagatagtttgaagtgagaatactagaagtgttcccaccaaacaaggtgtgtcttggtgcctgctgtatcccaggctccgtgaggtgccggagtcagcactgaacaaacagagcttcctatgcttgcggaaatgcatttcgttgggggaagggatttttctgctgactctggctattaatagtaacaatcaaa

SEQ ID NO: 216708 - DNA, 415 bp, Homo sapiens
tcactggataatttcatcataggtaaagagaagtatctttataatattaatccagctaaaaagaaaaaaagttaaaatattactattttgccatagttaatatatctctaagcattgaatatcaacagttgctaacaccacataaagagaaaaagaatatactatatacttgcacacctgatgaaagaatatactgtactcctgctatggccttatcaaagggatcaaaccttagtctcttcatcctcaggatccagctaccaatttgcaggaaatgccaagctcagcggagcaagttgaactataccaagtgtatgcaatcagcaaattccagattgtgagaaagccaaacagccttggttctttaacagatattttgtgtggaaaagaaacagaagaagaccatgtagaaaaa

SEQ ID NO: 216709 - DNA, 343 bp, Homo sapiens
gggtggggcatgtggcgggaaatgcctcagaaggattttagttgatgtcaggatcttattgaatacctactactcataagttacgggttccatcctcagggggaccagggatgaattgagtccagttcctgcccctgttagctcattctgtaggataggggccatgttaggctctttcaggttaccagaaaccctcaggatacatcagtggatgaaggtttattgtaagggtacatactgaagtgaggacagccaggaagccatcttggcagccaacatggccaggcctcaagggaaaacaagatggccttggttatgctgtggatacaggattggcttggag

SEQ ID NO: 216710 - DNA, 419 bp, Homo sapiens
aggtaggctcaactgtcagagccaggcctctgcacactcagagccagttgttcaggagccagcagcagctgcaggtctgggtgctcctcagggccaggacaccctttaatccgacccatgaaggccagagaagcctacactttatggattcctcaacccggcttttgtaagtaacttcagccacaagccgcgtggcatgttgcagctattacatgtgatctggcagtaggtatgtgtcagaaactctctgatgaagccaaatggaaactagggccctggcagcacaaggctctccctccttcccgaggcagcctacacagtgagctgaccccacatagttcacccagctagagagggcatgcggatgccccgtgggcagaatctggggaagcagcaggacagagagggtctctctgcag

SEQ ID NO: 216711 - DNA, 600 bp, Homo sapiens
  misc_feature (46)..(47): n is a, c, g, or t
  misc_feature (402)..(402): n is a, c, g, or t
ccagtgtttgaagcaatggatgtcttatcttgatatgtttgggggnntggattcttcttgttcttttttttttttttttttcttcaaccagggtcttgctctgttgcccagagtacaggggcgcaatcatggatcactgcagccttgacctccctgggctcaagcaatcctctcctgaaccacccccctgccccccactgctgggactacaggcatgcgccaccattcctggctaatatttttattttttgtagagacgaagtctcaccatattgcctacactggtcttggactcctgggctcaagtaatcctcctgcctcagcctcccaaagtgctgggattacagtgtgccactgcacctggcctggatggattcttaatgtcttcaaataaagatttcnaagtactccatagcaaataaatccatgctcatttaggttcattaaaaaaaatcagaacagtatataacaattcttatatagcttttgcaaaaatgcaactcatcacctgcccctgccccccactgccatctctcatctccctaacccactgccatctctaatctccctaatccactgccatctctcatctccctaccc

SEQ ID NO: 216712 - DNA, 197 bp, Homo sapiens
gttttttccaaaagcaaatattacaatcagctgtagctgcagtatcccacttgtttttaatttagccatattctgtctatcaccattagtttattatggagtgattaacaagccaggtttgcttgaggctgagtgggttcgcaagacacagtgctttcagtggaaaaactgagagagcctctggcaaactaggataa

SEQ ID NO: 216713 - DNA, 539 bp, Homo sapiens
gtaaaggggtctaggatcttgtcctgagggcagagctgtgggaaggtcttggggtttctgatatccctgaactgactctttctcccatgcttccctttgccaactccagccacccaccctctgcacacacctcaggccttcaggatttgtctctctgccccaagcgcagtttgattttcactgaaggagataggttaagagcatgggctctgggttcttagccctgctgcttacttgctgtgtactgaacctccctaagcctcagtttcctgtctttgtaatgaggacgatcccagtgcctgccccaggggttgaagtgaggactcaagaacgcagtgcatgcggtggattcagagcagtgcctggcacgcagctgccacttcacatggggtggctattgttattgccataccctctccctacccaacctgctcattcccagactcacggggaaaggcctgtcccttcccctagggaccaccaccccttgtccttctctgaggtcggaactttaacaagaggctgagctttctcttcta

SEQ ID NO: 216714 - DNA, 965 bp, Homo sapiens
tcctgcctttttgtactcctcttccttttcttcagaggcaggagaaaagggattgcttatatttctacacagatggattaactgccctctgtgaattcacatgaacgttcataaatggccaaaacttggcatgattgggtagtagagttctgtttgtaaaaggaccactatcaggtaacagtttaaatctcccagtaatcttaccttatttcttaatatcctttttatcattaaaactgtttagcatagaaaaaagttcctaccagaaaaaccaagtgactggaagatagtggaaatgaccaagtgaaataggatcagaatgggaactaattaggaacatcaagaaggcaagtgtaggcagggtgtgatggcccacatctataatcctagcatttcgggaggctgaggtgggagcattgcttgagcccaggagtttgagacctgcctgggcaacatgatgagacctccatctctatgaaaaaaattaaaaagaaaaaaatgagctgggcatggtggtatgtacctatggtcccagctactcaggagactgggcaggaggattgcttgagcccaggaggttggggcttcagtgagccatattcacaccactgcgttccagcctgggtgacagagcaaggtgctatctccaaaataaataaataaatgttaaatttgcttttttctctctctctttttttatgtagaatttgtttgttgatacttactgaatgtagtgaccctgctgtggtaatgaacacttctagtgccttctaggcttaaaataccagacagccccaaataacaaatgctcttttgtgttttgataggttggatttctgtttgcttaatattgggaatactggggggaaaaaagatggtgttttcattctaaggattgtcctaaagaaagtgctactttatttttaagaaagtaaggccacttgttatataagaaataacaagtt

SEQ ID NO: 216715 - DNA, 1611 bp, Homo sapiens
gtgatccacccacctcggcctcccaaagtgctgggattgtaggcatgagccactgcgcccagcctgttttgccaagcttttctggttgttttccttcagtgagagagttgatggatattacctagtctgccattactggacatcattcttttttactccagcttctgatccttatatatattttatcttataggaatgtgtactatttagtttgcttccttgtaagaagctttcaaatgtctcatttgctggtgcctgttcaattaagctttggataacagtacaaaatttggccaacatgaatgcctagttcaccgctaatgaaagctgggcactgcaaatgttctgctatgctccagaaatcagaagttgccagcttttatatctagactgtgatttcctcatagaggattttgtacatgccaattcaaagtttaaatttgtgccatgtgtgaataagtgcacaaaatgctcaaataagaatgagaaaaatatctccttttcccatccacattgagatacctgaaacaactatgaaatacagtttttcttccagttttccgaaatacttatctgggttgagaccaagaatggagcattttaggccaaaatgcttttttaaaattttatgatttatgagtttagaaaaaatctcttttggactttaagcatatgttatttttaggatatcttattcatgaataaaacaaattttttacataggtgaaataatttaggtgtttgtatattatgagtcagttatttctataatatatgactagtttatatttgtagtttttcagttacattcagtagcccacatttgtttagtaacagaattaacaaaaattgctgttattattttgagttaattttcaactcgtatttttaatttgctaaatacattctagcactattatattgtcagagaccttaattcaagtctttaaatatttaataaaattatgtgaaaaattgaaattatttgatgttttaattttgattgctctggacaaagacagtatttccatcttgatgcttcaggataaaaattgcgttaaacaatacttgaatttaaatgtggtttaaaatatttcttaattctaaagctctctgtagttcctattttctaagcaatattagctatattggatcttctagatgaagaaagatttgactatgattaaatatgtgcagtgccatcctggaatagattttattcatagattaataaaatatgtgcagcatgatttaggagaaaatattttaggacattaaatttagttacataagctacagtcttttaaattctgtgcaactaaaatctgttttgctttaaaaagaaaaaatgttcaaatttcactgggaaatgtagagtatttgttttccaagacgatcaaaatcatacccaatcatacttttaggaaattttcaaaatactagatatagcctttcaacttaatgacgattgttattgtctaattttcttacctgcacttaccagtattcagaacactctgatttggttacatgtttcttatagtacctccttggttcaaatgtaattcttttctgatattgaataaactgtaatgtcaaggacctagcaca

SEQ ID NO: 216716 - DNA, 534 bp, Homo sapiens
tgacttcatgaaggcacacatttagaccacaggcctctctttcattcccttctctgcatttctattttaatttactcattcattcacctgttaacatatggacagatagagctatagcagttacttctataggctcatctgcaagagggaaatatgttagcaaaacagggaaaataatacaggtgtgccagagagaaggcaaaggaagggaaagcaatagggtgcccattccatggtggtgagtaataagtggaagttttccagcctcctggccttcctgagcagcttagggccaccttgccgggaactcattcccagctctggaaatgaaactccgggtgccgctgggtttgcattgacactctttccccacaaggtttgtctcttgttgttccagacagaatgaacctcattattttggattaattgggggaagatcaaccaaaattagtgagtcagaattaaagagtgttttaaacaaaagcaactttagaatttgtaattcatatagtaacccaatctaagtgttagaaa

SEQ ID NO: 216717 - DNA, 617 bp, Homo sapiens
  misc_feature (615)..(615): n is a, c, g, or t
aacttgctcaaggttccacagctggcaagtggcagagccagaatttgaactcatcccatttaagagcctgcacatataccactatgctacagtgacttccccatgccatattaataatcatgacagctaatggttgacataacaagaagagaacctgtaatcacccccaggggcttcccgcagcctccttcctattcctaccactgtctgtctgcctgcctcctccctatgcagcagccacgtcacatgatccccgttccttggatggcctataaggtggtcttcctctagtagctgggccctgtcccttcccatctgacaaactcttgctcagcccacgtggcccagtttaaatgtgctctgtgcattccatcatctagtgcttaccacatgatcataaatcccactggtgtatgtgtgtgtctttcccaagttggagtgggagtgcctttgacatgggactgtgtctttccctttcggcatcttgtatcttccccagcatctctggctctccaaagcccccagtaaatgtttgagtaagtgaaacatgcagaagacatgaagattgttaagtaacaaatactcagcagaaagggctgttaattttaaaaaaanaa

SEQ ID NO: 216718 - DNA, 555 bp, Homo sapiens
ttctggttccagtaaagaagtcataagactgtgtcaggaagtcaggaactgagcaaaggggtctgaaattgaggacccttgagggcataacagttgctttaggaaaagcctcatgcatttgctgcccatctactgggaatgtagggaaatgtgacagctcagtgggtacaggtggaccaagcattcacctgggattgactccggggttggggacagccaggttttgagttgaggagcttcaactcaagaggtttagaaagcaggagttaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaa

SEQ ID NO: 216719 - DNA, 922 bp, Homo sapiens
aaatttacaatcctgtttgaatcccagttcagtgttggtggaaatgagctggtttttcaagtcaaggtaaagccttccctcagctctgcgtgtgcgtgtgcgtgtgtgtgtgtggtgtactttatgttacaaaatattttttttttatcacatagcatcttcttctttttgactgttggtaaactgaaaatggactgacctcaccctgagaactgtttcacttaggttctcttaagacatgaacagaggccaagcacagtggctcatgcttgtaatcccagcactttggtaggttgaggcagtcaggtcacttgaggtcaagagttcaagaccagcctggctaacacagtgaaaccccatctctactaaaaagtacaaaaattagccaggcgtggtggcacgtgcctataatcccagctactcaggagaatcacttgaacctgggaggctgaggttgtaatgaaccgagattgtgccactgcactccagcctgggtgaaagagtgagaccctgtctcaaaaaaaaaaaaaaaagacatgaacaagcaaggcccagtgcagtggctcacatctgtaatcctaacactttgggaggccaaggcaggaggattgcttgagttcaggagttccagaccagcctggagctggttgtgagaccccgtctcaacaacaacaacaaattaaaaaataaaaaataaaacatgaacaaacaataatgaactgaactagctggagaggtagactacaaaatggatatgagaaacattacttgggatgaatttgagtaaaggttgtggtaagttttaaatttgttatttgtattttcttcccagaaatatctccaatagtcttttctctctcctgttctccatgtaactttgagaaactttatccttcagaaatatctaagcaacattgcttgt

SEQ ID NO: 216720 - DNA, 506 bp, Homo sapiens
aggccaccatcatcagtgagcagcaggccaagtctctgctcaagaacgagaacacccgcaagtaattgtgcagcttcctctcattccctgctacttgtctcatgtcctggcaacaggaaaaaaagaattctgcctcctgtgtcagatccctgtttgcccttctggcctcttctgggcatcagcaaaggaatataaggaagttcttgggcctggtgtggtggctcacacctgtaatccaagcactttaagaggccgaggtgggcagatcacctgaggtcaggagttcaagaccagcctggccaacatggtgaaaccctgtctctactaaaaatacaaaaaattagccgggcgtggtggcaggcacctgtaatcccagccactagagagcctgaggcaggagaatcccttgaacctgggaggcagagattgcagtgagctgagattgcagtgagctgagatcacgccactgcactccagcctgggcaacaagagcaaaactccgtcac

SEQ ID NO: 216721 - DNA, 5392 bp, Homo sapiens
  misc_feature (914)..(914): n is a, c, g, or t
gcggcgcgcgtccctgggcctccgcgcgtgagcggcgcgcgcgcccccgcgggccccggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgagattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctgnccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttaccaggacggaattacactttctggcaatggtttgacggtgtgatggaagtgttaaaaaaacatctcaagcctcattggaatgatggggccattttggggtttgtaaacaagcaacaggcccatgacctactcattaacaagccagatgggaccttcctcctgagattcagtgactcagaaattggcggcatcaccattgcttggaagtttgattctcaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactgctaaagctgttgatggatacgtgaagccacagatcaagcaagtggtccctgagtttgtgaacgcatctgcagatgccgggggcggcagcgccacgtacatggaccaggccccctccccagctgtgtgtccccaggctcactataacatgtacccacagaaccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagcagaggggccacagacagaagctgtggtggtttttactttgtgcaaaaaggcagtgagtttcgtgaagcctggaagttggccatgtgtcttaagagtggctggactttgacatgtggctgtttgaataagagaaggacaaagggaggagaaagcacatgtgctccagtgagtcttcgtcactctgtctgccaagcaattgatatataaccgtgattgtctctgcttttcttctgaaatgtagataactgctttttgacaaagagagccttccctctcccccacccctgtgttcttgggtaggaatgggaaaaggggcaacctacaaagattgttggggcaagggaagtcacaagctttcggatgggcggtggcttttcacaaaacatttagctcatcttattctctctttgtcctctctcccctcctgcccgcccgcaccctggaattgccactcagttcctctgggtgtgcacatatgtttggagaaatagaggagagaaaagagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttacaaaaataacttctgaatttatcagtgttttgccgttaaaaatattcctctatagtaaattatttattggaagatgacttttttaaagctgccgtttgccttggcttggtttcatacactgatttatttttctatgccaggcagtagagtctctctgcctctgaggagcaggctacccgcatcccactcagcccctccctacccctcaagatttgatgaaaattccaaccatgaggatgggtgcatcggggaagggtgagaaggagagcctgcctgctcagggatccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccgtcctggctcactttgcagttggcactgggttggggaggaagagagctgatgagtgtggcttccctgagctggggtttccctgcttgtccagttgtgagctgtcctcggtgttaccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgtgtgagatgtgcaggttttttctagggggtagggggagactaaaatcgaatataacttaaaatgaaagtatactttttataatttttctttttaaaacttggtgaaattatttcagatacatattttagtgtcaaggcagattagttatttagccaccaaaaaaaagtattgtgtacaatttggggcctcaaatttgactctgcctcaaaaaaaagaaatatatcctatgcagagttacagtcacaaagttgtgtattttatgttacaataaagccttcctctgaagggaaaaaaaaaaaaaaaaaaatataaaaaaaatataaacaaatcacaacatattatattatcttttattaatataatatttcttcacttttttataatttattctatttctctttaatcaattatataattaattttatctctcattattctcgccctttttgttatttcttccataatgggggtgtttttataatatcgtctctgtgtttcatatgtctgtcttgggaaacacctttgttacc

SEQ ID NO: 216722 - DNA, 4645 bp, Homo sapiens
  misc_feature (914)..(914): n is a, c, g, or t
gcggcgcgcgtccctgggcctccgcgcgtgagcggcgcgcgcgcccccgcgggccccggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgagattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctgnccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttaccaggacggaattacactttctggcaatggtttgacggtgtgatggaagtgttaaaaaaacatctcaagcctcattggaatgatggggccattttggggtttgtaaacaagcaacaggcccatgacctactcattaacaagccagatgggaccttcctcctgagattcagtgactcagaaattggcggcatcaccattgcttggaagtttgattctcaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactgctaaagctgttgatggatacgtgaagccacagatcaagcaagtggtccctgagtttgtgaacgcatctgcagatgccgggggcggcagcgccacgtacatggaccaggccccctccccagctgtgtgtccccaggctcactataacatgtacccacagaaccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagcagaggggccacagacagaagctgtggtggtttttactttgtgcaaaaaggcagtgagtttcgtgaagcctggaagttggccatgtgtcttaagagtggctggactttgacatgtggctgtttgaataagagaaggacaaagggaggagaaagcacatgtgctccagtgagtcttcgtcactctgtctgccaagcaattgatatataaccgtgattgtctctgcttttcttctgaaatgtagataactgctttttgacaaagagagccttccctctcccccacccctgtgttcttgggtaggaatgggaaaaggggcaacctacaaagattgttggggcaagggaagtcacaagctttcggatgggcggtggcttttcacaaaacatttagctcatcttattctctctttgtcctctctcccctcctgcccgcccgcaccctggaattgccactcagttcctctgggtgtgcacatatgtttggagaaatagaggagagaaaagagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttacaaaaataacttctgaatttatcagtgttttgccgttaaaaatattcctctatagtaaattatttattggaagatgacttttttaaagctgccgtttgccttggcttggtttcatacactgatttatttttctatgccaggcagtagagtctctctgcctctgaggagcaggctacccgcatcccactcagcccctccctacccctcaagatttgatgaaaattccaaccatgaggatgggtgcatcggggaagggtgagaaggagagcctgcctgctcagggatccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccgtcctggctcactttgcagttggcactgggttgggcacgaaagactgtgtgttcccagaatgggtcactgctgcctgcg

SEQ ID NO: 216723 - DNA, 4843 bp, Homo sapiens
gcggcgcgcgtccctgggcctccgcgcgtgagcggcgcgcgcgcccccgcgggccccggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgagattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagaccacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttaccaggacggaattacactttctggcaatggtttgacggtgtgatggaagtgttaaaaaaacatctcaagcctcattggaatgatggggccattttggggtttgtaaacaagcaacaggcccatgacctactcattaacaagccagatgggaccttcctcctgagattcagtgactcagaaattggcggcatcaccattgcttggaagtttgattctcaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactgctaaagctgttgatggatacgtgaagccacagatcaagcaagtggtccctgagtttgtgaacgcatctgcagatgccgggggcggcagcgccacgtacatggaccaggccccctccccagctgtgtgtccccaggctcactataacatgtacccacagaaccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagcagaggggccacagacagaagctgtggtggtttttactttgtgcaaaaaggcagtgagtttcgtgaagcctggaagttggccatgtgtcttaagagtggctggactttgacatgtggctgtttgaataagagaaggacaaagggaggagaaagcacatgtgctccagtgagtcttcgtcactctgtctgccaagcaattgatatataaccgtgattgtctctgcttttcttctgaaatgtagataactgctttttgacaaagagagccttccctctcccccacccctgtgttcttgggtaggaatgggaaaaggggcaacctacaaagattgttggggcaagggaagtcacaagctttcggatgggcggtggcttttcacaaaacatttagctcatcttattctctctttgtcctctctcccctcctgcccgcccgcaccctggaattgccactcagttcctctgggtgtgcacatatgtttggagaaatagaggagagaaaagagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttacaaaaataacttctgaatttatcagtgttttgccgttaaaaatattcctctatagtaaattatttattggaagatgacttttttaaagctgccgtttgccttggcttggtttcatacactgatttatttttctatgccaggcagtagagtctctctgcctctgaggagcaggctacccgcatcccactcagcccctccctacccctcaagatttgatgaaaattccaaccatgaggatgggtgcatcggggaagggtgagaaggagagcctgcctgctcagggatccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccgtcctggctcactttgcagttggcactgggttggggaggaagagagctgatgagtgtggcttccctgagctggggtttccctgcttgtccagttgtgagctgtcctcggtgttaccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgtgtgagatgtgcaggttttttctagggggtagggggagactaaaatcgaatataacttaaaatgaaagtatactttttataatttttctttttaaaacttggtgaaattatttcagatacatattttagtgtcaaggcagattagttatttagccaccaaaaaaaagtattgtgtacaatttggggcctcaaatttgactctgcctcaaaaaaaagaaatatatcctatgcagagttacagtcacaaagttgtgtattttatgttacaataaagccttcctctgaagggaaaaaaaaaaaaaaaaaaatataaaaaaaatataaacaaatcacaacatattatattatcttttattaatataatatttcttcacttttttataatttattctatttctctttaatcaattatataattaattttatctctcattattctcgccctttttgttatttcttccataatgggggtgtttttataatatcgtctctgtgtttcatatgtctgtcttgggaaacacctttgttacc

SEQ ID NO: 216724 - DNA, 1091 bp, Homo sapiens
agccgggtgtcgccgtaaaagatatatccctcatatggccaaatcatatatggtgaacgagtgacttcttggtacaagctggcgctccgcctttggattggtatcatacactgaagttacatggtcctctagtgccaggcagtagagtacctcgtcctaggacctctggatgagagtctgggcattaactccgctagtccgcgaatcatttacctcctctcgctgatgtgtacatatttgatgaaaatacctaccaagatgatgggctgcttcggtgaaatgagtgtagaaaaggagagtcgtgtcatggtgctagggatccacggtctatgcagtgcatgcccgggacgttctgccaaagaagctatgatctagatgacataggtatctagtagcaccgcgacgcccctggatacagcaaccctggttggggggtcagacttgatacactttcaggttgggagtggacccaccccagggcctgctgaggacagagcagccaggccgtcctggctcactttgcagttggcactgggttggggaggaagagagctgatgagtgtggcttccctgagctggggtttccctgcttgtccagttgtgagctgtcctcggtgttaccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgtgtgagatgtgcaggttttttctagggggtagggggagactaaaatcgaatataacttaaaatgaaagtatactttttataatttttctttttaaaacttggtgaaattatttcagatacatattttagtgtcaaggcagattagttatttagccaccaaaaaaaagtattgtgtacaatttggggcctcaaatttgactctgcctcaaaaaaaagaaatatatcctatgcagagttacagtcacaaagttgtgtattttatgttacaataaagccttcctctgaaggga

SEQ ID NO: 216725 - DNA, 2031 bp, Homo sapiens
  misc_feature (914)..(914): n is a, c, g, or t
gcggcgcgcgtccctgggcctccgcgcgtgagcggcgcgcgcgcccccgcgggccccggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgagattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctgnccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttcccaggacggaattacgctctgtggcaatggtttgacggccccccattcctccccccactcatcccccttaccccgctactcctacctatttccccttttatactaataattttata

SEQ ID NO: 216726 - DNA, 5151 bp, Homo sapiens
  misc_feature (914)..(914): n is a, c, g, or t
gcggcgcgcgtccctgggcctccgcgcgtgagcggcgcgcgcgcccccgcgggccccggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgagattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctgnccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttaccaggacggaattacactttctggcaatggtttgacggtgtgatggaagtgttaaaaaaacatctcaagcctcattggaatgatggggccattttggggtttgtaaacaagcaacaggcccatgacctactcattaacaagccagatgggaccttcctcctgagattcagtgactcagaaattggcggcatcaccattgcttggaagtttgattctcaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactgctaaagctgttgatggatacgtgaagccacagatcaagcaagtggtccctgagtttgtgaacgcatctgcagatgccgggggcggcagcgccacgtacatggaccaggccccctccccagctgtgtgtccccaggctcactataacatgtacccacagaaccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagcagaggggccacagacagaagctgtggtggtttttactttgtgcaaaaaggcagtgagtttcgtgaagcctggaagttggccatgtgtcttaagagtggctggactttgacatgtggctgtttgaataagagaaggacaaagggaggagaaagcacatgtgctccagtgagtcttcgtcactctgtctgccaagcaattgatatataaccgtgattgtctctgcttttcttctgaaatgtagataactgctttttgacaaagagagccttccctctcccccacccctgtgttcttgggtaggaatgggaaaaggggcaacctacaaagattgttggggcaagggaagtcacaagctttcggatgggcggtggcttttcacaaaacatttagctcatcttattctctctttgtcctctctcccctcctgcccgcccgcaccctggaattgccactcagttcctctgggtgtgcacatatgtttggagaaatagaggagagaaaagagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttacaaaaataacttctgaatttatcagtgttttgccgttaaaaatattcctctatagtaaattatttattggaagatgacttttttaaagctgccgtttgccttggcttggtttcatacactgatttatttttctatgccaggcagtagagtctctctgcctctgaggagcaggctacccgcatcccactcagcccctccctacccctcaagatttgatgaaaattccaaccatgaggatgggtgcatcggggaagggtgagaaggagagcctgcctgctcagggatccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccgtcctggctcactttgcagttggcactgggttggggaggaagagagctgatgagtgtggcttccctgagctggggtttccctgcttgtccagttgtgagctgtcctcggtgttaccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgtgtgagatgtgcaggttttttctagggggtagggggagactaaaatcgaatataacttaaaatgaaagtatactttttataatttttctttttaaaacttggtgaaattatttcagatacatattttagtgtcaaggcagattagttatttagccaccaaaaaaaagtattgtgtacaatttggggcctcaaatttgactctgcctcaaaaaaaagaaatatatcctatgcagagttacagtcacaaagttgtgtattttatgttacaataaagccttcctctgaaggga

SEQ ID NO: 216727 - DNA, 4146 bp, Homo sapiens
  misc_feature (914)..(914): n is a, c, g, or t
gcggcgcgcgtccctgggcctccgcgcgtgagcggcgcgcgcgcccccgcgggccccggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgagattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctgnccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttaccaggacggaattacactttctggcaatggtttgacggtgtgatggaagtgttaaaaaaacatctcaagcctcattggaatgatggggccattttggggtttgtaaacaagcaacaggcccatgacctactcattaacaagccagatgggaccttcctcctgagattcagtgactcagaaattggcggcatcaccattgcttggaagtttgattctcaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactgctaaagctgttgatggatacgtgaagccacagatcaagcaagtggtccctgagtttgtgaacgcatctgcagatgccgggggcggcagcgccacgtacatggaccaggccccctccccagctgtgtgtccccaggctcactataacatgtacccacagaaccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagcagaggggccacagacagaagctgtggtggtttttactttgtgcaaaaaggcagtgagtttcgtgaagcctggaagttggccatgtgtcttaagagtggctggactttgacatgtggctgtttgaataagagaaggacaaagggaggagaaagcacatgtgctccagtgagtcttcgtcactctgtctgccaagcaattgatatataaccgtgattgtctctgcttttcttctgaaatgtagataactgctttttgacaaagagagccttccctctcccccacccctgtgttcttgggtaggaatgggaaaaggggcaacctacaaagattgttggggcaagggaagtcacaagctttcggatgggcggtggcttttcacaaaacatttagctcatcttattctctctttgtcctctctcccctcctgcccgcccgcaccctggaattgccactcagttcctctgggtgtgcacatatgtttggagaaatagaggagagaaaagagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttaaagaagaagaaatagaaagaaataaaaaaaaaggtg

SEQ ID NO: 216728 - DNA, 2330 bp, Homo sapiens
  misc_feature (914)..(914): n is a, c, g, or t
gcggcgcgcgtccctgggcctccgcgcgtgagcggcgcgcgcgcccccgcgggccccggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgagattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctgnccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttaccaggacggaattacactttctggcaatggtttgacggtgtgatggaagtgttaaaaaaacatctcaagcctcattggaatgatggggccattttggggtttgtaaacaagcaacaggcccatgacctactcattaacaagccagatgggaccttcctcctgagattcagtgactcagaaattggcggcatcaccattgcttggaagtttgattctcaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactgcttgatgggggatatctgataaccggg

SEQ ID NO: 216729 - DNA, 455 bp, Homo sapiens
atgataggaagggagcttggctgaggctgaatgttataagtagtaacaggggataccatctgctgaaggtgagagggaatggagacatggagagaatagaggaatgtgggcagtgtattagaggatatggcttaaatgatgagggagttgcggaccagagtcagggcccacttgaggtaagacatcacaagcatgtcacggccctagtgattacatgttgcaggaaatagttgtttggggatatggtttttttttggttgtttcagtctttctcccatcagatttgaccaactccacttaacttggtcaaatccaagtgagaattccaaattatgggtaacaaagcctctctaatttggctaaaattcctcacagctgcaaaagaggaaaacaaaacaatacaaaacaaacccaaaacactatgcacttggtttctgagtttgcttcctgtctca

SEQ ID NO: 216730 - DNA, 603 bp, Homo sapiens
catggtgaaaactgcatttaaattataaaataaccttttttatttgcatattttatactttttagaacactggcaagcatgcatgtcatggaaatttttatatacattaaatgtatcaggagatattaagatgaaattcctagttttcttatagtcacttaaaaattattttaatacataattaactccaagatatcttgtattagtcatgtagtacaactcaattatcaataagcacatcaatatcaatgtgatcacttgaaagttttggaaaaactttctctggtttggcctctggaaagcctggacatttatttgggtctcaggagattattttctggtaataacaaaaattacactaagatagaattatgagtatgtgttacctttcttgatttttttccttaaacttttcattttgacagaaatgtagattcacatgtagttgtaagaaataatacagagaggtcttgtgtaccctttatccagtttcacctgttttgcatgttgcaaaactatagtatgataacacaaccagcatactgacacagacacaatctaccaatcctattcaagtttttccagttttacttctatgtgtgt

SEQ ID NO: 216731 - DNA, 192 bp, Homo sapiens
acttgaagctgtaagaaaatgttaatttcctttgatctattagtattgctcttgagaatttaagaataaagaatttattaattctaaaaaggaaaagagctctaagtacaaagatatctatttattatttttttaatctcataccttcctgcacaccaaagatatttatagcaacattgcttaaaatagaaa

SEQ ID NO: 216732 - DNA, 590 bp, Homo sapiens
cttggtggcgggcgcctgtagtcccagatactcgggaggctgaggcaggagaatggcatgaacctgggaggtggagcttgtagtgagccgagattgtgccaccgcactccagcccgggcaacagggtgagacaccgtctccaaaaaaaaaaacaaaaaaagaaaataacagtacagctgactttctgtgccctctcccattcccacatccatttttctttcatattaggatataaacccttagaatcaaacctgcttccttatggtttaggaatgacagtaatgttcttagtctttgtagagattagcaattaaaaaataaaaaagtcaaagcaaacaaaatgacttttttactctattagcgttctgcaacaagagttaaggaccataaaagacatcggagggctaggcacagtggctcacgcctgtaatcccagtacttttcgaggctgaggtggatggattacttgaggtcaggagtttgagaccagcctggccaacatagtgaaatcccatctctactaaaaatacaaaaattagccgggtgtggtggcagatgcctgtaatcccagctactcaggaggctgaggc

SEQ ID NO: 216733 - DNA, 500 bp, Homo sapiens
ttcctcatgtatatgaaagatggagaagaccgttgtagaaattcatgttattagtattccaagcaaaagagctaaaggttggtctctcaaattcctacccctttgaagaccgatggataagattctttaagtttgctgcaggtgattaactatgcaagggctaaagacagcagaactcttgccaaagtagcgtgccacggtaattctgccatgacctatgtaagcagaaatggatggataaatagttgcagactatctacagatttccgtcttccaagtcttccaggcagaggctacaaaataaaatacccttaagagccaggcaggtaatgagaatgagtggtgcatgccgggggtttgcatagttaatattagcactattccttgcttccacaaaggcgctttctgcacttgctggtaaaacacacagtcctctgggtatatgttttgttttctcacattttgtagattcatgagcacagagaaatatttctgcacta

SEQ ID NO: 216734 - DNA, 307 bp, Homo sapiens
attgtatataaaggaacaaagactaggatgacagcggaattcccattagaaacaatgcaggcgtaaaggcataagaatgatataatggacttggggactctgggggaaggttgggaggggggtgaaggataaaagactacacattgggtaacgtgtatacttctcggtgacaggtgcaccaaaatctcagaaataaccactgaagaacttatccatataaccaaaaatcacctgctcccccaaaactattgaaataaaagaaacaatgcaggctgaaaacattgtaatgacaatctttgtaagtgca

SEQ ID NO: 216735 - DNA, 392 bp, Homo sapiens
tgcttagcactcaagataattagctcttgtagttgatgtgatgccaggaggctgctcctgctgaccattcttcctcctctacctgcctccctgaccccatccttccgctcacttcaactgatgtttacataaaccaatgggatggctacaatgcccgacatgtgctgtggctggaaagcgtctatagctagaaactcactggaaagatctattttagcacttgcttatgcataatatttaataatgacaaacataatttaaggggcaaaatattgatagaagaaaagggaaaaatttaaaaagtagccctactataatcaagttttttttgttcgtttgtttgtttgttcatttgtttgagatggagtctcgctctgtcacccaggctgaag

SEQ ID NO: 216736 - DNA, 705 bp, Homo sapiens
agagaatgcatttgtaaacatacctccttctctgttagcctcatttttatttctattaataggtacagatttttagaagtcttattacttcagggctgtgacagtgaagcagcaactgcaacaacaaattcttgccctgtatgcacctgtgccttacctttcccaaacatttttaggctttttcttctgttattcaactccatattctctagtcatatgtttctaaactttaaaaaaacctagtcttagaaacactcttcttgttatggaagatgagaatttaatactcttacaccaccagatattcctggcacctctttcttaatcatttcaattagtaataaatattttggttaactgctaagccaagtagtgtactataattgcattttctttttcggacaactttttgtttttttgtttttattgtagtttacagttcgttgttacatttgcctagatttcaaggcactgtctcttctttatctcatgtagaattgtcagatccttttgtttttcatataaattctaatactgtttcctccttcccactcccaggaaaaatcccccctggaacttttctgttctgaactggttgctctctaggcaattttgtctaccctttacttcacactgttgaatggatttcatttcttcctctttgttggtttggtaaagcaatttcttagtgctatcttagaaagg

SEQ ID NO: 216737 - DNA, 570 bp, Homo sapiens
atatgatccacttaattatgaaaaaaaatgaaaatcttaagcttgacctgttcacatcaagatagacctagttatagatgccacaagtaaatcatggtgggagggatggggagtgggaaaacagtatttgggagatatagccaccaacagcgatccaaccaagcaacccatatccttgcaaagttaacagtagtatctaccaatatccagagttccagcactggagatgcagacaaaaatgatatgcaaatatgcacacagatacaaatgacccttggggagggggtgggaaaaacaaacaaacaaaacagccctgggcgcagaggcaggatcccagtttaacaggaaatcagagctcacatctgtagcttgatgtatgtaacatatatgaagatgagatctcagacacaataaacgagacaggaccaactggaactggcacttaaggttgcaactaaagagtagcaagtatagcatttgaaagtagaaattcttgagtcattccttggtaatgtcaagaaaaacgtctggagcctgggcagtacctgaagatgggagtctgagaatgaa

SEQ ID NO: 216738 - DNA, 769 bp, Homo sapiens
cagcaggaaagggaaagatagaactacccattgttcctcttcatttcagtgcctatttagttgtctgtatatgtaggtagaaatgttggtagaatgtgcatgtatcaataagataaataaaagcagttgagttagttttatacaccacgagaaattttaaaataaaaaaaattttttaattggggggggggtgggggttctttggcccatttccccttaaagggggggttttaaaatttacgggcccgggttttaaaacggggggactgggaaaaccctggggttccccaatttaaatggtttggaaaaaaatccccttttcccaagtgggggaaaaagaaaaaggcccccaccgatccccctttccaaaaatttgccaaccctaatgggaaatggaaatttgaagccttaaattttttgtaaaaatccgggtaaattttttttaaaacaggttattttttaaccaaaaggcccaaatgcggaaaatccctttataattaaaaaaaaaaaccgcaataagggtggaggtttttcccggttgaaaccaaagtccccttttaaagaagggggccccaccctcaaagggggaaaaaccgctttttagggggagggcccctatcggaaccctccccctattaaagtttttgggggcagggggcccaaaacccttaatatgaacccctaaaggggcccccctttttaaattttccgggaaaacccccaaactggcaaaggggggacccaaggggccccccctagcccctttcct

SEQ ID NO: 216739 - DNA, 581 bp, Homo sapiens
agtgctgctaaggtcatgaatctgtctgtggctctgtccaggttctctgtcctgtccacaagcctccatccctgctccagggccacactgccttaattgttggagctttctaacaagactcctaatctggaagggtgtgtcttccagttttgtccttcaggatagtctcagatatcatcccttcacctttggagatgcacgttagaattgatttcctgatttatacacactatccccccaaaaccattttttttcttctggaatattgactgggattgattatagatctattttgagagaatggacatttaaaaaatttgaagccttcctaggcacaaacatgatcatttctccatttactgagaactttttctagaattttcggggtagtacttttgtttagaggtcttgcacattttttgttagatttactgatgcatttttttttggatgctgttgcaaagtatttctctttaagtttttgtattattatggataaagctgctatgaacatatatgtaccgggttgggtgtgaacctaagtcttcatttctctgggataaatgcccaggatgcatttc

SEQ ID NO: 216740 - DNA, 272 bp, Homo sapiens
ctccttctctgaaccactgctaacaggctctcaccttttgcgtctacttttctctctctttctaaaattccattataatcatgtaagcacttgaagatcccccttcttttacctagccaagcaaaccactctaagaattccctttccatcactgacttcatcagtttctttccctctgctgaatcattcacatatattcatatatctgctggatatatcagcacacaaatatgctcgcttgagagcatttctatcatatttctgacttcccc

SEQ ID NO: 216741 - DNA, 618 bp, Homo sapiens
cgtggtgactcacgcctgtaatcgcagcactttgggaggccgagacaggcggatcacgaggtcaggagatcgagaccgtcctggctaacacaatgaaaccctgtctctactaaaaatacaaaaaaattagctgggcatagtggcaggtgcctgtattcccagctactcgggaagctgaggcaggagaaaggcatgaacctgggaggcagagcttgcagtgacctgagatcgcaccactgcactctgtctggcctgggcgactgattgagactctgtctcaaaaaattggtatgcacacctggcaatgtttgctgaatgcctagggtgcagtatgggtagtggcaaagtgttaggtctccgagggagattgcctgggtttgaatcctggttttgccacttgccagctgtgtgaccatagcagctacttaacctcactaagccttcatttcttcatttttcttttctttttcttttttgagacagggtcccgctccatcacccaggctggagtgcagtggcttgatcttggctcagtgcaacctctgtcctctgggctcaagcagtcctcccacctcagcctcgcaagtagctgggaccacaggtgtgcaacaccatgcc

SEQ ID NO: 216742 - DNA, 947 bp, Homo sapiens
cctgaagcagagactttaagggtgggtgcagcaatgtggtctaacaagccctgcaagtgatctggaggcccaagttagagaacagctgctttagaggaagacctgtcacagtcccacctattcccatctgttcccatcctatagcagctcagacgccctcggtgtcatagatcttttccgatcatgccctacataccactgatgtcccctttcccctgtagccacaaaatgcatagtgactcaacactccttttggcaattagtcacatactgccttgtccctaacagatgaatatagtgatcattccgtaaactatttatttatttaagatggagtttcgctcctttacccaggctggagtgcagtggcacgatctcagctcactgtaacctccgcctccctggtccaagcaattctcctgcctcagcctcctgtgtagctgggactacatatggtggcctggctaatttttgtatccttagtagagatggggtttcaccttgttggtcaggctggtctcaaactcctaacctcaggtgttccacccgtcctggccttccaaagtgctgggattacaggtatgagccacctcacgaggcccagtaaacatttatttaatcagccacaaataaatgaagttgcaaaactggagtgacaaggacagccaggaaaatatttaacttcggtaatctttacaatgcttcaagtaggtcctgtggaagaacacttatttgctatgatgtagaggctgatgcaggaagaaaaaagtggtaatatttataagcttttcaagaccattcgtttaaataagaatagcagaagcagctcccctttcccaagcacatactctccatcaggcactgtgtgccttccaaacaccatactattatcttccccattttgacaatgaggaaattgaggattagagaacttaagacgattgttg

SEQ ID NO: 216743 - DNA, 260 bp, Homo sapiens
ttactatccctagccaaggaatctcacctacactcagaattacctatttgacacgcctacttcagtgcttaggacacttctcagattcagcatattttaaactagtctcctgattatgccccttcaacattcctgacttacactgccgccagctatcttccccttccagatgttcatgcaaaaatcttacaggcattcttgaccccattctttttctctcaccctacatccaatgcatcaacatcctgttaggtctatcc

SEQ ID NO: 216744 - DNA, 872 bp, Homo sapiens
aggtaaaaaaaaaataatacatttttacattgtaaagtattaaatattttacctctattcctattgacatgcctacatgcatatttaaccatatcagaacaacttaagttttcataaagctatcttttgtgtaggacaagtatatcaaagaagcacatctcagaatttttacttgtaattatttcataattcttactgctggaatatttttctcagttttctcctttttattaaaccaagttaaaagatagttgaaatttgaaattatactattttcctgttgttgtcttctcagaggaacatcttgagggcccagtttatctgtagttcatactagatacttgctgatagtgtcattgtagatgtcttcaccttatctatccaatgttcttgtagaatatatcagctgcagctctttcctccccaaataacaaacataaacccttaaacaccgaaattttgtttcaccaaaacttttcaaaaagattataatactattctagaacttgaaatcatattctctgctcttaaaaatatataaaatacaataataaggacccaggattgttaggaaatcagttatgtgccactggattatatagcagtttttgtgccttctctcctgtgttggcagcagccattgcagttttcacaatgccttcctcctctgctcctaatataccagagactaaaataaaataatggaaatgttactaatacattaaccaatatgctttgaatatggtctagggccatgtaaattttcttgcacttaggctctaaaaccttgttttcttttttgtgtgttccagactgtcttccatgttagggaatcgtctggtttaacattaaataaaatgttaatctgttaa

SEQ ID NO: 216745 - DNA, 345 bp, Homo sapiens
gccaggcgtgatggctcatgcctgtaatcacagcactttgggagcctgtaatcacagcactttgggaagccgaggcgggcacatggcctgaggtcaggagttcgagaccagcgtggccaacatggtgacactccatctgtactaaaaatacaaaaaattagctgggtgtggtggtggaagcctgtaatcccagctactcgggaggctgagataggaagattgcttgaacccaggaaaaggaggttgcagtgagctgagatcgcgccacggtatgccagcctgagtgacagagtgaaactctgtctcaaaaaaaaaagaaagaaagtaggaagatcactgaataaa

SEQ ID NO: 216746 - DNA, 186 bp, Homo sapiens
agagcccagctttgagatgcctggtctctcctgatgcttccctttgattccacaaaagggagggcccggtggctgctgaatggtacagtctgaggcgatgacagaggctgcaggtctctgccagcattggagaccctcagacacagtgtggctggtgaccactggaggaggcagggttcaggttcc

SEQ ID NO: 216747 - DNA, 375 bp, Homo sapiens
ctgctcagggtggatggatataggtaggtgtgagttttccgcagagggttgctggcttcgggtgggtgagactaagaccagtgggaaagtgtgtcaagtgggaatcagatccgtgtttggggtgggcgcggggtcacggctaggcctccgcaaatgaaactgaagatttgtaaacgctccctggcccatctcctagttggcttccccgaccaccgtccacaccaggcggcccaccccgctcctccctactcccagccagcctggaattcagcctcctctcccaggcttcctgcccaggagaagggggtggatctcaggagtgtgggcaggagcagtggggtgccccggcccctccctccccttccccggcggccg

SEQ ID NO: 216748 - DNA, 620 bp, Homo sapiens
agatgctcagcaccattaatctttagggaaatgcaagtcaaaaccacaatgagataccacttcacatctactagatggctagaataaaatctaaaaatagataataagtgttagtaaggatgcagagaaattggaactctcatacactgctggtgggaatgtgagatgttgcagccactttggtttgtttttgattttcgttttttgagagacagggtcttgttccacacccaggtcaaaatgccacggtgcagcatggcttactgcatccttaaactcctgggctccagtgattctctcacctcagcctcttgagtagctgggaccacagtgcccagctaattttttttatttttatttttgtagagatagagtctcactctgttgcccagcctggtctcaaactcctgggcttaaagaatcctcctgctttggcctcctaaaatgctgggattacaggtgtgagcaattatgcctggccccagtgtagctgcttcggaagacagtcttgcatttcctcaaaatgttaaatgcagacttaaccatatgacccaggaattccacttctgggtatttacacaagagaaagaaaacatgtccatatagaaacttgtacatga

SEQ ID NO: 216749 - DNA, 240 bp, Homo sapiens
ggggctgggggggcagtggggagtgactgtgaatgtggacagtttccatcttgtaagatgaaaagtgtcctggagctggatggagggcgatggttgcactacaccgcagatatccttaatgccactgaagtgtgcacctaaacatgctgaagacggtgaattttatgtgatatctattttaccacaactaaaatgatttttcaagcattgctgtaaacggtactttgcagactcatttct

SEQ ID NO: 216750 - DNA, 493 bp, Homo sapiens
cacccaggctggagtgcagcggcgcgatctcgactcactgcaagctccgcctcccgggttcacgccgttctcctgcctcagcctcccgagtagctgggactacaggcgcccgccaccacgcctggctaatttctttttgtatttttagtagagacggggtttcactgtgttagccaggatggtctcgatctcctgacctcatgatctgcccgccttggcctcccaaagtgctgggattacaggcgtgagccaccacgcccggctaaattattattaatttttattttacagcagtccagagtagtcgagtattctgtaacaaaataacagggttacttattttggatagtagagggtttctagcacaaagtaggtgcttaataaatattggttgagtgttaagtgaatggtggacctgtttggttacacacatgcacacacggagaaagaaaacatagctgagctctcattgctgctgatgaactaccatttt

SEQ ID NO: 216751 - DNA, 387 bp, Homo sapiens
cgtttttgctgcgtcacagggagacagaagatgggctgctatttcgtcggctaaatgctatcattttaagcaccgttccaaagaaaacagggatcttgccagaggaaaataacatataccataaaggaaaaagaaatgtgcatcaaggcaaataaacagctctctactaagggcctaggatcttgctagacgagtcatttctctggttgaaaagcagttgagaaaggcaagacaaggggggcgggggcccagcagggcacctctgagcccttcctgctgctcttcaaagacagacgcattttcctttctacggtctccttgcaagtcttctgtaggccctgccaccttcaggctgactgactgcctccttcaaatatcagcatttgg

SEQ ID NO: 216752 - DNA, 596 bp, Homo sapiens
gtcccaaaaaggtagaggaactcacattcagaacctggtggtctctttgagctgaggaaacaaatatcagattttgagaggtcgaagtatctagacagaatacatgctgcagagtaccaaaaaatagggagctgtacagacagagagagatggaggtcttcagagtttcctcaagtttttgtctgagtgtgatgtgtacaaccaaaagcagaaactatacaatctggggaaacaactaccaaaatggggagacataaaaatttccaaaactcacacaagtaaggcctcataagacatgcggcatagagtaaagttcacagaagtctatcatcttcatggtagggtttaattacactaaatgccaagagcaaagacttcaaagcagaccacaattaatccaagtaacttaactgtataaaaaaccatatgcaaaattattattaaaacataataaaatccttcacataaaaggtaaaaatcacaatgccttggatctcatcaaatgttacaaaacatgcaaaatatcagaaagtatgatccataattattagaggaaaagtcaagtcgtgatgaaaacagagccacaaatgactaag

SEQ ID NO: 216753 - DNA, 440 bp, Homo sapiens
ccgcctactactactaaattcgcgggcgcgtctacattctgtgtggctgactgctgcaactttagttcatctgtcttaaaatgaaaaggggcacaataatatttttttctttactgagacaggttctcactgttgcctgaaccacgagtgcagtggcacaatcaccactcactgcagccttgacttccgggttcaagccatcctctcacctcagcttcctgagtagttgggactacagttgcatgccaccatgcctggctaatttttgtggttttgtttttgttttgtttttgagatggagtcttgctctgttgcccaggctgaggcaggagaatcgcttgagcctgggaggcggaggttgtggtgggccaggatcacgctactttactccagtctgggcgatggaatgagacacagtctcaaaaaaaaaaaaaaaatcc

SEQ ID NO: 216754 - DNA, 1207 bp, Homo sapiens
cgcggtggcttgtgcctgtaatcccagcactgcgggaggctgaggcaggcagatcacctgtggtcggaggttcgagaccagcctgaccaacatggataaactccatctctactaaaaatacaaaattagccgggtgtggtggtgcatgcctgtaatcccagctactcaggaggctgaggcaggagaatcacttgaacccgggaggctgaggttacggcgagccaaaatcatgccattgcactccagcctgggcaataagagcgaaactccatctcaaaaaatacatttaatgcaaaactacataatttacagcagttttttatgctctccattttcttaatatttaaaataccgtaaagaatctttacaattagtaagtatcttgatggtagtccttaaagggaagtaaaatacaagttaaagctggtaacaaaataatctcaaatacgaaataattttgttacccataaagttaataggatagagcacatgaagaaatgcagacctgacaagtccccccttatctgcagtttcactttccacagtttcaactgcctagagtcaactacggtctgaaaatattaaatggaaaattccaatcttgacccctccaattcaatctggccaagacattaatcaatccctttttcgacctattcatgccgaaatttggcccaccagccattaggcactaggggccatttaagtttaaaatggacgtcaaggatacaagggcttgggttaaggaccttaatggccttaaaaatggcctaaaggcacaagagtaggatgctagcacttggaagtgcaaaaacaaagggtggttatcccactgggactttaaaaaggttgccaaggggttaagcctgaacccggcactttggagggttggccaggagactttgacccgggttaggcccctttcgcaaaggccgacctgtcaaaaaattttaaaaactcggggggtggcacctatgcctactatgggggttaacagggaactttccccccatgggtcctgagaaaatggccctcgtcccacgggaaaaatttctttcaaaatcgcacattttacttcggggcggtgttcccttccacactccgcggggcggaatctcgggatgtgccacccacacgacgcacccttctctatctcactcatacgcgcgggtgctctcttctcgcggggggtgcgcaccccacaccc

SEQ ID NO: 216755 - DNA, 848 bp, Homo sapiens
ttggccaggctaatctcgaactcctgacctcgtgatctgcccacctcagcctcccaaagtgctgagattacaggcgtgagccaccacgcctggccttgaatttatttaaaaaaaaaaaaagtattataaacccagtatctacaagaaaaaaaaaattgtcagacttctcacatttgacatgacagtataaaaagattaacaaattatctttcagtacagctgtataaacctatttcagtgctctggaattcaaccaaaggcataaaacaaactgggagcatttatttattaagttactgaacttcaggcagaaatggtggttttcagttttgagctgctaccagactcctgcccttcccccaacgccagctctgtgggtattagtttaagcagggcatgctgctgcctgagaggactcgttggatttggagtgttgtcaagttaacggggcaaacacggaagactagtggcagactggtggattaggccagggatgtaacaggtagttgtaggaggtgagacagccacaagaagcttgaaaagctctccccaaattggttgactctagacgatacacacacatataagagactggaacacactcaagccactcatacatccttggccatcagaagctgcacatacagagatttcaagagaatctggcagagagcaaaagccagggaagaattgaaaatggcctgaagtaagaatgcacttccagctcacatacagatccattagcagagagctgaaagtttactggctcgaggtgtttaactataatctcttaccaatctgactgatccctaaataatggagacagagaacccaaggaagccaagctt

SEQ ID NO: 216756 - DNA, 887 bp, Homo sapiens
gtatacagggcagggagaagctgtttatttccgtgcctgcggctggagcttcttaaggatttgagctgtgatgctggcacctggcagaccacatcctgtgcggttttcagttttgctccgttcctgaccctggtatagcagaagctttttcacatctatgacacccgctatgtcttggtaaaccctggaagggaaaggaggacaaggttaaaatactgttccgaggatctggtctctccacagcgcaggctggaggtggcagcccgtggaaagccaagttcatccaccatcggagcccaggccaggctgccaaggctaatattcaggacaaagccaggcacaggtcgggaatcctatgaagatgatcatcgtcctgaggtcttccttccagggttgcatccgcgacagaagatggaaagagaaatgggtgagtccctgctaccaccccaccctcaggttgcttttttggctgaacaagaagggtcctcccaggcaggaagggtggggcacagaaacgtgagccaatgtggatgacttggggagggctttgcagttgaatctcctgaaaacagcaagaagtacagacctccgggcattctagactcagattctgtagacgcttccctttggccgagccaagccagggttgctcaggaactggggtccttgagattggattagattggacggaacgacacaggattgcaacgtgctgaactgtgaggaccggggtttagcttgagttccccagtctgtccacgaggtccaagcttgagatcattacggcgaccacatctcaggaggaagataggtcagcaacgcagtgacgtgctggaatagttttgaaatatttgaactattctaatgcaaactcttcttttaatgac

SEQ ID NO: 216757 - DNA, 370 bp, Homo sapiens
atgtactgttccatctggaagtcaagtttggtgccacctaagtgggttcctgctgcaaggaactgaaggacatcctcctccttcatttgcaggacatcaggggctccagacattgcgaaagtttccctttaagttacgacgggaatccagaacaacgctgtatggacacctctgtaggtagtgcggaaaagcgtaattttatttatataaagtgcaaaaaaccatgcaaaaccaagtcatacattgtttatggatacatatatgtattatacaaatttatataaaatcaaaggaagaattagtgaaagataatggccacctccaggggacagggaagagtgtacacacataaataaaatggatacatggg

SEQ ID NO: 216758 - DNA, 262 bp, Homo sapiens
tgggtggacctgaacttggacactcccctaccccaaagcttggccagactctggcacggactccgaccccagccagacactgactctgatcctggaccctaccccgctcctggctggcactgacgtgactctagtcctgaccccaagctggtgcggacgctgacccagacctcagatggatgctggtactgacctccaccctatctttactggaaccaaaataactgccctggtcctgaccctggacttgggctggatgttg

SEQ ID NO: 216759 - DNA, 494 bp, Homo sapiens
aagcttcttccttaaaactataaaacaatcctactccaagcatatattttaaccatatggtacaactattaatacttcaaatgagttgactatacagacaatgacattactctcatccagtgcagatcagattttctcccaatataacttccagctactggtgaaaaaaaatgcaacctctaaaaacactgttcaagtgggtttggtgggttttctgctttgagaactctaacagtttacaatgtctggtatcagactccagttcctcaaaactacagaacttgtgagaacctccaatcagggtggttacctgaatggctttggtctggtgcaaatcctctttggtgtgtcccccaccttgcctctgggcccacagtcttacctactttgacgtatctgtttcttgcttcttaaaaactacattgacaactgattttaattgacttccaagtatttaaaaacatacttaaggagggatgagaaggagggatgag

SEQ ID NO: 216760 - DNA, 468 bp, Homo sapiens
agacgggggaaggattacaaggcaggtgagcgacgaatgaccatgatgtacgacgagtttcgagtaggattccgtatagggagagttgggacggcctgcaggaccggctcgggtattccggggtcgactactactactactatatttgcggccgcgtcgaccacacgtctgtaatcccagctactcaggaggctgaggaaggagaatcgcttgtacccaggaggcggttacagtgagccgagatcatgtcactgcactccagcctgggtgacagagcaagactccatctcaaaaaataaaataaaataagctgaatgaattgagtgccgaactgaagagtgagacagtgactagggatgaagggagaggaaaaaacaagaaacaacccaacaagcgaggcctccctgcatagagggagaagggatgtgttcgaatgagaagaagcagagcaaggttttgaatcacagg

SEQ ID NO: 216761 - DNA, 483 bp, Homo sapiens
attaattaatttttttagaaacagggtctcactgtgttgcccagacttaactcctagaatcttatatatgaggactcatacaatatatattcttttatatctggcttcttcaactcagcatagtgattttgagatttatatttattgttggatgtgtgagtagcttgtttcttttattgctgaatagtattctagcatatggaaataccacagtctgtccattcatttgttgatgaacatttgggttgcttgcagtttgagactactacaagtaaagtgctatgaacattagtgtatgattctttgtatgaacataatgctttcatttttcttggatgaatacgtagatggaatgactgtgtcatattgaaggtgtatatttaactttttaaagtggctttgcacaagtgtataggaattcatttgcactgtattctcaccagcccttggtatggtcatttacagtatttttttagccatctg

SEQ ID NO: 216762 - DNA, 552 bp, Homo sapiens
tgtagggataatctataatgaggcttgatgtctttcttcaatttgcacagtccagcagaaatcaatgaaatttgtgaattgggaaatggaaaaatccctgtattttccctcttaggcctctcggcccatgatgagaggggctgccatgaaggtctttgacatgttctggagacattttccctattgtcattacatatgcaaatttctgcagtaagctagaatttctccccagaaaatggggttttcttttctgtcttttttttttttttttttttttttgcctaaatcaacacatctttattaaacacctgcagttactgggaggaggcgatgatgctggacacactgtcaaagtcaatcttctctagagtattctagggtttaatgctctcttcctggttacagatgaagatcggccctgactcgttagcgctccagccatatttgctcatctacacctttagctggctggctaacagatcaccaaacattttaccaagcagccagcatcccatgtgctggtaagtgatacccatgacatggcagataaac

SEQ ID NO: 216763 - DNA, 318 bp, Homo sapiens
gaagttcttgttctcagaaatctagtctagattataatttcagtatgattactctattttgataacatatttagatgacaaaagcatagagttgtgacaaggcaaaataaaaatttattagcagttacgagtaaagaatagtttcaagcaaacataaattttagccttttcatgactgcaggtcctaagataactgaatacatatatgtcttcttttcccactgggtgtttattgaatgcctgttatgtgcctggcactgttctacatggtgagactatagcaatgagcaagacaggtgggatctctgttctcatgga

SEQ ID NO: 216764 - DNA, 478 bp, Homo sapiens
atagccttcattttctgccatgccccttcataagggagaaggatgtttgtaccatgatcctccccgcataatctatggaattaggagtcctgtgtggagtcttatcaataaatatgcacattcatcaaatgtctacttaaatgtgagtattctaccagtgagaaaaaacacataattttcaaggtaatcattgttaaaccaacagcaaacttttgtctttttcagcgccataaagtccagaagacagtagaaaagtatcttcaaagtgctgaggaaaataagtatcaacttagaattttatgtacaatattggaggcaaaataaagacatgtttagacatacaaaactaagagagttgaattattaaaggttatattccaaggacaaaaaagaggatctgcccaaggtgaaggtatggcatacaagaaacaatggtcaacagagaaataaaatatatggatgaatatatggataaatt

SEQ ID NO: 216765 - DNA, 773 bp, Homo sapiens
tgcgtgggcaagatttcataaagaaaaccttaaaagccggcaacagaagcagaaatagacaaatgagattatatcaaactaaaaagcttcggcacagccaaaggaacaaccaacagactgaagagacaaccaacagaatgggagaatgtatacgtaaactaatcatctgacaaattattaagatccagaatatacaaggaactcaaacaacaacaaaaaaagaggcagcatagacttcagaaaggtgggtctgggaaaaatgaatcatatacctctccagtggtctcagacaccccaacatagataccatcagatcccctaaacacaggcacccaggcaggtgccatcagatacccaaaacaggcttccaggtaacccccaaatatgtcagacactccacataggtccagcagatacccccaaacacatactagataaccccaatacagatgctgtcagataccctcaaacaggtgctcagagtctgaaacacataccataccctcccctatccacttccacacaggtgctatttggcagatgtggataggccagatgcttcccccagcaccagcaacctctcaattgccatcagacaccccagtcttgaggttgcctgtctaatccaagtcctgccacaggggaggcagttgaacagtaaccaggagtcgagcagaacagctctcaccaaggttggctggtcagccaggcctagaagatctccccatggccaggcaagacggctcatgcctgtaatcctaacactttgggag

SEQ ID NO: 216766 - DNA, 711 bp, Homo sapiens
gtgaaagcagcctgctgaggaagagactccgggaggatcccgaggacaccccagtgcagccatgttgagactgacgctgaggaggaccccaactgtcacgagcaacacctgtcgaacacagccacccacctggggacagatcaagaagctgtcacagatggcagaagaaaacctgaggaaaggtgggtctgggaaaaatgaatcatatacctctccagtggtctcagacaccccaacatagataccatcagatcccctaaacacaggcacccaggcaggtgccatcagatacccaaaacaggcttccaggtaacccccaaatatgtcagacactccacataggtccagcagatacccccaaacacatactagataaccccaatacagatgctgtcagataccctcaaacaggtgctcagagtctgaaacacataccataccctcccctatccacttccacacaggtgctatttggcagatgtggataggccagatgcttcccccagcaccagcaacctctcaattgccatcagacaccccagtcttgaggttgcctgtctaatccaagtcctgccacaggggaggcagttgaacagtaaccaggagtcgagcagaacagctctcaccaaggttggctggtcagccaggcctagaagatctccccatggccaggcaagacggctcatgcctgtaatcctaacactttgggag

SEQ ID NO: 216767 - DNA, 420 bp, Homo sapiens
ccataccactcaaaaacctattgttggtggctttcttttattttgttcaattagaaatgggatgatattatatatactattttttatgcatattgcctgtttccatcttcatgtgttatgaacatttccttatgtcattaactattcctgatagttcttgataactaatcatattcctgataacatgatttttaaaggctgcatggaactcagtctcaggtcgagatggtttataaatcccctggtggacttttcattccttttgtaaattgctattataaatagtattttggtgaatatatatctaatcatttttgcatacatatctgtttctgcaagatacagaaaaattttcactgttttgcacccctaccagcaaaatataaaaatatctgtttcttcacatatttatcatcatga

SEQ ID NO: 216768 - DNA, 306 bp, Homo sapiens
tcaaaaagacaatccttaattaaatctaagttttaaactacatggtttctaaaatatagaaccaaaacgatgaaattaaaatatacaaagaaggaaacctatatgcacattatgtataataaccaccaacatcattatttaccaagcatctacttactaccaggcaccatactagagttttcatatattatttctaataccgagcaccatactagtgacttcatatataatttataaacttcacaacagacagctaaagaaattaggactcagaaaggttgaataattctcccagagccacacagg

SEQ ID NO: 216769 - DNA, 688 bp, Homo sapiens
ctgatttgaggttttaaatgacaaacagcagaaccttcgctgtttttaatcttaacttttaaattattttcaacacctcagcaatctactgattagcatccatagtcaaaaagtaaagatcctctttccagaaaaatgtacatatatagaagattttgccagcagtttcaggatgttcacagaccctctaaaactttcaagagactttatggatttcagattaagaatgacgagaatttgggccgggcacagtggctcacgcctgtcatcccagcatccaagaacatgggccataaggaagcagtaacagttacatcacaagcggctacttatttcacaacatcatcgcccagtctattaaattaatgttggtagtcagaactttattggttttgtagtttggtttgaaattaatttataaactgccttttatagctgcattagggatataagcacacaaattatacctaatttgtgtattggggaagggaggaaattaagtaatatagaagaacacaaaaactatttttgaagtaaacatactcaagtttcaaaaacatgaaagaccctggaactgcatcagaagttccacatcctcaacgtaagcaacataaggaggagaccctgtctttacacttctttagcaggccatgtggcccctgccttgagttccaagttctggggtcct

SEQ ID NO: 216770 - DNA, 456 bp, Homo sapiens
gcctttccagcctctgctttgggaaatgcagactgggaaggaaggatcaagcctactcagaaacacaagccgaggtataagacgagctccttgcaataaaaagcaacaacatgatggaagaaagttgagctcagaactcagtgacatccgagctcaaataccaccttctccacttaattacttttgtctccgtagacagattatacaaatttcctgaccttccttatctgagaaattgtgagagtcctgccttgcagggcgggtgtgagaattaaaagcatgggacatacctagcatagcccttgacacatagtgaacattcatttgtcacctccctcttaaaggaaataactatcttttattctctgtatcccttctattatctcccacacaatagtacctcaataaacatttgttaaataaataaataaatagctccacttctcagccaagtgg

SEQ ID NO: 216771 - DNA, 407 bp, Homo sapiens
gtgagggtgtatcaatcagacctaggatgcagccaaatgggctggctcagccaggtttctagaacacagatgctggaaggagactgtggtggttgtgaatgttaccctgcaaggaatagtctttggagatatgattaggttaaggattctgagatggcagattatcctgagttatccagatgggacctaaatgagatcacatgtattcttataaggcagagacagaggaagacttaacacaaacagaggggaagaaaagagcagagagatttgaagatgctggtcttgaagctggagtgatgtggctacaagcaaaagagtgccagcatccacctgaggctggaagaggcgaggaacagatattttcctagagcctccggagggagctcgggcctaccaataccttg

SEQ ID NO: 216772 - DNA, 426 bp, Homo sapiens
gctgagttgaaggcctgccgggaccaggaggaggagtataagtccaagtatgaggaggaggcccacaggcgcgccacacttgagaacgactttgtggtcctcaagaaggatgtggatgcggttttcctgagcaagatggagttggagggcaagctggaggctctgagagagtacctctacttcttgaagcatctgaatgaagaagtgaggctcaaccaaagggcaggctgcagccaagagagaggactgggtgggcaggcttcctgtggccatgaggagaatggccaagaggggaagtctgttagggtggcttagattctgggtcattcagtcacttgacaaccaattactgaaaacttactatgtgaattgctaggtcctggggatacatcaatgaataaccaggtcgacgcggccgcgcattta

SEQ ID NO: 216773 - DNA, 389 bp, Homo sapiens
tcagagcctccagaaggaaccaacccagccaatacattcattttggacttcaggcctccagaactgtgagaaaacaaacttctgttgtttgaagccacccagtttgtggtgacttgctatggcagccctaggaatctatttcatcctaagagagagggaaaggacaagaggaggaggagggagggcaagggaagggaaaagcagggggagagaaatgggtccggagtgggggaatgaagagtaagtgtgtgcagagaaagtgaaagagtttagttggttatagtgctccccgccaaggtatgttcacccagaacctcggaataagaccttatttggtgcacacttactaagaaccaggaagaaaaaaaagaaaataacaaatttaaaaa

SEQ ID NO: 216774 - DNA, 289 bp, Homo sapiens
gcaaagcccagttttcttcatcgcatatctttgttttcttcaagtatccccttacttaatgttggtagtattttttttaatgaaatataaatccctaaccaccaagcaagaaatgagactcttaattgcatcagtttacagtgcaatgtgagtgtaaatagtgtaaattgaatttttaatggacttttttttttcccgtttttgcttgccttacattcattatccctccctgggtaataaacatttatttttccctttgtaaccactcctccccttctgtcgtcttctc

SEQ ID NO: 216775 - DNA, 309 bp, Homo sapiens
taaatctccgtttaggccccatctaagagatccaggccttggagcaacactgcgcccagtatggggaggacgcaggcttcggtggctgagcttctgctctgctggtattggccatgggtttgcactcagcctctccaagctcagggttccgctctgtaaaatggggtaacgtttactttctttcttttttttttttttttttttttttttgagatggagtctcgctctgtctcccaggagaattacttgaacccaggaggcagaggttgcggtcagccaagattacaccattgcactccaggtcgacgc

SEQ ID NO: 216776 - DNA, 638 bp, Homo sapiens
gatatagcaagtgctcaacaaacgttagccacttccatgatgatggaggaggagaagggggaggaggagggaaaaagaagaagatatgcaaagcatagcaatagttgactttcaacaaaggttactccctttcctctttcctattccattattggttgggggaaagcttcatttacccattctagggtcaaaccccattacaataaaattattgcccaacttcccctgctgaatgggaaccttcttatattaaattttggtaagaattacctacattataaataattcaggttacttaattcaatatgtttgacaatgtataggcataactcttagaaaaatagatcatgtaaacactgtcagattatttccccacactttctttttcttgccagcaccattataaaattatagagggcttccatatatcgggacctgcatcatgcaaaaatggttggggtggagtgggagtagaggttccaaacttctagtggctttatggagaaagcctcactgtccctattacctgaactcttacctctgaggtggttgggttttgtttgtttgtttgtttgtttttggttttggtttttttcgagacatggtctcactctgtaacccaggctggagagcaatgg

SEQ ID NO: 216777 - DNA, 549 bp, Homo sapiens
gttagtttgctgaggatgctggcttccagctccatccatttctccctgcgaaggacatgatcgcgttcctttttatggctgcacagtattccatggtgtatatgtgccgcattttctttattcagtctatcactgataggcatttgggtcatttaactttatttttaagctgtttgaaaatatttagaccctaaagaccttttcttttttacatttttaatacgaattaaagtgcttagccttgatccattgcacctccaccccatctcccactcaccctgtctcccaggcacagttgctgcttgagtcgctccaggcccagctgccaggtggacagtcccagactctcaaagcctttgttctgggacgggtgcggtggctcacgcctctaatcccagcactttgggaggctaaggcaggtggatcacctgaggtcaggagattgaggctgcagggagctgtcatcccaccaccgcactgcagcctggtgggcaatagaatgagacctgcctcaaaaaaaagctaaatggatatgacttaagaaactga

SEQ ID NO: 216778 - DNA, 664 bp, Homo sapiens
gttagtttgctgaggatgctggcttccagctccatccatttctccctgcgaaggacatgatcgcgttcctttttatggctgcacagtattccatggtgtatatgtgccgcattttctttattcagtctatcactgataggcatttgggtcatttaactttatttttaagctgtttgaaaatatttagaccctaaagaccttttcttttttacatttttaatacgaattaaagtgcttagccttgatccattgcacctccaccccatctcccactcaccctgtctcccaggcacagttgctgcttgagtcgctccaggcccagctgccaggtggacagtcccagactctcaaagcctttgttctgggacgggtgcggtggctcacgcctctaatcccagcactttgggaggctaaggcaggtggatcacctgaggtcaggagctcgagaccagcctggcccacatggcaaaaccccgtctctactaaaaatacaaaaaaaattagctgggcatggtggtgggcgcctgtaattccagctactcgggaggctgaggcaggagaatcgcttgaacccaggaggcggaggttgcagtgagctgagattgcgccatggcactccagactgggcaacaagggagaaactctgtctcaaaaaaagaaaaac

SEQ ID NO: 216779 - DNA, 259 bp, Homo sapiens
tggtagagatggggtttcaccatgttgcccagctagtcttgaactcctggactcatgcagtttacccaccttggcctccaaaagtttggcttttggtttttttgccccatggatattgacagtataacatttaacagtgacattttctcatttgtttgtgtcatatacctaaaagtatctgtgtattataaacatcaactgcttatatacaatttacagatattaaagaaaattttttttttttttttttttgagacgg

SEQ ID NO: 216780 - DNA, 104 bp, Homo sapiens
tgtagaaggtggtgcctttttattgcagtttatctgtttgtctctcattctctctggacaagcttgtcctttcctttgtctgcgcatccttcggtctctgcatc

SEQ ID NO: 216781 - DNA, 394 bp, Homo sapiens
taccccttcatcggaggagtaagttacagtactcttgggcagatcctgattgagtggctcagctccaatctaattagcagttccctattgcttaacaagtacacaggcccaggctgggcgtggtgggtggctcattcctgtaatcccagcactttgggaggcagaggcaggaggtttgcttgagtccaggagttcacgaccagcctgggaaacgtggtgaaacactgtctctactaaaacaaaaattagccaggcgtggtggcatgcacctgtagtcccagctacacaggaagctgaggtggtggactcactgggcctgggaggtcgaggctccagtgagctatgattgcaccactgcactccagcctgggtgacagagcgagaccctgtctca

SEQ ID NO: 216782 - DNA, 188 bp, Homo sapiens
aatattcttccaatccgtgagcatggacatcttcccatttatttgtgttcttctcaatttctttcagcttgcttggtactttcctcgttgaggtcttgaaactccttggttaaatttatatctgggtattttattctttattgtagctattgtaaatgggatcactttcttgatttctttttcaatga

SEQ ID NO: 216783 - DNA, 247 bp, Homo sapiens
atttgtactctgtatataaaagcttaaagacagtgctaaaaattctccagtagtaggatgtatgtaagttgtttgaacagatagttctagtgggttcatagtaagctatttacctctcccattctgtggttcagttgacccatttaaaaaagattcaggatcaaaggcagaagctattgtatcaaaaatctttgtccactcttctcttgatttactcattcatccaaaaaatatttatggaacctct

SEQ ID NO: 216784 - DNA, 478 bp, Homo sapiens
aaacatttaggggtttcctagacaccttactgttacgtttgtatttttcaccatgtcttcattatttattcaatcatttttccgccccatttgctcacattcgtctccttctggaactcctattgggtatctgtcagacctgatgttgtcacataggtttcggaagttgtccctctcttccgtcttttttctccctgctctgggatctctaagggcagtcctgctctcacaacctgcaactgtgactcttcctcacatggccccatcctcagcttcactccccaccccctccatccctttgccctggtgcctttcctccatgctgcatctcacactttgactgaatgttacctccattctttctcttcagcctacatgttttttcctcttctttgccttggttgacaacccctttctttcacctaaatgaccataacgcagaatttaagcaagtttattttcccctgttctgtagtga

SEQ ID NO: 216785 - DNA, 162 bp, Homo sapiens
cctttgtactgaagagatgctatggataatttaatctgtttttcccttacccaatgctgacgtaaatcttactctatctagcccaagtgaatctcaattgccctggtcatcctaagcaatagaccgctagcataacaccaccatcaaaatgatgtgtttaac

SEQ ID NO: 216786 - DNA, 286 bp, Homo sapiens
gggaagaaatggaaaggacaaatctgcaagaagcccttagacctctgataagcagctgttgactcacctgagcccttgtggccttgcagaatcaacgattagaagatgactcatttggttagttctaaaatatgcccagatgttaagtcccatgtgtgcatatccccccaccaccaatttgaagaaattgtctacattttcctttgtgtggctccaatgttttttgttgtgcggctattctaggtgttttgtattttaatataagatgtgctcatcaatttctaca

SEQ ID NO: 216787 - DNA, 435 bp, Homo sapiens
agagaaattaagctttacaaataccccccctccaggctgaccccgggcccctcctagtcagccagacggccacatcagctcagctctgagaagaaagcccgtggttgggcctggcagagaggggcaggtggtggtcactgcaggtctgtccctgggcgctgccatggagaagaggacacactggttatattaactctcttcatattcaccaaaattaatgcctgcaagtggacaggcgcagacactgtggcagagaaactgtagttccggactagcgggtgaacccggggccatgttaaggaagtggccaagccgttctgctcacgtccccggtatgtcagccactttcatcagttttgttttaccttgtaataaaagttaccaaggagttagcaaaatctattaaaaattaccaagaagataatttgaagtaca

SEQ ID NO: 216788 - DNA, 589 bp, Homo sapiens
tctagaaggctgtccacatgagtaaggctttgttaattctcaaggctatgcacatgtcctgaaaatatctaaaaataccctaagctgtcacctctgactaaccttgagggactgtacaagcagaaagtgaaggctaaggcagagttgtcatctgtcacctgactgtttatgatgtaccccaacatgtacacagagaccctttgcaaggatcaggaaacttgctggtttcaggtgcttaagaaaatctctaattattagctgattactaagctaactggtcagagactttaactttagtagccacaatgacaaagaataaaagctttacaaattagtttataaaagacactaaacaaacaaataacaacaacaaacagcaaccacaacaaaccctggaaggggatgagaataatttccagagttgctatattatttaagatgtttagttttcatttaaaaattgcaaggtgtgtaaagaaaaacaaagtatagcttataaatagtttaaaaagcagtcaatacaaactttccctgagaaagcccagactttagtcttactatacaaagactttaaatcagatatttaaaa

SEQ ID NO: 216789 - DNA, 411 bp, Homo sapiens
gctgtagagtttaatggtaccaggacacagttggcccttggcatggtttcttcatcttgttataggattacaaacagcacctgtttcaaatagctgttgtaagaattaaataattacaagtagaacacataaaacagatatttattagataaaatatcaagccaaaagtattgtgacttttatctgagtagtctgcaatgacttctcaaacatatttggtctctcaactataccactggtgtgaaataggccacagttcccctactattctctccagctttatgctgagaaaaccaaaaattcctctcatctgcaagagagaggtatggccctgattttgataaggcaataaggatttttattaaccatcataataattattcattcatgatagaaccattatcttagcat

SEQ ID NO: 216790 - DNA, 539 bp, Homo sapiens
tgatgatgacggtgatgactgtgatgatagtgatgatgtttatggtggtgttagtgatggtgatgttgatgatgttggtaatagtaagaactgttactctgagtgcctacactgttttaggtaccttcatttcaccaggacacgtaacagagctctcgtctctctgactctgcaccccatggctatgtcctaattccactaaactcacactcttacaccagccagtaaacctgttgagggaagtgctcattattttttttccctggcatgcaggaagagttcgacatatgtttgcaaatacaggggtctgggacaggcggaactgcaaatgatccttttgagacctgaactactctgctgaatgggcactgaggggagatttatcgctggacagtgtagagtagccctgcccacctacaagatcagagagaggccctccagaggtggggtatcacaaagctctggtggctgagacctgggtgctctgtgtgccagtgagcacagttttgtatccttcttgtagaatgggtgagattcag

SEQ ID NO: 216791 - DNA, 399 bp, Homo sapiens
caatctttactcttgactgtctgcttactagtgttacaatctcacctttgagctgggctctgttagtacctatctgtaccacccaaagaatttatgagatacatagtttggctctatgtcctcacccaaatctcatctacaattgtaatctccacgtgtcaggggaggaaggtaattatatcatggggcagtttcccccatgctgttttcatgatagtgagtgagttctcaggagatctgatggttttataagtgttggaagttcctccttcattcactttctctctcctgccaccttgtgaagaaggtctctgcttccccttctgccatgatagcaagtttcctgaggcctccccagccatgtggaactgtgagctaattaaacctcttttctacata

SEQ ID NO: 216792 - DNA, 1033 bp, Homo sapiens
ggcacgagggtttttttttaggtttgggggagggtgagaggaaggagaggagcaggaaaggtaactattggttactgggcttaatacttgggtgatgaaataacacacacagcaaagccctgtaacacttgtttatgtatgtacaaaagtttcacatatacccccaaacctaaaaaaaaaaaaaaaaaaaaaaggaaagtgtgcttacgagctctgtgagtctgctgaaatgatggtagacgacaagctgtcctcaatcattcgccccccgctccccagccaattttctctgtgcaacagtggctatttactttggttacaagataaaatttatgtaagtggttgagcctagacttaggggcactagtttcagaaaaaaatgaaactatatatatttccatgttttttccaaggccaagagtagttttgtcctaagacaacagtaatcagtattttttgcttttgttttgttttggttttctttatactctttaactactttttacttttcacataccttactctcttgtactatgaaaacttattgaagactccaaagaggttttacttctaggttgtaaatgtcagtactcactgttggaaactgaaacagaaccactacaatgcttattgaaactgaaacagaaccactacaatgcttatttaatgatgccaaggaagatagcaaagataaaagcattgcatattaataacatctcggtaataggatgaagttatttctggcctcagaaacagccctgagacctgtccgaaaatcaagtgtcattttgttccacatatgaaagagcagaaccacagacacaacttggaaagtaaaactcatctgccttggtttttataatgcctgaatctggaaatctataaaacctgttaagatactagcaaagctttctcaattttgatgagcttattttctttgtttactgactaatatcttcatctgcaatataaagtgttaccatttttgttgtgtgtaatctgtctagataataaagattttcttttcaccaga

SEQ ID NO: 216793 - DNA, 595 bp, Homo sapiens
gtgtcatcccaggtggaatattcccagtatcccttcctgctcccagctgtgggcccctggagggcactccgggtgatgaggattctcatccctgctgagttggaaaggggcaccctgacaggagagctggccatgccccaagcctccccagccttgccctctgcattccttgagggccctgtcttcatggggatgggggatggcagctgtcagcaacaggccaagtggttctctcttctgtccccagcctcgagtggaagcagaggctgcattaatttaatttaaaaatttaagccaaagttccaactcgtggtacagagatccaagagcatagaaggtttgtaaggagagcaggtacctcttgtcctgccccttgctttccctcgcattcaggctcgtggggtaaacacttgcaactgttcctatgtttttgttcttttggcagttacctctgtaattctaaataatgagcttgtaattcaattgcttgacttatcaattttggacaatcttcaatgactattacaatggaatcttacaaaatagtctcttagctaatttcattagatttagttctagtgatgacctttatagc

SEQ ID NO: 216794 - DNA, 396 bp, Homo sapiens
caaacatgcccccatgaaagcagggacctctgtgaaagcaggaattgagaaattgggctcactactgaatattccctgggagttcatcagtcctgccacagaatagaagctcagtctgctggagtttgctgggggtctattccagacgctgttggcctggatatcaccaacggatgctgcagaacagcaaagattgctgcctgctccttcctctggaagctttgtcccagaagggctcctgccaaatgccagccggagctctcccgtaagagatggggcctccacgtgaaaagtaactacaaaacagaaccagaaaatagtcatgctgttcaagtgagttggcatatcacttcatgctactttgaaataaaatttcctcttattttcttatggata

SEQ ID NO: 216795 - DNA, 477 bp, Homo sapiens
cagccgcctcttcccccacagccatgtttccagctggtctcaggcctgggcttctccccaagaccactctgggtctcgtccaaacctgccaagagactcctagtggcagagtcttggttatgtcagcaccccctcaaggtgcatatatgcaccccagcacttcaccacctcggaggctatatcagcagccgcttccgctggggaggacagagccaggattggcccctcggagtccgaagcctgcggctttgataagagacaggcctcccactgctcaagactggggccgccttttcccatttctgtgcagctgcctgcctctctagccacccactggctgaccactggtccttctcagccagcgggaccaatgggctccctgggctgtggtcaccatggtgaccagagctgggcaggtaggaacaggcatgggcctcactcaatttccctcctctcaggccatcttgcctgccagca

SEQ ID NO: 216796 - DNA, 590 bp, Homo sapiens
gttaagggattaaaaaaataataaaatagaataccagtgactattgataaagagtcagtggagagggcaagatagaagtaacctgggctggacttgggaatgaatcactgatgctgcaaccaagaaagttaagaagatacatggagtatggtttagaagaaatgcagatggttgtagcagaaatagttctgaattggaagtcgggagatctatgttcctgtcttagtctttgccacttgacagctatgagaacttggcaaaggagttttgtgttttcttctgtagactcagtgttcccttcttaaatctgaggtagtcgaactaaattgtttcaaaattaacatctacattttaagtactccaattcagtaatacccaagagtaaatgaagagtggatgtagagatatatatttggacatatgaagagggaagatgaggaattttacctcccatacccttaatctggaggccagctgctacccactggggagatggaattggaggatataagcaatttatttatatacagctttatttttagtaattagttggcattttgccaagcctcattattccagacagtaaatgg

SEQ ID NO: 216797 - DNA, 460 bp, Homo sapiens
attgggtggatgcagaaactgagacctaggagacttcaaggagaagggagacggcttcctacagggaaccgcaggcttccacagggaaaatgcaaattgcacatgggaggcttggctctgcagtgaggttttcaaacattcccattcaatgctggttttaactctgagaatcctgaggcctggcaacttcgtgtatcaagagcctttcagcatggttaaatctagctcagaaaacccagaaaaccaaaggccaaaagaaccaccgaattccctattgcccaaaaaataacggctgcaggggtctcgacttccttcttgtccatttttatttcctttcactgtacacatgtatttctatatatatacacggaatccttgcgccaggagtggtggctcttgcctttaatcccagcactccgggatgaataaataaatgaatggaatggaaagccttgcttga

SEQ ID NO: 216798 - DNA, 283 bp, Homo sapiens
cagataaagccccttcatccctcccctgccagtgtagacaccacttcatccacctcccccgccagtgtagacaccctgctttcccagcaggtcaaacaggcagaggccagtgctggcccccggtcccggagccgggagtcccaggtgtctgtcttcaggttctgtttattaacaccccatcctcgaaaaaccaaccctagcgaattttatcgtatgtgaattaaaaatttaaaaataagatgaagtaagcaaataaattttaaaataaaatacatctaaggca

SEQ ID NO: 216799 - DNA, 415 bp, Homo sapiens
aaaagctgtgtttttatgatcttcactcacttattcatttatacaaaatgataaggagagattctagataagatacttttcctgaaatgaaacattatggtttctaagctatttcaccttctgagtagcaatttttcctttttttcccccccatttctttttttaagcagatatgagggcaatctgtctttgtctcctgaaatcccattgatcactagagttgatctaattaatcttgtcaatcagatggctgttttgtgttcagaaagtccaacctaaaggttgacaaatgaagagaattatgaccttgataaaggaggacagtcctttggttaagagcagtcatcattgaagaaacatttagcaccctctgtgtccttccctgatcccatcttcttccttttcctctggagat

SEQ ID NO: 216800 - DNA, 229 bp, Homo sapiens
caaaatcccccaagacaggaaccctagtctacctgtcccctcctacctccaccccattcagctctgaaaacacttgctgagccctgataagtgcagagcatggggggctggggatggggtctcccaggaagctgcaggtcttcagaggcagctttggcaactcggagtgggggtatttcactgggatagcctctgtggctggctgggctgagactggcaggcgaagtgg

SEQ ID NO: 216801 - DNA, 460 bp, Homo sapiens
ttttgcatttaatcaaacagtatggtttatggagagtttcctggatgattggttttcagagccagcgttgttttgtgtttccttggtaattccaaagaaatcccagcatcctacgtacctttggcctccatgatggattgaccatgattgggtgttagatggtcagaaactgagtgagatggtttttttttttttttctttaatgagctttccctttttttgctttaaaattttcaatgtaaaaataatgacatcatagtctatatttcatgtaaagtattgtggcttaacatgtacaaagttagaaaaatccacaagactcatttgctgatctaggtctaaagatttattttttggatgactataaaatttgcagagttagaacatttcaagaaagtttctcggctcgatgcggtggctcacgcctgtaatcccagcactttgggaggccaaggtgggt

SEQ ID NO: 216802 - DNA, 471 bp, Homo sapiens
agctcttggggaggcagagggaggaggatagctgtgcccaggaatttgagatttgcttgggcaatatagcaagaccccattctccaccaaaatgggggggaaaggaaagaacaatgaaacatattagggaatatctagcaagtctaatgactgagctggaaagtagcctaaccatacagtctctgcatcttatatactacagagagtgaagtttactgtatgtaaattcaaaaacaaaaggccaagtgtgaaggagtctaagaatgtgatggttctacaacaccccttccctaaaagagtgttacatgttttaggttaaggattctcaacaagtttttgtccccgcactctgcacatgcctcagtctctcttcgtattgtctcagtgaactgctatgattctcaacaatagtggggaggttgccaaaaataggaaggtttttacacaattttaaaaggcttctcttgctct

SEQ ID NO: 216803 - DNA, 425 bp, Homo sapiens
acagcaggccaactccaagaaccctctaagctattttttagtaggaagcatcaaaaaagctaagattcctttgattctatcaggattgatgctcaatcctttggctgacataacatgtgccacatgtttgacttgagaaagacaaaattaaagtttacccttaatgtaatggtcaattgttgaagtaagtacaagttttcttcttcagaggaagaaagtgtgtcagagcaaaggaggaggtatgcatacactggatgagggatgaggatcccctgagagaagtccgagtctgctaaattcatatttcagtatttgggaaaagtaagtggggcgctgtatatccctgtgacatcacagtccaagtataccgtcattctctccaggaaaaggcaaacaaatactgactacctagatgtatagggatg

SEQ ID NO: 216804 - DNA, 462 bp, Homo sapiens
gttcacaaataataagcatttggttgcaatttaaaattggttggcagagcaatagggcatttgattattaggattttacattatctgagtgacttggaaatagaaaagaagggacttgtattatatgtccagaaaaaaagtccagcaaactataatccataggcaaaatccagtgcactgctgtgtttgtaaataaagttttattggaattcagtcacgcccatttgcttatgtgttgtctatgtctgatttctgtctacttggtggcattgactagttttgagaaaccaaatgacccacaaactttgcaatatttaccgtctctttattgaaaaggcttgaccctctataaaaacgaattaatcctgaaggagaagaaaaaataaatagggaccctaatcatatttttaaatttatacagcatgcagttttgaaacactcagtcaatgatgtagaacaatt

SEQ ID NO: 216805 - DNA, 566 bp, Homo sapiens
gaaattattataaaaggttagattggagtgcttactattgtggtgccactcatcccaggctcagtggtcagaacttgggaattgtgtacatgtatgcacacacatatgtacacacgttgtctaaatttgcttcacattaatatctaaatttactttcatatccatatattgaaaaccatgaattcacaccagtacctccaattctagtccaacaacacaggattgcttctcattttctttccatattgataactcctttctcagacagtggctcccattatcctcaatgtaataacccatgattggtacagattttttttatccttgggcacgcttaaaattacttagcaaaaacaaaaagtaaaatcagttttgaagtaatatttctgctaaatatttagacatttttacttctttttcttcagcatggtaagtaaaaccatttattccatatttagatggttttctaaatttcagaaaatttagttagataaaagccgaccgaacccatgctacaaagaactttttgtatctataggcatgccctgtggttactggcgtaattg

SEQ ID NO: 216806 - DNA, 751 bp, Homo sapiens
caaagcgcctttgccgaggatttgccttccagcacattaaaactctagaagctctcccagttgatctgcagcatctggtacctaaagggattttcatctttaattctaaatgtatgaacgtaaaatgtagggattgaaagttgatgtggaatgtgtttttgaatttgtttgtgcaacttcatacttccagcatagcctttctaaggtagtgacaggtatatttaaatcatattttacttcgaatgtgacagagttcaatattatttaatgtgattttaaaatgcagtgggtctagatgagattaacctgtttcaaggtaaaatagatgtcatcatttactcccttctgaaaagctttttcttttattccattaacctttggttgtctctgaagtactatttattgcaggaaaatcagttctaaaagttggttccagggtatcatgaaaatgttaaattaaataatttctagtctgcttttacaaaacagcaatatggaggaaagagtgaaaaccatgttattcaatactttgcacaaaataagacagagctatgttaataaaattaacaatactaaattgaacaaacaaaaaaaaaaaaaaaaaacctttttggggcggccttgggccccaggaaaagagtttcttaaaaccctttggtgggggcgcggggccccagtgggtagggcgacccggggccaaaaggcggtcccaaggagaaccgggccgagaaaagggggggaattctcccaa

SEQ ID NO: 216807 - DNA, 408 bp, Homo sapiens
ggtaccatattgaaaactgttgaagtttaagtgactgtggtacttaagagagctctattttactccctgtcacagcttagagattttgtccctcatctgaccctccagggtcacagcccgggagagaataagttccatgtgtacattcatgtcacaaatattcattgagaaaaccatgtgccaggtgcgagatgtgggatggccagagagtaccattctgagcagggcagcagatcttgaaaaaggacccttggcaccagatcagagaggaacctaataatggcaggctgcatttattgagcactcactatgagccagctactgctcaagtactttctacatactaactcattgaaccccataaggctgatactcttacaattcccattttacagatgagatgactca

SEQ ID NO: 216808 - DNA, 675 bp, Homo sapiens
cagctactcaggaggctgaggcaggagaatcgcttgaacctgggaggcaaagattgttgtgagccaagatcgtgccaccgtactccagcctgggcaacaagagtgagactctgtctcaaaaaacaacaacaacaacaacaaaaacccagttattgtgtgtttgagttttgtgtttttgctttctattctgttccattgatctgtccagtcatgtactgataccaccttgctttcattaatcatttaattcatttattcaattagcacatatttattatgtcatatatgccattctggaaactaaatgtatagcattgaacaaaatgatcatagagcaaagctaatgatgtgttcatggagcttaagttctggtagggcatctgcgtgaaaacatacatcagctttggtagggcaggtgttggcaaactataaccctaaatccggactgtttcctgtttttgtaaagaaacttttattggaacatagccatgtccatttccttacatatcgccatggcatgccatttctttacgtactgccatgccatttgcagctatggtctgcaaagctgaagatattttctctctggactttcatggaatttgctgactcctttgctagggaaagactgaaagtaaacagaataggcaaaatatatattcgatagtgacaagt

SEQ ID NO: 216809 - DNA, 519 bp, Homo sapiens
cagatgtggtggctcacgcatgtaatcccaacactttagggggccaaggcgggcagatcacttgaggtcaggagttcaagaccagcctgatcaaccttgtgaaacccgtctctactataaatagaaaaattagccaggcatggtggtacatgcctgtagtcccagctacttgggaggttgaggcaggagaattgcttgaatccaagaggcggaggttacagtgagcggagattgtgccactgcactccagcctgggcgacagagcaagactccatctcaaaaaaaaaaaaaaaatgttattaggtacattcaaatttaggatttttgttttcctattgaattgaccttaaatattagaaaatgctttattcattataatcttcttgtcttcccatctgctttgccttacattaatatagccacaccaacttcttttggttagcaatggcacagtgtatctttttctgtccttttcctttcaacctttttgtgttcacatgtttaaagtttatctcccgt

SEQ ID NO: 216810 - DNA, 469 bp, Homo sapiens
tcttgggcagtcagttcagaaactctgagccacagtttcctcctctataaagtgggataataatatctgccttacagagtgctttcgagagttaaatgagttaatataactagcattgagggtaatgcctggtacttaatggcaatcaataaatattctcaataaacactgggttcctccggaagacattggtggacactgtgccagagattcaacaaaggatgacattgttaagttctgtggggtcagattgcctgggttcaaatccaaaacctatcgctctgtgcttagagtaagctatttcacctccctgaacattaatttcctcatctgtaaaataagaattattatagaacctacctcctaaggattatacaaaagactacatggaaagcatttggtaaagtgtcttgtactgagaaatcaaacattcaataaatgtcagctacttttgaggaggtggatgata

SEQ ID NO: 216811 - DNA, 571 bp, Homo sapiens
attaagagccacctcacaaggctgtggtgagaatttaatgtaagtgacttgcttggtgagatcagcttgacaagtgggaggtgcctggtacagagtatcatgagtatcaactcagccctttattatttggaaggccttgggcaagttctttaaactctctgagcctcaatgtcctcatgtgtaaagtaggggttgagaggagtctaagaatgcttctaaagcccttataacctagcaactgctcaatcagtattagctgttatatcatgtggcttgtaataagcacttagtatcattaatagcattttctcccaccttttaacatctttaatagctaagttctcctccatctgctaaaacgtaagctgtcagaaatttttgttataatcactaatgtgccccatatgcctagaacaatgtctaacaatacagtaggtgttcaacaagtttttgttgaatgaactttcctaagacttgcctctcctagcttctatgcttgctgcttgaatgtcctaattatcttgcagggaaagcactcaggttcctctcaaaaaggccccatgcaactctg

SEQ ID NO: 216812 - DNA, 272 bp, Homo sapiens
gtcccccttcattctgggtacctgcaggttccgacctgctgcctctgggcctagggcatggctacaggaggtggtgccagggtgagagaaagccccagtccccacacacagggccggctaagctggcagtctcgccccgggcaggggcagccctccttgtcaagacctctccccttcccactgccattgtcattgctctgtgtttgtactcattagtaataaaggtttagaagctctgacccagtgtgtgggtccagaaagctccctctgga

SEQ ID NO: 216813 - DNA, 355 bp, Homo sapiens
ttctggggagtagggatggggagattaagatgtgggtgagtgtgggcaaacagagacacttaaaaagtgagagttgataaaaaatattttcaagtcagtaagtgtcacttaaaatgggaatataaaatgaaatggacacatacaatttaggatgatagatatcatttaagtaactatgcttttcagaatgtacaacatgaaatttatatttgactatataaggcttatatagaataatagacagaaatagggaaaatgctatcatttcacctattcattagaccaagaaaatgttcatattccacaattctaaatgaagactactaaaattatatttctatataaaaaaatggag

SEQ ID NO: 216814 - DNA, 561 bp, Homo sapiens
agatacaacaaaaacacatatcattcccatgtgcacacagcgcggccaccatgacagaccatcagctccattaaaaacaagcctcaaatgtcaaaggactgaaatgataccaagtgtgtctttaagcacaatgacatctaattagaaatcaacaataactaagaaaacttcagatatgtaaaaattatacatctaaataacctataagtcaaataagcactcacaaggatattaaaaatttcacattgaatgataattaaaatacaatataggctgggagtggtggctcaagcctgtaattccagcactttgggaggccgaggcaggcagatcacttgcagtcaggagttcaagaccagcctgaccaacatggcaaaaccccgtctctactaaaaatacaaaaattggccaggcgtggtggtgcacgcctgtaatctactcgggaggctgaggcaggagaatcgcttgaacccagggggttgaggtttcagtgagctgagattgcaccactgtactacagcctgggtgacagagcaggactccatcttaaaaaaaaaaaaa

SEQ ID NO: 216815 - DNA, 433 bp, Homo sapiens
cttttaatgcatgtgaagcatgaaggggtctaaggacagcagctgtggggaaaacaggctggccaagacccaccgccccacaaagggctccgggagtggattatgctgatgctgtgtagcagggtggagtgcccagtgacccgtgcagagcctaggggattgcctgtcctctgtgtggagttctgctgaaagagacaatgatgggcacatcctaatatccaggcttctcactggatccaatttatttaccttctcctccgcctgggaaaatggaatctaaacggggtgattgacactacgttgcttaaacatggctcagttttgtattccctaatgcaaagtggaaataaagtgcggatgaaacagagaagcagttgcagtgagatgaaagggaatgatgtttaatattctacataaacatagagcaaggatg

SEQ ID NO: 216816 - DNA, 501 bp, Homo sapiens
tcatcatccttacccaatattgtgctcattcctgcctctgtaacattccctctatctcaaatgtctcttcaaattactcccatccttcaaggctctacccaaatcctactccacagtacagcctcaccaccccctggagcattccacagactcccccacttgccatggtctctttcttctctcatcctgttatagtcattgtctctaatccacaaccctcacattattatcattcttgtcactatctctgctttataatttagaacattttaaataaattcagtctgctgaacatttatattttaaatagcatgagagctaccccataaatgtttgaatgcatgacatatataccctaaatattttaatgaatgaactacaatatataatttaaaagataaataacacatttatcctgtaaatagaatataccataaatatcctacaattctattctagaatgttatattattcataaagataaacatattgttcaaaata

SEQ ID NO: 216817 - DNA, 294 bp, Homo sapiens
tacacttcttggctttattacgctggacaggcaggtctttttgtttcccaggatgttggttggcttcagctcttagtcttaggggatctggcatcccgtgctggggttttcacagcctgcaaagcaagccaggttctgggcagagccaggcttcctggtggatttaggaatgaaacccatctggacagggagggggaatgggtgggcttataggaatgctgggctatacatttcctatctcaagcttcaagagtgacaggaccaccaatggatatttcggaatagatgcctaaa

SEQ ID NO: 216818 - DNA, 226 bp, Homo sapiens
cttgaaaaaggtacaattttgaggggtgaaatcagggccttcaaagccagatatgcaaaatcattaataaagctacagacataagaaaagtataaggcttgttaggggagcagtaaagattttatctgggttagaatataaaggagtgagtgtattctgagtgatgttcaggaatgtagaagaagatggcagtctctataggaattaaatttttctgtaatgttta

SEQ ID NO: 216819 - DNA, 432 bp, Homo sapiens
acaagtaggatcattcatcattatggtatacatgtgctgttatggactacataatgttttggttgaagttttatttgcaagcgatgtgtgtgtgtgtgtgtgtgtgtgtgtgtgtgtgtgtatgggattttttaggtagtgggtgttgagcttgaacgctttcttaattggtggctgcttttaggcctactatgggtgttaaattttttactctctctacaaggttttttcctagtgtccaaagagctgttcctctttggactaacagttaaatttacaaggggatttagagggttctgtgggcaaatttaaagttgaatcatgctaagaacacttctgctttttgatccactgtttgcagcagaattatatatatgtataggaaaaatccactttgaataatccatgttttgtatttggaaattgttttta

SEQ ID NO: 216820 - DNA, 386 bp, Homo sapiens
gattttattgatgtaaagtagcaaatattcctgtgtccccaggaagggtgaggttctatgccaggttgggatgagattaccgaaatgtttgagaaagaaagagctcttcccgctgagaacaccgctcttaaaactccacctccccatggcttcacatcagcaaagcccagagatcgcgccaaccacacatggagaccaataggaccaagaaggcagatctgccgggattagggaagaacttgaacctgtggctgcaaagttggcgcttggcagacactcaggatgctctgcttctctccaagatctgggccttctttttgatgacaaaagttgccttagccccagctcctaagcacttagaaacaaaataaaattaagttttgaat

SEQ ID NO: 216821 - DNA, 452 bp, Homo sapiens
cttgtcacccaggctggagtgcagtggcacgatctcggctcactgcaacctctgcctctgggtataagtgattctcctacctcagcctctcaagtagctgagattacaggtgtccaccaccacacccagctaatatttatatttgtagtagagacagcatttcaccacgttggccaggctggtctggaactcctgacctcaagtgatccacccacctcagcctcccagagtgttgggactacaggcgtgagccatcgcgccgtcttttctttttttcttttaaagaaaatctcatctggattctttctgttaaagaactaaacccaactccaataacgcctttactatctgcctatttgcagttatactcaacttgcacaaaatttgtatgccatatacaaatatacacacattctctttacactatatgcacatgaatggaaatctgctgt

SEQ ID NO: 216822 - DNA, 477 bp, Homo sapiens
tctccctccacaaggccaaatccatcgtgtctgatcttaaggagaaggcccttccagtgctaggagaggtatgggcagcctctcatctgtgagctatggggatcagcaggccacctgccccagtcttggagctctgtagggtgaatgaggcagacgtggaagagttggccccaccaacagctgctttgtggagcaggggtccaaggaagataaggtggactcaaggtcaggctgcctggatttgtccgccaccctgttatgccatgacaacttctgaaccacacaccagacctgagttctgggctcatttgaagcctggaatagcaataaatatttttaacttgcaaaaagaaaagaaaaaggcaggtgtggtggctcacacctgtaatcccagcactttcagaggctgagatgagcagatcacttgaggccaggagttcgagaccagcctggccaacatggggaaaccccctctct

SEQ ID NO: 216823 - DNA, 449 bp, Homo sapiens
tcttgaacatgggagtggggagacggactcctaagggtatgacacttgaagatttcaggagggggcctgcaggtttatgtcctcacttgttttacacctcacagaggtcagcgaagcagggtatcaccaaagccccacctgatgtctctggaaatcgagtactccgtgtcttcaccaggcccatgccagctgtgaggggcagaaccaggttttctgacaccaaaccccaggtttcttcctgtgctggcatgggtcctttttctgacttggccagcagcctctcatagatgggggtctgattaaatagttctggtgatgggtggagtgatggttgcacaacaatatgaatgtatttaatgccactgaactgtacacctgaaaatggttaaaatgttacattttatgttatgaatatttcaccacaataaaaaaaagaaacaaatatggat

SEQ ID NO: 216824 - DNA, 413 bp, Homo sapiens
gccctcggcgtggcttctctccagccgggagtcccagggccagctagcctcctcccctaaaggggacggcctgtcagcgcagtgccagagtccagcaccgggaggaaagtttcggagtgcggagggagttggggccgccggaggagaagagtctccactcctagtttgttctgccgtcgccgcgtcccagggaccccttgtcccgaagcgcacggcagcgggggggacttcagccctccaggcggggtgggttccaggtccgggtccgaggcgggcgctggaggctcggccccaggccggagaggaactcctttcgcgagctgtcgccgtgggcccgcattgtctgcaggaactctccggaatcgggagggggaggactggatcgcgcttccactgggattcgtcaagagttc

SEQ ID NO: 216825 - DNA, 939 bp, Homo sapiens
cgagggaataagtgtattttaaagcatcccaggtgatggcaatgtgcagccaaggttaagaatcactgtttcatagaatcagggaagaagtcagagaaattgggaaagaaaataaactttagtacttagtgaccaaatacaggaagcaatacgggactctgagaacacagagtttgaaatttggggctaggcgcagtggctcatgcctgtaatcccagcattttgggaggccgagacgggcagatcgcccaaggtcaggagtttgaagccagcctggccaacatggtgaaaacccatatctactaaaaatacaaaaattagctgggcatgatggcgggtgcttgtaatcccagctactcgggaggctgaggcaggagaatcacttgaacccgggaggcagaggttacagtgagctgagatctcaccattgcacgacagagcaagactccatctcaaaaaaaaaaaaaaaagaaatttggaagtaacctaatatttagtctttcccacttactttatgaatgtaaagttaagttacttcttcatgtcctacatctaataagtggacatcacttcttcccacacatgtgtttacacatgcgtatacacaatttctccccactacttcctttctgtaattgtaatattttttgttggacaagagcaggacacttgtactatcactgacaaaagttggaaaggtagattattgtattgagtatacactggtgagtttagttgttgattggttcagtttgagaaaacaggtatttaaaaaggagattatttttatataaacttaggaataaagaaatggtattcaggtatgaaattaggaccacattgagagtcattaacaaaaagggacaagttaaaactataaatgtggcttaagaaagaatagaggacatcagagggttgagggctgagtcttgaaaagca

SEQ ID NO: 216826 - DNA, 429 bp, Homo sapiens
gcttacccatatcagaatgtcttgattttataatactccagaacagttgttttactaggtagggtagtagattccaaacaaagtgaggaagtgtaatttctagtgtgaggatagtagttttaattatgtattacattatgaaaatgaagagaaggagtgaaagaactcagtttatggattagacagtggatggatgacagcagtatcctttattgcttgcacctaagttggggcctgactgtgttaggagggaggagagattggcattggtgagaaggcagtggggtagagcagctctgtagcacttgagacaaaacatgcctgtggtgggccttgatatactctttgattcaagtagggtggtgtatctatttcattcacattaccttgtcataaaactcctttgggaaagttaacaagtttttgtct

SEQ ID NO: 216827 - DNA, 782 bp, Homo sapiens
gagggagggaggctgtcaggagaatactggggaggaagacttgggtctccaaatgtctgattctgttatccactgtggcagcttcaaagagataaacagaaaggcaaacttgaactgctggaaatgaaaagcccctggaggaagcagatctgaatattttataatgagcagaaatagctcatttctttatgtcctgacctatacaaaacttatacccagtattttcctaaagaagtctgctcttcctacactgctacctgcaggatcatgaagctctggctatgaagacccttgggagttacggtagttcactgttatctttgtccacaaagttgggacataaagagaaaattaatgtttaactccaaagaaatgtaaaactgtcttctagtgggacagtgtccaatttaagtttccttacacatttgcctaagaatagcgttggttttcctccccttttcatctgcaaacagtatgatgcttttgaaaattaagactcctttgaacgctggagtcaaattgacaaaatccactttgtctaaatcttttgaagtcagacttttgtctcttctctatcccaggcctcttataatggcaatctataaaatacctgctaaaaactctgacttttaaaagttgcaaactcgaagtcctgaaaaggaacagaaggcttgggttgatagggccagttctactgctgggtttgtgaactagtcattagacctcattgccggtttcccagccagaccttctttcctgtcatccttgggagagaattcgcc

SEQ ID NO: 216828 - DNA, 446 bp, Homo sapiens
tcatcggaagacttgagaacttggcttctctatcccacgaatgttatgcagtcatcttcccagcatcctgcaggacagacctgcttatgccatttgcagtacaaacaaagtactatctatctgaaattgagcagcaagtactttaacttcacgtacctctccttctgaaaatgccatcaggatagctcagcccataccaagcttctggtacttctctagtaccccaaagcaagtaattcatgccctaaggcattagcatccttgaagggaatgttgccaagacaaggccacttctgcagagcagataccttccccagaggggaggcgtccaaagtcttgcctcaaacgtaggaatgttcaggaagcagtcatggacagcgagatcatcaagtcccttaggaataagtaaactcaaataaaataaaaataaagtgattttccctttt

SEQ ID NO: 216829 - DNA, 335 bp, Homo sapiens
acttattagctgggtgacatgggcaagctgcttaaacactgtccacccttggctgggtgcagtggctcacgcctgtaatcccagcactttgggaggctgaggtgggcggatcacctgaggtcgggagttcgagaccagcctgaccaacatggagaaacccggtctctactaaaagtacaaaacattagccgggcgtggtggcacatggctgtaatcccagctactagggaggctgaggcaggagaattgcttgaaccccggaggcggaagttgcggtgaggtgagatcatgccattgcattccagcctgagcaacaagagtgaaattccgtctca

SEQ ID NO: 216830 - DNA, 412 bp, Homo sapiens
agcaagaatcgggaaagaacgatcaatgcccttcccccataaggttgacagcaggtgggagatgctttggattggctgtcagatcagaatttcggatgatattggataaatattttaatgcctgaaagtcagtcttaatgaccacattgagacttttcttgtaagtagaagtgcttggagagccatagcatctttccaagttgtcatcaagaggtgaggggacatagatagggcaaaaggttgtgcaaggtgatgggtaggaagacactaaaatttcaggagagcagaaaatggcagtcagacaaggctggcacttccatgcccctaagcatgggcacctccttccattttgcaccatagacacctcacttgccttaccttaatcagccctgcattcagccacaaagacacc

SEQ ID NO: 216831 - DNA, 425 bp, Homo sapiens
cattggcaaaaggggctttactctcctgtaaaaccgtgacttccttggcagggcatataaaaaagaagggttatagccaaaacagaataatatggatataactgtattataagatgtatttcaagaagaatgcatattttttaattagctttattttctatccatatctgactttcaaagcaaaatttctagagtagtactgattaataccatagtcactagcctcatgtggctattgaatgcttggaatctgggtagtctgaattaaaatgtatgttaagtgtaaaatactcagggtgtttcaaagacttagtacagaaaaggaatgtgcaatatcacattaatgattatcttgtatttgttatgtgttgaaatgataatattttggatatgttggactaaataaaatatcttattagaactaa

SEQ ID NO: 216832 - DNA, 393 bp, Homo sapiens
gccctagcaagtgagcctccccagcttggcctctcaaatccatgtctgaactcacccggctgtcaagtgtcttttccaaatctgaccaactgttcccttctctcctgaacagttgttgcttttacctcttaatctttgcatatgttcctcactgggtcacacgtgtaccatgacccaggattacagagaagatgctgtcatctcctgtccttctgtcccaccctcttgaggtaccggatgttagcagggccgtagacacacaggctcacctagaaactgtctaaggggtctcttgctgctcgctcactatttatcttatttttttgagatggagtctcactccagcctgggcgacagagcaagactccgtctcagaaaaaaaaaggaaggaaa

SEQ ID NO: 216833 - DNA, 768 bp, Homo sapiens
gcttccctgcatcagaaagggaaagcacagggcagaatttcattgcagcaaggagtagaaaggtgttgtccattggtttttaaaactaatgactttctgtcagaatctgtttgagtgctgctaaaaaaaccaaccaaacaaaaaccagtgacttttaaagacagagacagcctttggttgggggagtcctttagagttgtcttgtacactcccctctttttagtggggctcccctcgtgggactcctggagctctgtcccatacagcagccacagccagttgtggcttttgggcactagacacgaggctagttttagttgagatgggctgtgaataaaacccacgccagattttgagacttacttctgaaaaaataaactttcttgctaatttttttttgagacagagtcttactctgtctctcaggctggagtgcagtggcgcgatcttggctcagtgcaacgtgcacctcccgggttcaagtgattctcatgcctcagcctcccaagtagctgggactacaggcaggtgccaccatgcctggctaagttttgtatctttaatagagacaggatcttgccacgttggccaggctggtcttgaactcctggccttgagtgatctgcctgccttggcctcccaaagtgctgggattacaggtgtgagcctctgtgcctggccaactttcttgctaatatgttttatacagattacatgttgaaatgatagtattttacatatcttaggttaaataaactatattttaaa

SEQ ID NO: 216834 - DNA, 523 bp, Homo sapiens
catttccttgtgcttgaattattcatattatctacaatctaatgtctctttgcaggaatcttttaaagatcatgtgctcatttttttgagggctagtttagcttaaattagataatataagccataaatccacttcactgggaacatcttagctgaaatagacactctaaaatatgtgagatgaagagtgtcactatcaatggttctacatcatagaactctcctcactctaccatcaggataaatagcacatggaccaaggaaaggtctcagtattaattcatgtactactagtaaagcttaatgttttagataacaataaatataacaaataacatatcaaaagaagttctgaatttaaaaattagccaggcatgatggtgtatggagcccgtagtcccagctactagggaggctgaggtgggaggaccgcttgagcccaggagtttgaggctgcagtgaattatgatcataccactgcactccagcctgggtgacagagcaagactgtctcaaaagaaaa

SEQ ID NO: 216835 - DNA, 871 bp, Homo sapiens
  misc_feature (266)..(266): n is a, c, g, or t
gggccaggtcagaatcacgcctcaatcccagcattttgggagccgaggcaggtggatcacttgaggtcaggagttcaagaccagcctgggcaaagtggcaaaccccatctctacaaaacattccaaaaatagttgggcgtggtggcaaacacctgtggtctcagctacacaggaggctgaggttagaggctgcagtgagccgtgatcataccactgcactctagcctgagtgagagagcgagaccctatctggaaaaaaaaaaaanttttttttttaagattttctttcacacacacacataacttaagaattaccagaatgacaaatgttcacacatagttggtagcgttcgaagagtcaagaggagcggacgtattctctaaggagccaggagaaagtctgtttgcagtgtgttcattttctccctagtaggtcttgtcattgccaaccaatctggtgaactatctcctccttcccaaacccagaagctggattctttccggtatacctttagaattttaagccttaggcagaaaggaaaaacatccctcagtgacatgctattaagggagaggataaaacatgtgtagagtttgtggtatataagagaattaaggtgacatgtgttacagatcagtttgactttcactatggatgacactattgggcttagtctccatacttcatggtattatactgggggctaaagttacaaagatgtatttaaagaatagacttcaaccatatgtcagaagactgggaaattaatgtatatttatatattttaagttaaaattaaattttataggtgtgtatcaacttgtatcattctcaaacctaactgacttttgtgatttacttgcctggtta

SEQ ID NO: 216836 - DNA, 445 bp, Homo sapiens
agcaggtgagagattacaaccccttgagggtcaaggtaacaaggcatgttggaaacattcctgactcccagtatcttattgtttacaaaggatatttctattatttagatactcatatgacattgatttttgttataaactactattcaaaacagtaaaataaattcaaagcaaataattcatgatttgagataggatggacataattctcatcattgctagtgaatatagttaacttcagtaatagaaatggctattcttttatgttacagtaattttgttggcaatgcattatacacgaaataaaaatcacatttctttagaggcatgttagcattcaccaaacaataactgtacttctttttcttcttgccagcaccatgcaggatactgagactaccaggcacccactcactctctacagtactcttactaaagagaccaa

SEQ ID NO: 216837 - DNA, 341 bp, Homo sapiens
gttttctgtattgcataaaaataaaagctaatcgctttggaagtacacgacctcaaaagttatatgtgctgaatgtaacctacttagcgattttttttggttctttaaagtggatttatactctttagccatattttctgatatatttacttgtacgtttatattagatcaacatgtataagaataagtaattcagaagtattgcctcagtaaatttacctgctatctgtagcttttgacagtatactttctttttttttgtttgagatggagtctttctctgcattacttgagcccatgagttccagaccacctgggcaacatagcaagacctcatctca

SEQ ID NO: 216838 - DNA, 303 bp, Homo sapiens
taaaacacttcagatgtggcttgacctattttaaactacaaggaaagaaggaggaaactggatgaaggtgaggcaaggtaaatatattaaacccagagacactacacaaatcttttcattccactgagacatggatggccactgattcttgatctcctttgtttggaggtaggagggcagaagttcaaattacagatttgtccccacctttcttttgagagttccctaacttatgtgaagtatgatttgcttagttggactgtatattttgtcagtttcatggaaaaagcactgatttctttg

SEQ ID NO: 216839 - DNA, 386 bp, Homo sapiens
acttagcatgacttacttataaaaaatattatgatttgccatatataagtctagtatattgtttagtttagaaaatgttgcatgttgagtatgtattttattgttggttgagtgttcaaccaaccatcagttaagacaaactagtttgtagtgttgtttaagtcttctatatccttgcagattttctgtctagttgttgtatgtattgagaatagagtgttaaaatctccaccttctattgttgagctgtcattttctctcttcagttttgtcagttttcctttcatgtatgtagtctcctgtttttaggagcatatacgttcattgtagttatatttttctaattaacttgcccttttatcattaaataaatctctttttcttta

SEQ ID NO: 216840 - DNA, 162 bp, Homo sapiens
caacaaaacctgaaaccccatctctacaaaaaatacaaatattagctgggcatagtggcaagagcctataaacccagctactccggaggccaaggtgggaagattacttgagcctgagaggctgaggatgcagggagccaaaattacacaactgcactccag

SEQ ID NO: 216841 - DNA, 204 bp, Homo sapiens
aatgtaagtgcaaagaacttaaatatatgattgtgtaagatgatagtcatttagaacaacattttttaaatttctgaaaaagtgaggccgggcacagtggctcacgcctgtaatcccagcactttaggaggccaaggcaggtggatcacgaggtcaggagatcgagaccatcctgactaacaaagtgaaatcccgtctgtacta

SEQ ID NO: 216842 - DNA, 411 bp, Homo sapiens
acatagaaagaggaacatcactggggacttaccgtgtgtagggcttggctctaaactctccacaccttttacgtatttgatccttacaacctgagctggattctgtatgtaccctcattttacagcagggaaaactgaggctcagagagggtaagcaacttgcctgcggtcacacagccaaaaagagaccaggatgggagccagccaaggtagcttgactcagaaactcacacatgtacaccacagctgtcacacacatatgggcacataacagagtggacacaaacacacacacacacatttgcacgcacgcacacattaacacccagcgaaagtctgggtgcagtggctcatgcctgaaagccagcactttgggaggccggggcaggtggattacctgaggtcaggagt

SEQ ID NO: 216843 - DNA, 355 bp, Homo sapiens
aatctgccagcgccctggtattggacttcttagcctccagaactaaattcctggagtcaccagaagctgaaagagataagaaatggattctcgcctagagcctcaggaggggacacagccttgcatacatcttgagcttggacttctggcctccagaaataagcatgagaggcagctaagtcaagtgagggcgatggctgggctggaagcactggtgcctttccctgacaacaggaggccacaaaagccatttcatcatcatcatccacccaaacatcaaacataaatggataaggctgcatatcgataagtatcaaataacctgtaaggaatattaaagcataatcaactagca

SEQ ID NO: 216844 - DNA, 338 bp, Homo sapiens
tgacgctacagtgcctggagctgggctgttttctcctcggtttggagcctggtgaccgtgacttccccgccatgttctgtgtgttgctggctggagaagggtagttgacaaactccgacccagcacagtgtttctgtgggtcaaaactagaaaactatgtccgggctccgccgaggcggaaggatcccttcaggccaggagttaaagagcggcctgggcaacatggcgcgactccatctctgtagtccctcctcagcttcccagatacttgaaccccaaggttcaaggctgcaatgagctatgatcccatcacagcactctatcctgcgagactgaag

SEQ ID NO: 216845 - DNA, 521 bp, Homo sapiens
tgcctcagctagttccctctagccttttacaaggcactaatccattcatgagggctccaccctcatgacccaaccactaccccaaaggctctccctcctaataccatcacaatgggaattaagttgcaacaagaatttaggaggggccactttcaaaccgtagcaatgatatataatcagattttcctgtggttatataatgaagcagatattcagaccaaggaacacattgcatatctattttaaaactttaaaaccaattttattggttgtaaaactaattttgaagtggttgtaaagacacaggaggctgcaaatgtaatgtacagagaagtccatgtacccttcatccagttgcctttactgggaacatcttgcataactacagtacagtaagaaaaattggagaaccgacataagtaaaatacacagagcttactcatagttcaccagtttctatcttttaaataataattatgtttgtttaaactctactttagatcacaaccaatcaccctgtg

SEQ ID NO: 216846 - DNA, 460 bp, Homo sapiens
gggtgaggaactggcttatgcctgtaatctcagcactttgggaggctgaggcaggaggactgcttgagcccaggagttcaaggctgcagtgtgctatgatcacaccactgtattctagcctgggtgacagtgagattctgtctctatttagaaaataaatgaataaaaacatattttttaaagaaaagggtggccgtgcacagtggctcacgcctgtaatcccagcacattgggaggccgaggcgggtggatcacctgagttcaggagttcgaaaccagcctggccaacatggtgaaaccccgtctctataaaaatacaaaaactagccaggcggatggtgggtgcctgtaatcccagctactcgggaggctgaggcaggagaatcacttgaacccaggaggtggaggttgcagtgagccaagattgtgccattgcactccagcctgggcaacaggctca

SEQ ID NO: 216847 - DNA, 598 bp, Homo sapiens
ctacttaaagaatcagagttgacattgtttaggttttgctttaggagacactccttcaggtaaaactggggaatggagataaacttccttttctaaaatagttcaaatgggtttgtgaaaggaaaataccttgggcccccaaaatcactaaggaaaactcaagctggaaactgcttaggacaaacctgcctcccgttctattcagtcactcctctgctcactgagatagatgcatatctgatttgcctcctttggaaaggctaatcagaaactcagaagaatgtaaccatttgtatatcacctatctgtaacctggaagttccctgtccgcttccagtcttcctgttttggcttcaagttatcctgcctttccagactgaaccagtgtacttcttatatatattgagtgatgtctccctaaatgtctaaaaccaagctgtgctcagaccaccttaggcacgtgtcgtcaggatttaatgaggctgtgtcacgagcgtgtcctcaaccttggcaaaataaactttctaaattaactaagacctgtctcagattttctgggttcacattttggtaaccacaggggggatcctgagtggag

SEQ ID NO: 216848 - DNA, 202 bp, Homo sapiens
attccattagtatcacttacctgggaagtccaggtgccttcaatagttgaggggagtaaatgatatgactacctaccttcaaaacttgtagtttaaagtggtaacttgaatactcacatttacctctgtttccttcctctaaaagaatggttttttaaagggtaaatccacagggacaaagaaaaggagaggaaaaccagca

SEQ ID NO: 216849 - DNA, 923 bp, Homo sapiens
cgaactcctgacctcaggtgatccacctgccttggcctctcaaagtgctaggattacaggtatgagccagcacacctggccaacatgtttttgtcattgttcgtaatttttaaatggcttcccaaacattcagaagtgactaaaattatttattttgtggtgacagaggttttgttgtcatgccctaggttaggtgtatcccctcagagtatcactgcccgtgctgtgctgaagagcagtgagagtgagggcgaaattcacacctgtcttaaaaatgcataccctctgcaaaaagttgggttttcctttaatgtaatcggcactagcgactcagtttcactgtgaggcccccgggcgattgtgaaggtaccaggcgatggtgttgctggcccagggcagcttctgcagcagtgcagggagggctggccaggattgtttagcctgtgcctgtttcctcacgttttgtgtgttgacagagcatgatctaaacattttatcagtttctttttcatttacgtaaattaggcagtagggaaatctcagctaactaaggtctttaaattttatttggatgaacaaaaaatgtaatcagagggaagggaactcattttcctcgagggtcagaggcaggaatcagaaaggctttctagggggtgggcctggcctctccggttgtctgtgaaattgagacaggtatgggagtctagaaacggagttgcatgtgtgtgattcctttcagttactttaattggatctctggttatccttgaactatccccgaatttaaacagttcttcatgtttgagatatagaagcatcttaaggagcctggggactatgggcagggcctggcataagctatttgtatgtttaaaagtggtatataatagtattaaattgggatataaagtagtgttaaaaca

SEQ ID NO: 216850 - DNA, 544 bp, Homo sapiens
agttaatcacatctgcaaagcccctgcctccaaataaggtcgcctgcccaggtgcggagggtgagggtatggacagatctttctggagagccgtaactcaacctcctgggtgccaggttctgtgcaggcaccttatgttctgtttcctcctccgtaaatggggacacgggtgcatcccacgaggcttcgtaagcatcagaggagcgggttggggtgatggcctgagcagcgccctgcggctgcaataaacacctgcagattggatggttattcagagcagggcctcattctcctccaaggtgacccagggtccctcttcacaggagaggaaacagagactctgaagctccactcagcctggcgtggtggcacatgcctgtaatcccagctactggggaggcaggcgggaggatcgcttgagtttgaggctgcagtaagccaagattgtgccactgccactccagcctgggagacagagcaagacctggcattacaaaagagagagagagagagagagagaaagaaagaaaagaaaagaaaagaa

SEQ ID NO: 216851 - DNA, 707 bp, Homo sapiens
cctgtgcccatggaggctgcagtgcagttggaaaagcagaccaaagggaataaacgtgaacaagataattgcaaaatatagtaagtactgtgaaacaaaccaatagattctgggagaaactaaaataagaaggagcaacttttagtggagacatccaggaggcgtctctgaagaggtgacagcaaataagttacgttttgggaagcagaggggagaagagggtattgggtaggtgaagaagcgcgacagcccatggtgtgtttgggtgatacaagtgagccaccattgtctgatggaaagggactggaaaagaaactggattgctgtaagaatgattttgaatgacattggggtttttctggtttgtttttgtttttgagatggagtttccctcagttgcgcaggctggagtgcagtggtgcggtcctagctcactgaagcctcaaattcctgggctgaagtgatcctcttgcctcagcctcctgagtagctgggactagaggcatgcgccaccacactcggcgaattttttatctttttgtagagataggttgtcactgtgttgccgaggcttgtcttcaactcctgccgtcaagcaatcctcctgccttcaagcaatcctcctgccttagcctctcaaagtgttgggattacaggcatgagccttacgcccagcacataattttttttttttttttttgagatga

SEQ ID NO: 216852 - DNA, 878 bp, Homo sapiens
gtgccaccctgaacacccccgacctcgtctcatctcagaagctaagcagggtcgggcctggttagtacttgcataggaaagcaggagggtccccacgccagagggaggcctgcaaaggaagcgcggaattgggatgggctcgccactgctctgagccagaggaagggtctggacggccgagctggagggacccccttttctggtgttcttggcaaaaaaaaaggaagacagcagaggagagctccgcgaggggctgctgtggggtcgggggagagcgcgctggagattagaagaggagccatgtcagaagaaacagtaagtgaatcacagttttccttgaagacagcagcgctaagagtgtttgatcttcctctgacttggtactattctctctcccagatcaaattttctccggtggctaaaaagttgtttgtggtaactgcagtgagtgctatatctgtaatttttctggctcatcactttaaaagaaaacgtggaaagaagaaaggaaaaatattaccatgggaaccagagcacctcatacttgaatacactaaaagagcagcatcagacaaaggttcaagttgttccagtagcagacagaatttgacattatctttaagttctaccaaagacaaaggatctcaagtttgtaactatgctaatggaggacttttcagtaaatattcaggttctgcacagagtttggcctctgtccagagtgtcaattcttgtcatagctgcgcttgtggcaattctaattcctgggacaaagcagatgaagatgatattaaacttgttaatattcctgtgactactccagagaacttatacttaatgggtatggcagtgttgaagaggcattgcgtcgatgggac

SEQ ID NO: 216853 - DNA, 691 bp, Homo sapiens
aggactccgccttctccatgtcagactgctgctcagcgccaggcatcagctgggaagctggcgtgggcaggccagctgtacctggcctggagctccagattagaagaggagccatgtcagaagaaacagtaagtgaatcacagttttccttgaagacagcagcgctaagagtgtttgatcttcctctgacttggtactattctctctcccagatcaaattttctccggtggctaaaaagttgtttgtggtaactgcagtgagtgctatatctgtaatttttctggctcatcactttaaaagaaaacgtggaaagaagaaaggaaaaatattaccatgggaaccagagcacctcatacttgaatacactaaaagagcagcatcagacaaaggttcaagttgttccagtagcagacagaatttgacattatctttaagttctaccaaagacaaaggatctcaagtttgtaactatgctaatggaggacttttcagtaaatattcaggttctgcacagagtttggcctctgtccagagtgtcaattcttgtcatagctgcgcttgtggcaattctaattcctgggacaaagcagatgaagatgatattaaacttgttaatattcctgtgactactccagagaacttatacttaatgggtatggcagtgttgaagaggcattgcgtcgatgggac

SEQ ID NO: 216854 - DNA, 571 bp, Homo sapiens
gctcttaaccacaaccacacttctcctttcttactctcagatatgacctcatgaactccttcacttagaaactagagatgggaattcttgcacttttactctccttcaagtgtttctgtatattgttacctatctctctccttccttattcccaaggttaattggttacctctactcttcccgttcccttctgaacttttttctctgttatcttcacttcctcttatatctgtcttctgtctttccttcttcgttgactcaagtatcttctattctgaaaaataccttctctgctctatttccctgccattgcacatttgactcttccttctctttactgatggactttctaaaagagatgtacatagaaagttctacctccactttttttagccaactgcaactgggtcattagttggactctactacctcagctcaactaattttatatgcatccacttcttttcagcccgcatcctgtctgccaagttatgatactactgatcatttttcctttggcttccataatacgctatcctaatttttcttctaatttttgggttgctcttct

SEQ ID NO: 216855 - DNA, 404 bp, Homo sapiens
atccctggagtctctctgaatctgctgtgattctggaggctgcctgatttgtgaattgttcattgctcaattaaacccctttaaatttaattcggctgaagtcagtcagtctgtctttttttctttttctttcttttcttttcttttctttctttctttctttctttctttctttctttctttctttctttctttctttctttctctctctctctctccttccttcctttcttccttccttccttcctttctttctctttctttctttctttcttccctttcttctctctctttctttctttttctttctttctttttccttttcctcttttcttttcttttgacaaagtgtcgctcttgttgcccgggctggagtacaatagcacaatctcagttcactgcaa

SEQ ID NO: 216856 - DNA, 431 bp, Homo sapiens
ctgtgtatacatctgccccttgtcaccagtctttaatcttattttacttgaacatttccttgtgtctacgtagtttatatatttgtaaaatgttctcatatttctagcctcttcattctcagttctgtgtatttgagttgtttccaataatgtctcagtaatacaacagtgatcttactattttaaaaaagattttactctcttggggtatttcccatctttgaaactgtagggacaaaggttaaaaaacgtttctgtatcttctgtaacattttgacagattgcttgccagaaagattgggctatcagtatgtagatgtatctgtttcacaatcctcttgtcattttatttacttttgttcatttagcatgtgaaaattggcactagagactagtgttaattccattttctttacaaattgatattttac

SEQ ID NO: 216857 - DNA, 230 bp, Homo sapiens
ttggctactgtgcctccaaaaagaaagtaacagacttagtaaagacttagaagaacaattatgaaaattctaatagaatacttttctcactgggaaagcataaaacaatcctatctgtttatctagaaagatgaaggctgagaagggctataatcaaagtttataaaatcgagccagggaggaaagtactagttcattatgagcaggagcccttcccttcactttcagga

SEQ ID NO: 216858 - DNA, 510 bp, Homo sapiens
ggctggagtgcagtggcgtgatttcggctgactgcaatctctacctcccagtttcaagcgattctcctgcctcagccttcctagtagctgggattacagacatccgccaccatgactggctaattttttatatttttagtagagacagcatgttggccaggttggtctcgaactcttgacctcaagtgatcagcctgcctcgcctcccaaagtgctgggattacaggcgtgggccaccacacctggcccattttcattttatatgtaagaatcaccacatgtatgtgacgtatttattataaattatattgactttattgagcctcccagactcgttggtatttctcactggtcacccccaactcttaacttatagtgcccctttttattattttttgagacagggtctagctttatcacctagtctgggtgatcatggtggcgtgatcatggctcactgcagcctcaaactcctgggctcaagtgatcctctcacctcagcatcctaag

SEQ ID NO: 216859 - DNA, 469 bp, Homo sapiens
ctgtgctacagctcagtatgggtggtggtggggtcagcctattaccaccctgacacccgttaggttagaggactgggggtccaagcacatgctatggtataccatcacccagagaggaggagccgatgggcaggaggctcgggggcctggagcagccgtcccagctaaccatcagactcccaccagccctgaaattgggcccctggacagtggacccgagatggccatcaagaagagctccttcctgggaggaggacaaaggcccctgggcaggtacgatgtacctgctgcaatgtgtgagggcggccccacactacccacaggtactgatgtcacagagcaacggctgaccatggaggactgaggggatcttacaaaggaactctgggcctcatctgactttattaagttgattacattgttgtctggccaacgggcaagaagagctgtggtcagagaataggccatg

SEQ ID NO: 216860 - DNA, 114 bp, Homo sapiens
taactaatacatgagaaaaagagaaaaaaaagaccccatcttgcttaaggcactgttattttctattttctgtcacttacaactaaatgtgacaagtcccttctccagttaatt

SEQ ID NO: 216861 - DNA, 315 bp, Homo sapiens
gatctgcccacctcagcctcccaaagtgctgggattacaggcgtgagccaccaggcctggccacctctttgtatctttaaacaccagccagtgacctccaggaccctggggtggacttcagggagggaacacaccccaatttgtttggaaatttgggcatccactttttcctggtgctaagacccctttctaatgggttcccaaaaagacttcataatccctggtctaaatgtttttcgggaggcatttggcttagttggaggataccctgatgctgggaccccaacattagaggttgaaaggatggtagcccag

SEQ ID NO: 216862 - DNA, 421 bp, Homo sapiens
agtgccaggaagatgaaactgaatgtcctggatgcccgctttgcttaattactaattacgttcgttcactcgaagccactgcataagttgcccacagccacctgcagggcctctttagtgcagagaaaaacatgcctaaggcttttctccatttgaatttgttttaagtcatctgcatgggctgacgtgaaatagcaagtgaacaaaacaagttgcagaatggagtgtgtaaagtaatgccttctttgggagaaaaggtttctttctctacggctccactaatgtctgcaagtaaaaatactgatcagctctacggagtggaaatgaagatggggaacttacgctttttatttcattcacgtctacattgtttaatcactttaacactttaaaaaataaatatgttcacttagtatcttta

SEQ ID NO: 216863 - DNA, 992 bp, Homo sapiens
ctttgatgaaactgccactaccagttcatttaagttttattcttttccatgctgcctttgccctatgtctcagacttcaatgcatggaccaaaagacctttccagtaataaactcttgagatgcttagaattattgccaccctttgatgcctttctactttacttaaaaagaatattctcttttcctgtgattaattctttctcatttctcattttttccttatccttcaagtaaacatacccacaccttattcatcctcaaagcctagccagacactcctgaatctttagatgtatacatcttcagatcaggtggagaaccccatctgtacttagttataaaggaacacttcaaatcaccattgactgtcagctatttatttctgctaccaagaccaatatatgttttttatttcataaagatttttcatagcgagtataaaaactactttgtaattaatgccctcctaaatcaccagttcttcttctctttctgcattctgggctcaaaactttgttggggaaaatggagaaaaatgaagactttacctgccaaaaagcatggtgccaaaccattgatgtgtacctgccatagttacccactttttttttaatcaggaaagaccttattaacacattcatccccaacctctccattacctggtgatctagtttgtgaatgaagatgttcaaaggtgttgattgttttttagtttttgttacaggtctctcctttgttgcaccttaccaagatttccagaccaatggcttattcttattgtctcttttatttattgcttagtttctcctcatttcactgagaagtgccttcaaattctgttgaattccctgaaattctatgaaatctatagatttttcttaacttattctcctgatatttttgcatctgaaagaaaccaaagtacttagttaactgctagactacaaggtgaagtggccttcattgcatatcccagaaagaatccagagca

SEQ ID NO: 216864 - DNA, 411 bp, Homo sapiens
cagaccaaagcctcgtatccagttaggagcaggatcagaattcgaacccaaagccagctgactccttgttctggtcaacacggttggtgctctcccgtgcaggatttcactcgtccatttagtgtaataagatggagagacgacagatggaggttcgattcgctactccgtcatttactggcccggccaggtgctgtcaggagggttaattcatgtctcagatcttagtttcctcatctgtgcaatgggataacaatggttcctccctcgtgggtggatatgaagtttaagcggggtcatgtggacaaaatgcctggcacagcgagtgcatagtaagccctttttttgtttttgttttttttgttttgtttgttttttgagactgatttttaagactgtcttaaaaacaag

SEQ ID NO: 216865 - DNA, 417 bp, Homo sapiens
agaaattgcataggagggccgggctcacgcctgtaatcccagcactttgggtggcccaggtgggcagatcatgaggtcaggagatcaagaccagtcttgccaacaaggtgaaaccctgtctctactaaaatacaaaaaattagtcgagcgtggtggtgcacacctgtagtcccagctactcggaagcctccacctcctgggttcaagcgattctcccacctcagcctcctgggtgtctgggaccacaggcctactgccacaaaaccgcctgcctcggcctcccaaagtgctgggattacaagcgtgagccaccgtgcacagccctgtagtttttattttaggagattcttaagcaaaaaagcctgaagcccagagaattaaatctcttaaagagaatggctagattaaatgagaaaa

SEQ ID NO: 216866 - DNA, 467 bp, Homo sapiens
agtccatttttatgcatggaaaaaggtatcattctggttttatttttctgttctggttatggatattcagttttcccagcaccattttttgaaaagagtgtccttttctcaatatatgttcttggcaccattttacaaaatcaattttctgtaagtttgtggatttatttttgggttctctatttttccattggtctatgtgactctttctataccagtacatatggttttgatatagttttgtagtatattttgaagccagtaagtgtgatgtcactagctttgttctttttgtttagaatttctttggatattcttttgtcattccatacaaactttaggatttttttctctatttttgtgaacatagaaattgcactgaatccgtaaattgcttaggtagtatggccattttgataatattaattctttgaatccgtgaacatggaatattttcccaaaaaaaa

SEQ ID NO: 216867 - DNA, 427 bp, Homo sapiens
tttttttaaaaaaggccaggcgcagtggctcatatctgcaatcctaacattttgggatgccagtaacattttgggatgcccactggagtgggcaacatagcaagacccatctctacataattttttttaaaaaattagccgggcgtggtggcgcgcgactgtagtcccagctaccatggaggctgaggcggaaggatggcttgagcccaagaggtggaggttacagtgagcgagactgcctcagaaaaaaagaaaacacgagcattagaacaaatacctaatgtatgcggggcataaaacttagctgacaggttgataggtgcagcaaaccaccatggcacatgtatacctatgtaacaaacctgcatgttctgcacatgtatcccagaacttaaaagtaaaataaaagaaaaaaaattgaaatgta

SEQ ID NO: 216868 - DNA, 605 bp, Homo sapiens
atgcatcatctaccacgcagatcaaataagccttagagtggttttatactccaggcttgtgtttctctcatattcacccaagaaggccagaactaaaacctacatagcattcaggcaaatccttcttgcccccagagcattgaatgtcccctccaggttactgaaatcctctgcttcaccccattactttccctaattagggtcttatctcccactcagtagagctgctttctgagccccatgctggtcccccagtttcttcagcttttatatacaggacaagttttcaagtcttactaaattcatatatagtcaataagtatttattggacttttacctaatatgtgccaggcattgtggtaaatacgtagtaaacaagacaggtattgtctgtgttcttatggagcttacagtctagcagagaagacaggcattgagcaaacagttacaactgtgacaaacttcagaaaaaaagacaaatgcaagactgtgggcacataaaatgagaggagataagatgggggagcagggatcaagaaaggcaccccagagggcaagtaggatagtatgggacgtagtgacgcggaggacatgagcaggtgtc

SEQ ID NO: 216869 - DNA, 630 bp, Homo sapiens
ccgagctctgtgctttggagtcagatctcatttaaacccagcagcacatcccatttcacacgtgggaaggtgggggagtcaggatcagagagcagggtgtcgcatgggggagcagccgggctgcgatgtgaaccctacagtctgcccatgagccgcactcctgggctggacactccagagccttctcaagcagctttcttggggctccctgagcacctggctggatgctgctggtctggaactctggacgggggccccgggagctgacctgcaaagctgtagagcgactgtgaggcactggcagctttgcagcccctctggacccagggtggggtgggctgagcatctggccttctgggtctatctgggaggcagggctgtctcagatctggggccttctgagaaagatgtcgaacccaagcttccttggggaaggaggcagatggaccccagatcactctcctgggtgtgaaatcagctttgggggtgccttcggggtcgggcagaactgggctcacccagctctcgccttttctggctgtgtcacttgggtgagctcctgagcctctctgtgcctcggtttccctgttgattaggtcaggccaaggattaaatgatggcaaagtcgta

SEQ ID NO: 216870 - DNA, 212 bp, Homo sapiens
tctttaagacaggctcttactctgtgtgccaggctggagtgcagtggcacaatcacagctcactgcagcctggacctcccgggttcaaacaatcctcctgcctcacattcctgaagagctgggactacagttgcgtgctactatgaccagctaattatttttattttttatttttgtataaacaaaggtctcactatgttgcccaagctggt

SEQ ID NO: 216871 - DNA, 623 bp, Homo sapiens
tgtgaaaaggtgttactggtccatctgttggaggtggcacaagcctgaccagtgttaggggattcgggcctctgccccctcttcaggggagtgtgcactggtgccagagccacgttgtctcaaagacagcggtgcccctcgtgacagcgctgcctggctctccaaggccctgacccaagggagtggctctaagtctagtggagtctctgcttctttgaaaaattcagcttctaacactgccatcacacaccaggtactcttgccctcagctattccgctccagaaaagctaactgctgagagccaaaatagtaagagcactgctgagaaagaggtttttaaaaccagcgtgcacctaaaagaggggaagaaaggccagtcctttcttttcaggagcttcgtgttttatcatttctccctcccgcgacataatgaaatactagcatccgacggatcttcttagaaagcatactagagacccagagacgttattactctatttcaaagcagcaatgtgcatgtctgcacacatttcttagaatcatgtgatgaaaagaagacccttcatgaaaaatatagacccattaaatcaaaatgtgctttttgaaatacaaagatgctata

SEQ ID NO: 216872 - DNA, 403 bp, Homo sapiens
cagtgattttgaagattccctcattcccagtattttaggagctaatggctttggtcaacaacagtcttttcctttaggaactctttggagaaccatgatacctttagtggctttcacaagatcactgatgtcactaaatgtttccatagcttgctcacccctaccttagtccacatgacagaaccccaggacctcagtcctgatgtccgtaagaatcactggggagattgttggccaagcaggtttctggccaaattatgaagatccagatgcagtaggtatggtgctggcattaggggcaaaggctcaaaaccaaggaatcagaggaagaaactcctcagggcaggaggaagcagaaggcaccacgatggcacccccagaggctgcagtgacttccctgctg

SEQ ID NO: 216873 - DNA, 280 bp, Homo sapiens
gtattctatttatatcttatttttaacatcccctgctcccaaattagtcattactattatcatttaaaatagatgtatccatgttgagccaactgtctttgttccatatagttttttgtataatattgtttcatttaggatcaaagtacaaccttaaatagttctttcagagtctttgagtaatcaactctctaagtctttgcctttgtaaaaatatctttatttcttctttattataagacatatttactgttggaaaataacttagctgggtatagaa

SEQ ID NO: 216874 - DNA, 514 bp, Homo sapiens
ctagctacattttgtattagcttcaaaaattgtaatagattatttggaatattctatgcacacaattatataatctgcaaataggagcaggtttttttgtttccaatttgtattttgttttcttttgtgcgtgtacatgaaatctacaagcaatctgtatgcttttaatcattttttgcctgttgctttggcttgtattttcagtgctgtgttgaataagagtggtgagagtggacattcttgtcttcatcccaatgttatggttaaagcatagtcttttgctgttaagtatgaagttatctgtaaatgttttgcagatgttctttatgaagtgggaagtttttatttctagtgggctgtaagtttctgtcatgaatgggtgttggatttgtcaaatgctttttctgtgccaattgtatggttatacaatatttctgttatatatatatgttgatgtgatgaaatacactgattaagttttaaatattaaaacaaacttttgtactggaaaaaa

SEQ ID NO: 216875 - DNA, 111 bp, Homo sapiens
gaattttagaatttttatgctgtgttgtgggattataggattataaggtattttcttttctcctcaaaagcaagaccttaccgtttaattgaagagctcaaacagctcaag

SEQ ID NO: 216876 - DNA, 225 bp, Homo sapiens
gtgttcacttttacccatttttttttctttctgtattgcagtttggataatctcaactatcttcaagttcactgattcttctgtcaatcccaatctgctatgaaagcccttctagtgaatttttcatttcagttattgtagtttccaatgacataatttctatttggttattttgataatttttatctttattggtattttttatgatgagacattattctcata

SEQ ID NO: 216877 - DNA, 216 bp, Homo sapiens
aagtgttggaagtagtgggctagaaaaagctatccaaataaaaattctaaaagcaactggggaggttttattacaacagacaaattaggctttaaggacccgtatgagatggtagaaacattcaccaggaagaagaataattctgatcttatttgcaactaacaggaaagcctcaaagtgtaaaataaaaaactaagacccataccccacctccct

SEQ ID NO: 216878 - DNA, 460 bp, Homo sapiens
gaactctgatatagttgccatatttagcaaataaaactacaagatgtccagctaaatctgaatttcagataataaacaataacttattaaagtaatacattattagtaacttatttattatttatctgttctcgaatgtaactgggcatcttgtattttatctggcaccccaaatctcagagaaagttagacagcgagatatttggggaacacattccaggcagagggacagcatttctgctggggcagaattctcaggagcagagggaagagcaagagtgaagacttgagttctttgagaaacttctaggagggaagtgcagctggagtgaagagaatgagggaaacagcaggagaagatgagttcagagagattgtggggaactattaggttagtgcaaaagtaattgaggtttttacaatgcgatgccaccttactcccggaagaatggccataatc

SEQ ID NO: 216879 - DNA, 413 bp, Homo sapiens
ggggctcctgggcaggacctgggcttctcttcctcttttgctccctggcagcacctggtatagggtcagcacacagtgctgacatcccctttgcttcaaaaagcccaccccctacaacacagacaaacctcaaaaacatgatgctgagcaaaagaagccagacacaaaaggccacatattgcaagactctgttcctatgaaacatctagaagacgcaaatccatagagacaaagagtacggcagaggctactgggggtgaggaaaagggttgggagttgttagttaatgggtgcagtttctgtttgggatgataaaaaaaattctggaaatggataggggtgatggttacacacattctaaatgtacttatgccaatgaactatacgcataaaagtggttaacacagaaaatt

SEQ ID NO: 216880 - DNA, 1010 bp, Homo sapiens
gagacaaacagttgcattcttctgcgtttctgattagcctttccaaaggaagcaatcagatattcatcgatctcagtgagactctgaaaagaatggggggcaggcttgccccaagcagctgccagctggaattaatgctgacattttaatccagcaacgacaaacatcaaattcagacaacatgtatgctgacaattttgaaggcatttctatttttattccaccactaattttaaagctagcttgtttactaaagttatacttgagtcatgtgaagttgaaaattgcttagacttatttacttaatttatgagcactcttttacttataagccaatttggtagacacaacatataacaataagtgtacatacaaataaacacatctagacgtgtatacacacacataaatgaagacccaatagcttggaaccttagctgtgagattgcagtacaagctcgccggtttgactttgccccagtaggtaatccaaggaaggctgggaaccaaaatttcgggtaaagcagtctcaacaaaggctaaacctcccgagactccaaggagcactggagccaaacagtaccaaaggagggtgtcacgttaaccaggccccctgcttagaacagcagcacaaaaccctggatccatgcgacgccatcccactttcccattagacagtaaacttcagattctaaaaaatttgggggccaagcagcattgcaaccgtgagagaaaattctaaggagggcttattactagacctcagaacctctgctgagaatgtcctctttgaagagcttgaggtccggaggatcccctgaagtgtccttctgtggggtccaatcttagagctccaaacgtctctggccttaggtgggcaccggtgccgctctgcatgtgttccctccagcgcccactatgagctttcctttggtacctgagtgtaatccctgacttttagcatccttataatttcataaggccatgcttttccctgcttcctgttccat

SEQ ID NO: 216881 - DNA, 484 bp, Homo sapiens
aatccgattcagcaaataaccccacctctccaagccaggactccagagctgccctgtgtggtgtctcagcaaggaaagccaacaaagctggtagacacaggcagaccgtagcccaccgcctgtgagtggaggctccgagccgacttcacctcctcctcagagggaccggcccgatccgaaagggcggtctccaggggtccccatcccgcaccacgcacacagcctggcgcaactaaagaggaagtcggatgtcacatccaacggataaataaagacagcccggccacacaagagccgcattctgggcaggactcctgctaggtttggggaggggtcccagtctgcgatcctttctccctcttcgtgcagcgtcctcctccccggggcccgggccggcggcgcccacgcaacgcggcgcggtgcgagtcccgagagcacctcgagcccccggccccctccccagccccgccgggcccgcggccgc

SEQ ID NO: 216882 - DNA, 508 bp, Homo sapiens
taggtatatacccaagagaaatgaaaacatatgtccacacaaaaacttgtacacaaatgctttatagaagcactacgcataatggcccaaaactggaaacaacctaaatgccctgtgactaatgaatggataaataaaatgtggtatatccatacaatagagtatcattcagccataaacggaatgaagtactgtacatgctactacatgcattaactttgaaaacatgctgagtgaaagaagccagtcacgaaaggccacatagtgaatgattccatttacggtattcccccttatccatagaagatacattcccaaacacccactgaatgcctgaaactggatagtactgaaccttatatatactatgttttttcctatacatacatacatacatacatttaacttataaattaggaacagtaagagattgacaataactaataataaaatagaacaattataacaatatactgttcgtttcacagaagtataagatagttcttac

SEQ ID NO: 216883 - DNA, 508 bp, Homo sapiens
tgacatgaaaggccctgttggcctgtggacatgcgtggtggaaacccgggagacagtgtgaagcagggctctcacctttgtgtggtgcagttgacgttttgatggctctctttggcgggaggggctgtcctgtgcgttgcaggatccttagcagcacggtagcatccttggacctactcactagatgccagtagcacacacctcccctcactcgcggggtcgtcatgacaacagaagaagtctcctgacacagcccctggggagtgggggtggggaggctgcaaatcgcccccaggtgagagactcactggtatcgatggtggggacacaggctttggtcctcagagagctgggtttgtgttttaactccgctgtccactctgagtcatttggggcaaatttcttaacctctttgagccccccgtttccacaccaataaaatgggaataatggtaaccacacccacctcgtggttgctgtgagcattgaaggaatgagtgcacataca

SEQ ID NO: 216884 - DNA, 1924 bp, Homo sapiens
  misc_feature (1488)..(1488): n is a, c, g, or t
  misc_feature (1490)..(1490): n is a, c, g, or t
  misc_feature (1493)..(1493): n is a, c, g, or t
  misc_feature (1570)..(1571): n is a, c, g, or t
  misc_feature (1594)..(1594): n is a, c, g, or t
  misc_feature (1636)..(1638): n is a, c, g, or t
  misc_feature (1643)..(1643): n is a, c, g, or t
  misc_feature (1648)..(1650): n is a, c, g, or t
  misc_feature (1652)..(1652): n is a, c, g, or t
  misc_feature (1656)..(1656): n is a, c, g, or t
  misc_feature (1658)..(1658): n is a, c, g, or t
  misc_feature (1660)..(1661): n is a, c, g, or t
  misc_feature (1674)..(1674): n is a, c, g, or t
  misc_feature (1692)..(1692): n is a, c, g, or t
  misc_feature (1701)..(1701): n is a, c, g, or t
  misc_feature (1708)..(1708): n is a, c, g, or t
  misc_feature (1720)..(1720): n is a, c, g, or t
  misc_feature (1730)..(1730): n is a, c, g, or t
  misc_feature (1773)..(1773): n is a, c, g, or t
  misc_feature (1781)..(1782): n is a, c, g, or t
  misc_feature (1784)..(1785): n is a, c, g, or t
  misc_feature (1789)..(1789): n is a, c, g, or t
  misc_feature (1797)..(1797): n is a, c, g, or t
  misc_feature (1801)..(1801): n is a, c, g, or t
  misc_feature (1899)..(1899): n is a, c, g, or t
agcggacggcaagtcggaggtagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcaactaaananaanagagttgaaagagaggccttaggattctcctctctctaggtgctgagccctcacctccctgttccaggctgagaacnnaaatggttaccctgcttcttccnacaatgctgtgtgatatgggtgaacccagcccctgaccaacnnnaaacnccaannnanccancnannaaccacctctctntattaaacacctgtttancccaacctntttgagntcaagctgtganaaagaagggnccaaccaatttcccctcaactagtccatttacgattctcactnactccccnncnncctngcagacanaaanaaacccagtgtcaggtctaggaaattaatggctattcttccccagaaacattctggcttatttgagatacatgattctcttagaatcctgtcccttgnttcaggaaagtagcttggaaaagga

SEQ ID NO: 216885 - DNA, 2314 bp, Homo sapiens
  misc_feature (1878)..(1878): n is a, c, g, or t
  misc_feature (1880)..(1880): n is a, c, g, or t
  misc_feature (1883)..(1883): n is a, c, g, or t
  misc_feature (1960)..(1961): n is a, c, g, or t
  misc_feature (1984)..(1984): n is a, c, g, or t
  misc_feature (2026)..(2028): n is a, c, g, or t
  misc_feature (2033)..(2033): n is a, c, g, or t
  misc_feature (2038)..(2040): n is a, c, g, or t
  misc_feature (2042)..(2042): n is a, c, g, or t
  misc_feature (2046)..(2046): n is a, c, g, or t
  misc_feature (2048)..(2048): n is a, c, g, or t
  misc_feature (2050)..(2051): n is a, c, g, or t
  misc_feature (2064)..(2064): n is a, c, g, or t
  misc_feature (2082)..(2082): n is a, c, g, or t
  misc_feature (2091)..(2091): n is a, c, g, or t
  misc_feature (2098)..(2098): n is a, c, g, or t
  misc_feature (2110)..(2110): n is a, c, g, or t
  misc_feature (2120)..(2120): n is a, c, g, or t
  misc_feature (2163)..(2163): n is a, c, g, or t
  misc_feature (2171)..(2172): n is a, c, g, or t
  misc_feature (2174)..(2175): n is a, c, g, or t
  misc_feature (2179)..(2179): n is a, c, g, or t
  misc_feature (2187)..(2187): n is a, c, g, or t
  misc_feature (2191)..(2191): n is a, c, g, or t
  misc_feature (2289)..(2289): n is a, c, g, or t
agcggacggcaagtcggaggtagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcaggtaaggcctcttgccttctgcccactggtgctgtccacttaggtgttcagtgaaggaagtatctgggaaggatgcaatactgctagacctaggtggaggagggatcctctcttgtgatctctctcagaagaaatagagagatcattcattagattcctcttctggatcctctgttgttttctgggcttttctctatttcatgttccattttccttattttctagctacaagatttaggccatcctccaaaagagctggctggagagatggtgagtatgtcttatttttccagattttaatttgagtccccaatttccagaattctttaacctctcaggattccacctaaggtgaaaattgtggctactggggatggatcttcacgtctgtcctaaaaaatgagcaactatctgagtcccttcatctcttccccagcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcaactaaananaanagagttgaaagagaggccttaggattctcctctctctaggtgctgagccctcacctccctgttccaggctgagaacnnaaatggttaccctgcttcttccnacaatgctgtgtgatatgggtgaacccagcccctgaccaacnnnaaacnccaannnanccancnannaaccacctctctntattaaacacctgtttancccaacctntttgagntcaagctgtganaaagaagggnccaaccaatttcccctcaactagtccatttacgattctcactnactccccnncnncctngcagacanaaanaaacccagtgtcaggtctaggaaattaatggctattcttccccagaaacattctggcttatttgagatacatgattctcttagaatcctgtcccttgnttcaggaaagtagcttggaaaagga

SEQ ID NO: 216886 - DNA, 1814 bp, Homo sapiens
  misc_feature (1378)..(1378): n is a, c, g, or t
  misc_feature (1380)..(1380): n is a, c, g, or t
  misc_feature (1383)..(1383): n is a, c, g, or t
  misc_feature (1460)..(1461): n is a, c, g, or t
  misc_feature (1484)..(1484): n is a, c, g, or t
  misc_feature (1526)..(1528): n is a, c, g, or t
  misc_feature (1533)..(1533): n is a, c, g, or t
  misc_feature (1538)..(1540): n is a, c, g, or t
  misc_feature (1542)..(1542): n is a, c, g, or t
  misc_feature (1546)..(1546): n is a, c, g, or t
  misc_feature (1548)..(1548): n is a, c, g, or t
  misc_feature (1550)..(1551): n is a, c, g, or t
  misc_feature (1564)..(1564): n is a, c, g, or t
  misc_feature (1582)..(1582): n is a, c, g, or t
  misc_feature (1591)..(1591): n is a, c, g, or t
  misc_feature (1598)..(1598): n is a, c, g, or t
  misc_feature (1610)..(1610): n is a, c, g, or t
  misc_feature (1620)..(1620): n is a, c, g, or t
  misc_feature (1663)..(1663): n is a, c, g, or t
  misc_feature (1671)..(1672): n is a, c, g, or t
  misc_feature (1674)..(1675): n is a, c, g, or t
  misc_feature (1679)..(1679): n is a, c, g, or t
  misc_feature (1687)..(1687): n is a, c, g, or t
  misc_feature (1691)..(1691): n is a, c, g, or t
  misc_feature (1789)..(1789): n is a, c, g, or t
agcggacggcaagtcggaggtagcaagatggccgccgctgaggaaggctgtagtgtcggggccgaagcggacagggaattggaggagcttctggaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcaactaaananaanagagttgaaagagaggccttaggattctcctctctctaggtgctgagccctcacctccctgttccaggctgagaacnnaaatggttaccctgcttcttccnacaatgctgtgtgatatgggtgaacccagcccctgaccaacnnnaaacnccaannnanccancnannaaccacctctctntattaaacacctgtttancccaacctntttgagntcaagctgtganaaagaagggnccaaccaatttcccctcaactagtccatttacgattctcactnactccccnncnncctngcagacanaaanaaacccagtgtcaggtctaggaaattaatggctattcttccccagaaacattctggcttatttgagatacatgattctcttagaatcctgtcccttgnttcaggaaagtagcttggaaaagga

SEQ ID NO: 216887 - DNA, 438 bp, Homo sapiens
aagagcaaagtaaacaaacaagaaaggccgtggatcttggttgatgccaacagatgccgtgtcgtgaagatgctctgaaggaaagacgttgacggggtctcctcactctcctgggcccttctgactagtgactgtcttctcactgctgctgctaccagtgcccagtttgttgcctgaagccaaaagctgaaagctcacataatcttttgaagagtactacataagtaaattgagttctcataatgaagaatagctgagtaaacactgccacaccatgtggctacatgcatttcctaagattaaaaacatttgcagtcacagaaacagacatgggataggaaacacaggtctattttattttgtgggttttgaaattaagccaattgtttacagtaaaggcgctgaagttctgcagattaaaagaatgaattaaatgta

SEQ ID NO: 216888 - DNA, 309 bp, Homo sapiens
ccagagtgagacaggagaggtaataaagccaggttgggcaggctttgcaggacactgtcaggcttttagctattactcttgaactcttttgagcagagaaacaataggatttaaactaacattttaacaatctttctttctttctttctttctttctttctttctttctttctttctttctttctttctttcttcctttctttattgagagggagtttcgctcttgttgcccaggctggagtgcaatggcaccatctcagctcactgcaacctccgcctcccaggttcaaatgattctcctgcctcagc

SEQ ID NO: 216889 - DNA, 205 bp, Homo sapiens
cctgacacttcctctggtcctctctgtcctccctgggctcagacccccaaccttgcaaggggacaatgccccctccccagcccattcctgctgagcagccatcaagactgagaaccaagggccgtggagtgcccagttctccgtacctcctctcctggacacggctcaccttcccagcagctcccatgggcagccctccagcctc

SEQ ID NO: 216890 - DNA, 329 bp, Homo sapiens
aataaccaaatgctattccttttggcctgttacctcaaacctaatatgctaaaagagcatcctcatcctctacggcttgaattccttaacaaattattataacttatctggcaacaaattatatcaaacccaggtaccatctctccacaactctcccttattggagtcaagagagaggtgagggccaagggaggaaggaaatttactttatgccaatgcattggaattaagaaatatcaaggtgatttgaactgatccaggaggcttgtattagtcttgttcttatgctgctaataaagacatacccaagactgggtaacttataaagg

SEQ ID NO: 216891 - DNA, 255 bp, Homo sapiens
tgatgtgtattacattgatatctcataatactttatatcaccttttagcatttattttattattttagattgttttttcaacttagagccacgtgctttagaagattattatgtaacttgacttaaattctggtaggttaaacctcttcaccatctttttatttgaaaaatgtcttcttgaaatgtcttattcgatcactgggctagaaaatacaagatgagactgagacatcttgcagtgctcaaaataagaaa

SEQ ID NO: 216892 - DNA, 485 bp, Homo sapiens
atggaagtgttaatatcatgaatgcatttattcaaacactttttcagctctcacaaagttttgttataaagacgattttatttcctctcacagcaacatacagaaggagcagctgttattgcccttagtttacagatgagaaagttgagacttaaagccattaagaattttgtggtagcaaagaaggatcctgtatttggtaaatttgggtgtaattatgagtttaatgtatgcctttttggcagtatcctttctggcttcatcatgctatatccccattgtccacaacattgactggtgcttagtaaggtgctcaaggacgcatcaaatgaatgaacaaagactagagacagagttgcctggccttattctttaaatacccacactataggactgcaacaaaatacagagccctagtgattagaagacttcaaaagtgtgttttctttttccaggtgcatgcctttgatttcttgagatgatga

SEQ ID NO: 216893 - DNA, 243 bp, Homo sapiens
tcagtttcataagtaataacttggcttatatgcattgaaaaagagtggaagggtgtatgctaaaatgttaataggacattagctcaagtagaagaaataactcttaaaccaaaaatagaaataactcttaaacaagagttattaagagttaagaaataactcttataccagtaaatagaaagtatttgacacttacatttatacatttgctcactcattcatttgttttttttactttaaaga

SEQ ID NO: 216894 - DNA, 430 bp, Homo sapiens
tgtaaaacaccgaggctcaggggagtgaaggaagacttgtcagcaaaaaggaaaacctagtgaagactatcgttggtcttgctccttttatcaaggagtagaggggctggggtcgcctcgggaccccacagcgacccctcttgctctcttcgcggatgaggcgcaggctgtcagccggaaggcctggcggcgtccagacgacttgtttgccttatgttgtaatcaataaggaacgccggcctaggaatcaggctgacctgggatccagctccgctcctgtgatgtcctatttaaatgtgtttaatcctcccttacaaaataaaaataattgcggctaccacttttgacatctgctgcattaaagatacttcagagtcggagttggtctgcaggaaggcgaagtaatgtttatggcagtattcatgtgtgt

SEQ ID NO: 216895 - DNA, 611 bp, Homo sapiens
tgtaaaacaccgaggctcaggggagtgaaggaagacttgtcagcaaaaaggaaaacctagtgaagactatcgttggtcttgctccttttatcaaggagtagaggggctggggtcgcctcgggaccccacagcgacccctcttgctctcttcgcggatgaggcgcaggctgtcagccggaaggcctggcggcgtccagacgacttgtttgccttatgttgtaatcaataaggaacgccggcctaggaatcaggctgacctgggatccagctccgctcctgtgatgtcctatttaaatgtgtttaatcctcccttacaaaataaaaataattgcggctaccacttttgacatctgctgcattaaagatacttcaggtatggtattacctcgtttaattattacaataattcataaaataggtattggtgttcgttttgcattagaatgcaggcttggagaggtgaagttacttgtctaaggcaagcaaataataagtataagaagagccgggcaccgtggctcatgcctgtaatcccagcactttgggcggggcgctgatactgagctagtgtgtgccgctggaggctgaatttggtgagctctcttaaccca

SEQ ID NO: 216896 - DNA, 192 bp, Homo sapiens
tgtatgtacacacatgcacatgtgtatatgtgtatataaaatttttgtcatgggagttttatatataattaagatagaaattatatattattgcacacatttttacacatatgtaatattctctaccatatgtatgtaaaatacacccatatgaattatgtataacataaatatttgtgttatcctgaaaca

SEQ ID NO: 216897 - DNA, 504 bp, Homo sapiens
gaaactgaattgtgttttgtccataaagaagatgaaattgtctacagagaacacattgccattcacaaggttgaggggataccacagagaggctcccactgtgatttgcatttgtcaaaagttctagagaattcttcaacagtacacacatggttgttttaaatatatcattgttataaaaattcgttttgagttctgtttcacagaaagtttttttgaatgaatgaatgtcatatatccttgctaaaggagctcagttaaaaaaaaagggaccatccttctcttttgggggttgtacagtaacacattcccaagaaagaggtaacagccacatacatttttcttcccaataaagagtgtgggtttttaatatgaatccatagtatgatttctgttatgttttgtgctgcttcataaccacactcatgcacttttcagaaaattaataccattcattagcataaatcataaactattcccttggtatgggtttgaaattggggg

SEQ ID NO: 216898 - DNA, 851 bp, Homo sapiens
cctgataggacccatattcccacagcactaattcaacatataccttactgagagcatgttttatcattaccattaagaagttaaatgaacatcagaatttaaatactccttaaccaaatacggcttggacttttgaatgcatccaatagacgtcatttgtcgtctaagtctgcattcatccaccagcctaggcctcctgtcttaatttcatacagacagaaatgactcccactggggaaagagcaaagcaatacatgtagcactctttttcaaacactggtctttttttttttcttaacaatccaacattgttatgtgttttgcgtctcatattgacaccttttggtcaaggtagaggacatgtttgttgtaagctttctttttcgtgtagaggatggattcttcactcctgatacacacaatcagtgcacagcagctctcttatacatccagttgatgccttcagtctccctggcttcttacaagcatcttctgggccttgtgtgtccctgggcacctgtccctggtcaattcccgaaagctactgtgctcctcttgcccatctccccttgcaaataatatcttccatcgggggaccggcttcctccaatttcaggagaggtggggctgaaggcacagacttgggcgtcactggcacagatataagtaaatacagctggagtctgcagagaggctggactgagtcagggagtcaggaaagagaagccacacacaaggacaaccaatcatgtttctcataatcttcttaacctagggaataggacacaatcattttttctttttaaaacatctttatccctgatcagcctcatttcctcaaaaactataaa

SEQ ID NO: 216899 - DNA, 873 bp, Homo sapiens
tttgtctttttgtcccatttggtggaagaatctgtgatccctccttagggtctgcttctctttctctctctccctatcctttttgcaatggctcgttcattataacccgtgggggatttagaatctgtggatcatgtaatgcatttcctgattgcctacaatttttatcttctttgctgttgattttaattgtgaatatctgaaaaagtatagtgctcaacaagtcagaagttgaaaatcatgtttggtatatgtgatagacctgtccatggctcctgaaagttgaagccaaagggctaccttctgagtcaaaatgtgccctgagaaccaggtcctttccctggtgcaaccagggccttcccctactcataagctgagaaagacctggggtctgaggaagaactgctgacccagagcaactccaaagtggtatctcaagcatctctggaaggtagtggggagaggcttatatgttgaagttattccattgctctcagcataagactatgtgaggggagggaaagtaccgctgtaagctctgtatgaaacaaatccctatcaggcaaacgctcccgactcgcatttctgcaaccccacgtttgcatctgtctcataagcatgtatcatatcaggatcttattgacatacgcccagaagaacatatgtggagagtgtagctctgaaaatttatcagcaaaggtgtgtttccgataggagtctcagttcctctggagtcattatatttgctgtagattcaaaaggtaaaaatgaaattcaatttttaaaaagatatgtgatacaatagtaagtcctaatgcatgtatgttgttttggacagattagaacaataaaaatcttaatatcttgaaaaaa

SEQ ID NO: 216900 - DNA, 533 bp, Homo sapiens
gagcaaccaacatttattaaggactggcagcgtgcagggccctgtgtggagcctttccatacactgcctcattcgatcctgagatgtggtagcattggtggtgtgtaattttcataccctccgagcttctccgaggctgccccaggcccttggttcctcgccctcagccctggtggtggcagtggccctggagggctacccatgcggcaggggagcggccagcagatggctccaagccaaggcagaacggctcaggaggggtggccagccaggcttgccagtgggccttagtttcccctgctgagcccacagtgcccttttggctgggctcattttccctggagcatccatgcagccaggctcctgggcagatgccggatgagtttcccggggctgccataatgaatcaccctaaaccaggggcctcaaaacaacacacactgactctcccacagttctggagacgtccaaagtcaaggtgtcggcaggacgcgttccttgtggaggccctggcggaggatctgttccagcct

SEQ ID NO: 216901 - DNA, 543 bp, Homo sapiens
gaattggattaatcataatgcgtggtgcatgatacactggcatttttggtccatgaaaaaaatattcatctatcataatgaacagccgttagcccactgtttgcccaagaacttgaatattaccagtaacttacatgtacctatgtggtacttcccattcactttcctgcctgctctctcagaagtgaccaccatcttgaattttgtgtttattattctttgctttaaaagaatgatttttgaactttatcaaaatatggctgagtgtggtggctcatgtgtgtaatcccagcactttgggaggctgaggcagcaggatttcttgagcccaggagtttgagaccagcctgggcaacatggcaagacctcatctctacaaaaaaatttttaaaaattagccaggtgtggtggcatgcacttgtggtcccagctacttaggaggcttaggaggaaggattgcttgagctcaggaggttgaggctgcagtgagcctggttcgtgccactgcactgtagccagggcgacagagtgaaaccctgtctc

SEQ ID NO: 216902 - DNA, 99 bp, Homo sapiens
gcttatgatttctaaatttcccataatgaacacattaaagtaaaaaatacatttaagtatcactcattcgtcttcttccccgattgtcggtgacttcag

SEQ ID NO: 216903 - DNA, 342 bp, Homo sapiens
tgtggctaggagaggctgggcagtgagcctggactagagacctggccttggccaggctggagaagaaagtgacagtgaacagtaaccgcggggatggcagttgtggtgatgacactaggagccaggtgtggtgcaagtgctttacacttatttattctattaactgacacaacagtttcctgaggtaggaacactgtcacctccattttccagggaagaagatgaggccctgagggcttaaatgacttaccttaagtcagacacttgaagcaataatgaaacactgagacataaaaactgtgaaggtgccaggcgcggtggctcatgcctgtaatcccagca

SEQ ID NO: 216904 - DNA, 342 bp, Homo sapiens
taattttaggtaattaatgctgtacctcacatagttaacatttttgtggtgagagcacatgacattgtcctagcattattcaaaaatacattattattaactatagacaccatgctgtacaacaagtcttttgaatatattacttttatctaactataattatgtattattctttgacaaacatctttctaaagccctcttttagataccttggcatctggtggttacaattttattctgtgcttcagtgaatttaagttttatatcattcatgtttaggtgaaatcataaaattttctttctgttcctggcttattaaaagataaatagataaattttata

SEQ ID NO: 216905 - DNA, 337 bp, Homo sapiens
cagaaaggggagagggacctctctgagttctctttataagggcactaatcccattcacgaggactccaagttcatgacctaatcaccttccaaagtttctacctccaaatatcatcacatggggcattaggaattaatctgaatttgaagggtacacaaacattcagtctattcacctagtttcctgatacctagtcctttgatttttctgcttaaagaaggaccaaatgttttagccatggacctaactctttccagcattttattctaaggagaagaaacaaaaagagagtacctgggccacattagattaggatacatggtaatttaaatgggc

SEQ ID NO: 216906 - DNA, 169 bp, Homo sapiens
attctctggagttccacatttccctggagttccacatagaaaacaggcccaacttgtctctattttcagattccataaacctaggtgggggttggaggcatagtcccttttcttgtttttgtttgtttgattgttttaacaaacattttattctggaataattttagtt

SEQ ID NO: 216907 - DNA, 429 bp, Homo sapiens
cgggggaggtcctgcatgaatattttcagtgctgattcagaaagagcattgggcatacacttcaggaaaccctacctggaagctacagcagcactgctctatcctagactgaccacttcagatatttccaacgcggagctggatgtggctaggaaccggctcccagctgaatagcttgtgctgagtcattatcaagttgcatttcctggctcaaccaaagataagcagggaagaacctaaatgaaaaatgactttcagactgtgatttgggttagtataccacctcagggcagcaatggagtcatgactgcacagacacgggaaaggatctggttgcagaaaccaagtgagtcagtgatgatgtatcatcattctaaaaaacgtacctgtactttcttttttttttgagacgagtttcactcttattgc

SEQ ID NO: 216908 - DNA, 136 bp, Homo sapiens
gcttgataattgggcagcgttccaagtttcctccccttcttgaggtactttgagctcttttctgttggtagtctacatatgatcatctctgtgtaggtggtctgcataagactattggtttatatcttctgccatg

SEQ ID NO: 216909 - DNA, 231 bp, Homo sapiens
tgtggcatcctctgtgcatactgattttgcaaacctcttgggaaacacttaaagtgaaattctttgaacacatcaaaaaagtcagcataaacaaactaaaatccctgtgattcccaaaccctaaaaatattctgtgaccaatttcaaagtccccccctcccctccactttaaggttggtataatcctgcctggtcatagggagtgagaaaggagggtttcacacgttcgtt

SEQ ID NO: 216910 - DNA, 493 bp, Homo sapiens
aggctttgctccagtgtcatccttcacagtgaggcccaccccagtcattttattgaacatcgtgcctcactccagtattgttactccttatcctcctcctatgattgattttcctccattgtacttatcagtaaaatattatatattcctctttctatttattcctctacaatggaaggtttatgaaggcagggaagtttgttcactgtaactcagttgcctagaacagtgcttggcacacatatggttatcaataagtattagttgaatgaaaacaatgggctgggctagggctgtatttttgaacccaagttagttgaactagaaagttcctccttcccactaccccatgtcatttcaagaagaaccacagatataaactagactcgtgggaaccattgagttagaggcttttctaggggtatgagtgggagttcaaggaagggattccataaaacactccaaatgtgggtgattgacaaagtagtaccaa

SEQ ID NO: 216911 - DNA, 396 bp, Homo sapiens
ccactgcgcccagtcctggtagcgactttttatttctgcgaaagagaaatagtaggacacaaatagacacacacttggaactacttgaattttctaaacataccactgtagagactattatagtaataatgatgggactctcttatatttggggtgcattaggcagtttacagcatggtttcaagcaaattatgtctttagaatctcacaatatttctttgaggtcgtcagagctggcattgttactcccttcctccactccatttatagatagaaaaactgaagatccaagggcttatgtgagttgcctgggaactcatggccagtaagttgcagagctgtgattcaaattgaaatattgggatcggtcttatttgaaccctggtctggtgctct

SEQ ID NO: 216912 - DNA, 493 bp, Homo sapiens
tattctaggtacctcataaaagtgaaattataacatatatgcccttccgtgtctggcttatttcactaagcataaagtttttttatttttctctgagacggagtttcgctcttgtcacccaggctggagtacaatggcgtgatcttggttcactgcaacctctgcctcccgggttcatgcaattctcctgcctcagcctcctgagtagctgggactacaggcatgtgccagtatgtccggctaatttttgtgtttttggtggagataggatttcaccatgttgaccaggatggtctcgatctcctgaccttgttatctgcccacctcggcctcccagggtggtgggattgtaggcgtgagccaccgtgcctggaagcataaagtttttaagatttatccatgtcataacatatattaaagttggattcttatggctgagtaattgtatgtatataacacattttgttcagttgagagacatttaggttgtttc

SEQ ID NO: 216913 - DNA, 369 bp, Homo sapiens
accatgaggagctgagaagaaggtatatccttttgctttaggatagaatgttctataaatatccgttaagtccatttggctcatgacttctcttagtctgtcgacatcactgtttaatttctgtttccatgatctgtccattgatgagagtggggtgttgaatctcccactattattgtgtgaggtgcaatgtgtgttttgagctttagtaaggtttcttttacgtatgtaggtgccttgtatttggggcatagatatttaggattgagagttcatcttggtggatttttctttgatgaatatgaagtgttttccttaatcttttttgatgacttttagttgaaaattgattttatttgatattagaat

SEQ ID NO: 216914 - DNA, 336 bp, Homo sapiens
ccagcctgggcagcagagtgagaccctatctcaataaaaaacaaaaaacaaaacaattaaaagaacaaagaaccctgttacttggaaagtgttaggattttgattgacattgcattatatctgcagatttattcagaaagaatgcacctcgttaaaattctgtcttctatttcaatcatatccctagtctaatcagtactcatctagggaatgggagactcactggactagggatatgatgaatttgttattgatgcttgataaatagtcataagtatgttcatatacggttcttaacttgctgaaatatattattaaaagcatgtattaaaattg

SEQ ID NO: 216915 - DNA, 469 bp, Homo sapiens
tatatacgtgtgtatatatatatgtgtgcttatatatacatatatatatgtgtgtgtgtatatatatataactaatcccatcatgatggggaaataccctctttacttcatctaaatctaattacctcccaaaggcttacctccaaataccatcacattggaaattcaagttgaaacagaagaattttgaggaaacattaatagtaagcctatagcaaatggcaagacattattagtgagcacagctttcagacatgagtaagttttgaaagtttcaaaactattttgatgagaaaccttcccaaagtatttatatttgtgtacgtgggtaaggcagtgaatttaccttactcattattctttctaacattccacaagctgtttccattggaaatgcaaggtagttcattttcttttttctgagacagaaacattctggaaaagcaaataaagtatcatgttgaggatg

SEQ ID NO: 216916 - DNA, 621 bp, Homo sapiens
agagagagagagagaaagcaaggaaggaaggagggagggagtcagtgagtgagtgagttagttttcagtttactataaatttagtggtgggcacagtagcttgtgcttgggacactgaaacagaaggatggcttgaagtcaggagtttgaaaccagcttgtccaatggcgaaaacccgtctctactaaaaattacaaaaaattagctgggcgtggtggcaggcccgtggtcccagttactcgggaggctgagatgggaggatcacttgagcctgggaggtcaaggctgcagtgagctgtgattgcaccacagcacgccagcctgggaaacagagcaaaattctatcttaaaaaaaaaaaaaaaagacagtggtatttattgcagactattatggtattgtaggccagaggtggtaagggcttctcaaactgttgttttaagaacctgtttccataagacatagcaaccatacttgtcccgtggaaagaggttcctcagataacagttccaaggttgtttaaaatcagcagattgacttttttttaaacttatacttaacagtattaatttacacttaaaacaaataatacagaaatacattctccttgtgaaagttttacc

SEQ ID NO: 216917 - DNA, 430 bp, Homo sapiens
ccaccttggtaaattgcttaagccaaaaacctgtcatccttggctgcatttatctaaagataactacatccgataccatcagcaaatcctgctgactctgcattataaactgtccctttctgtagaccctgccatccaagccagaatcatcttctgccttaaccagcgcaaaatccttttacctggacttccagtttctgtgctcatccaatacacactgtactgatcacagcagccaaagtgatggttttaaagtttgactaacatgtggctgctctaagtactttaaggctacctgtggcaagtgggatgaaatccaagctccttagtgtgctttctttctttttttgagacagagtctctgttgcccaggcctggagtggagcggcgcgatctcggctcactgcaacctccacctccctggttcacg

SEQ ID NO: 216918 - DNA, 513 bp, Homo sapiens
aatatttgtattattagtagagatggggtttctccatgttgtccaggctggtctcgaactcctgacctcagatgatccccccacctcagcctcccaaagtgctgagattacaggcgtgagccaccacgcccggccaaaaaacctttttttaattaaaattaagaaaaatatatgaatatatgagaagtgcttatcctagcacctggtacattccaactaccccttcagagttcaccttgttttcatttgataagtttgggattcgatcgcagttactgggtccccaggtctccctggctctcacttttcctgaagagaacacggaacgtaacctgccgcctgctgcatggcagccagaggcgctgtccctcccggcccacctcagacagtcttgttttccttccagccccttcccaggttcaggttccagcaacatccagttttaggcagcagagttctaagacacgccagctccagggtgtcctcaacccatgtggacatctccctgggtcc

SEQ ID NO: 216919 - DNA, 159 bp, Homo sapiens
tgggaggaagcagagatatatacacttgttcagtttaccagaagcctgctgaatgggaacttgcagcttagcaagaagacccccccaggtgactcacatgcatatcaaatgtttacaaacagatttacagttagttgccatgtctcataccattttttt

SEQ ID NO: 216920 - DNA, 133 bp, Homo sapiens
aggattcttcttgtcactccattttaatagtgtgatggtaagtgatagtagaccattatccacggtaagaaacattataattccttatgactgcaaggagacactttttccctaatagtacacatagatttcc

SEQ ID NO: 216921 - DNA, 713 bp, Homo sapiens
actttgggaggccgaggcaggtggatcacaaggtcaggagatcgagaccatcctggctaacacggtgaaaccccgtctctactaaaaatacaaaaaattagccgggcatggtggcgggtgcctatagtcccagctactcaggaggctgaggcatgagaatggcgtgaacccgggaggcagagcttgcagtgagctgagatcgcgccactgcactccagcctagggacaaaacaaagaaagaatggtgtttcttactgcatggtgaatagtgttagaatcacctgggatgcagattcccaggtccactcatgcctacaaatcagggactctggggacatggctcagaaaggtgaattttaaaatagtgccccagatgtttcttgtgcacatcaatattttaggccctctggcataggataatggaggcagatgtaaagtaaaattcatttcctcactttgcatgttgggagaacatatttatatctcacctttctgtcatcccctttattaccagtgtgagatcatacagtcctcaagaagtattaatgaaatgacttacagaaaaaattttcttaaataacactcttgcctgacacctcttatataagcagaaaggagtctgggacctcagcttctaaaatgggaaccatgctaaggatcaaaaagtgaagacacctggggactccctgtcttgcaaatacaaccaaccacag

SEQ ID NO: 216922 - DNA, 1313 bp, Homo sapiens
taagatagacctaggaaagcatctccacacagaaagagctcttcagcctggtaagacgttcctgcctggggtgtaagcccctctctttgaaagtctccaaataagcaacagttctatcatctattgaagctgatcgtcagcaagacgacttccagtgccaagactactttaccatctaattttagcaatccctcttggcaaaggaagagtttcccctttcctccggctatctggtgttccacacaccatctcctactgcttcctttgatgttgggggattctgtggactcaaggccagatacaacacaggaagagacacactcataggcattacactgccctatctcactgcagcaataagaggcctatttttttttattgtgaatttgaggcactcagtttgaaaaatatgggctgtcaggtttgggattaaaactcagtattgatcattatgtctacagccatgcaaaagtttcttttacttttaagtgctaggatgtttaaatcatgattttatttcagttgttcatttaaagatttcattcatgcttttaattcactgtcagtgaatgcaatttaagcccatcacataatgatagaaagtggctgaaagccatgagaatatgtttctcattgtggaaactacaagttaagtcattttcttctcccgagtaaatttcttcagtttggctaagggaatttttttaaaaggaatcataagttctgaattagtttttcatctcagatgttaaccctatggagcgccaaggttctggaattgcaatggaatggactatgcctaaggctaagacttaaccttatatctgggggtaccagctgctccgctcctacctcgcgtccctcacaggtctccactcatcaagtctctgtctcaataccctcttcacagccaatctacctcctactataccttctctccgacttctcaccacatccactcctctaccccgttctcctcattacccttcagatctccttcctcgactcttccatcttaacgctccgtaatcataattgctatactctaccctcatctcccttctcacatatattccatccacactcacgccgcagcatccttcacgatccgtcgtatcatccttaccttatctcttcttacctacctcttaccctctactatcttcctactctctccattaatgcctccacatcctctcactatccactattactctcctcctcccactgatccagtgtttactgcatcatctcttcgtcacacctatgccactgaccataccatcagcgctcccgatcttcttctctcctcc

SEQ ID NO: 216923 - DNA, 365 bp, Homo sapiens
cctccctccaccttcaaagcagcattgttcagtagagcatttctcatgctgtgctactgaccctcctgttccctctctcactctctcacctacacggatacttgtgaccacattggacctacctagataatccaagacaacctccccacctcacatccttaacctaatcatacctgcaaagccccttttgctaggttaggtagcacattcacaagttctaatgattcacatgtcaacatgttggaggggggcacgttatttggctgccacagaaagtaggttagttgctttttattgctgtataacaaattgccccaacatgtcgtgacttaaaacaataaatgtttatttcctcacagtttctt

SEQ ID NO: 216924 - DNA, 431 bp, Homo sapiens
gatcacttcaccagatgcctctttgcccctccctagttattatttttttgcacattattacatttcttccctgctatataaacccctagttttagtcagtcagggagatagatttgagattgagcttcatctccccagctgtagcacccaattaaagccttcttcctaggcaaaacttgtttcagtgattatctttccaggcggccagcagtaggatctagactgaacccttggtattttggtaacattttagtcaagatgaacatttgagtggatttttataaaaatgtgcctatatacagtttaggaaggtgatagtaacacaagttaaatgtttaagtggattattaaaaaattatgcataagagctgtgcctgctttgacgtgaataaacacagctttaaaaatggaaacaaaatacctttacaact

SEQ ID NO: 216925 - DNA, 544 bp, Homo sapiens
gatggacttggtcagactggggttaagtccagcagtgtgacctgctcatcacttttcttccctgaacccatgtccacctctcataaggttgtatcgaagttccaagaagaaaagcagagcgagtgctttgaaaggacataggaaggaaggtggccctgcccctcaagaccgctgtgctggggtcttggcaaaccccttgcccctggaacagagaccggtacaagacctctggagtggatagtgccagctaggggagggcagagtgaggaaaggccttgttccccaggaggaagagaggtgctgagctagcagcgagggcttcttggaggaggtgagatttgagtttttctggatgggcagaggtggggaaggggtacgctgggaatcagggagcagaaaaggttgggctgctttgggcagtagaactccttgcccatccagaagatcctaaaatagaccagcagagagagggctgcttccatcctctgtgtttaaaagaaagggttacttgggattctgagctgttcttcctaccccatcaaaa

SEQ ID NO: 216926 - DNA, 517 bp, Homo sapiens
agtctagacttaaggtgcattcccttagagatttgattttgttgttgttgttcatgtacctgacagcaatattggcatgaaaccacattaaactcatttcttagtgtgatgtttttctgggcactcaggaaatgtgaatttgggcaataaatccatatgagtcagcttatagttacaaattcttaagatttttttttcctctcaccactcctattgtgaagacaaaaaaattttcttgcagtcctctagttgaggatgaggggaagggaagggacttttttctagtatgcccctctactgagtgtgtgtgcttttggagtcctagctctgtacagaggaagccaaattctacctgcccactaccatcctcattcagtaaaaaataaaactccataaaactctaagcacatttgaaagaagttgaattttattaagaatatttaatattttttaggtactcaaatgtaatatataaataccaaatcactaatgacagttatagtatgacatttcaacc

SEQ ID NO: 216927 - DNA, 502 bp, Homo sapiens
gagaatagcttctagccaaagatggctagcagtaaaacattttggcctcctttccctctgttgcttagcctctaagccattggaagtgggtggtggttcccagtctactggctgcagggttagtgcaaagggactgactgcagatgcttctgtgaaccaagcattgcatgtggcacgcagggccctttaaatgtccattatattgttgttattagattaaataggccaggcacggtggctcacgcctatagtcccatctttttgggaggctgaggtgggtggatcacctgaggtcaggagttcgagaccagcctagccaacatggcaaaaccctgtctctactaaaaaaaatacaaaaatcagccaggcatggtggtgcatgcctgtaatcccagctactcaggaggctgagacaggagaattgcttgaacccaggaggcagaggttgcagtgagcggagattgtgtcactgcactccagagcaagactctgtctcaaaaaa

SEQ ID NO: 216928 - DNA, 225 bp, Homo sapiens
aatatataccatctgtgacacttcctaagctcctggcttcagagtagccatcctgataattattatttaaagtccacattataaatgtgcaagttaagtgagttatggaaatcattccagatactggttcaccagtaacatcagtttagccctaaatattgtcataagttctctgataggctcatgtgatttaagctggtgctctgtcaagactagacttaggcg

SEQ ID NO: 216929 - DNA, 315 bp, Homo sapiens
tcaggtgacagcagatgctggcaaggatgtggagaaagggaacactcctccttgttttgggattgcaagcttgtacaaccactctggaaatcagtctggcggttcctccgaaaattggacatagtactaccggaggatcccgcaatacctctcctgggcatatatccagaagatgtcccaaccggtaagaaggacacatgctccactatgttcatatcagccatatttataatagccagaagctggaaattacccagatgcccctcaacagaggaatggatacaaaaaaaatgtggtacatttacacaatggagt

SEQ ID NO: 216930 - DNA, 568 bp, Homo sapiens
taaggccaagagttcaagaccagcctgaccaacatggtgaaaccccatctctactaaaaatatttttaaaaattagctgggcgtggtggcgcgcgcctgtaatcccagctactcaggaggctgaggcaggagaatcgcttgaacccgggaggtggaggctgcagtgagccgagatcacaccattgtcctccagcctgggtgacagagccagactccgtctcaaacaaaacaaaacaaaagacatcagctagctggtccaagcacagtggtgttcacaacgaattgatcacagccaggtagaattcttcattctttctccagttccactgctttgcttgaccagccttaaagacacacatacacatttttgtctgggcgcgctggctcacacctgtaatcccaacactttgggaggccaaggcaggcggatcacttgaggtcaggagtttgagaccagcctgaccaacgtggagaaaccccgtctctcctaaaaatacaaaattagccaggcatggtggcacacgcctgtaatcccagctactggagaggctgaggcaggagaatcgct

SEQ ID NO: 216931 - DNA, 398 bp, Homo sapiens
taaggccaagagttcaagaccagcctgaccaacatggtgaaaccccatctctactaaaaatatttttaaaaattagctgggcgtggtggcgcgcgcctgtaatcccagctactcaggaggctgaggcaggagaatcgcttgaacccgggaggtggaggctgcagtgagccgagatcacaccattgtcctccagcctgggtgacagagccagactccgtctcaaacaaaacaaaacaaaagacatcagctagctggtccaagcacagtggtgttcacaacgaattgatcacagccaggtagaattcttcattctttctccagttccactgctttgcttgaccagccttaaagacacacatacacatttttgtctgggccttatttggctcttaattcaa

SEQ ID NO: 216932 - DNA, 460 bp, Homo sapiens
cgccggtgactcacacctgtaatcccagcactttgggaggctgaggcaggcggatcacctgaggtcaggagtttgagactagtctggctaacatggcgaaaccctgtctctactaaaaatacaaaaattagctgggcatggtgttgaatgtctgtaattctagctactcgggaggctgaggcaggagaaccgcttgaacccaggaggcggaggttgcagtgagctgagatcgcaccactgtactccagcctgggggacggagcaagactgtctcgaaaaaaaaaaaaaaagaagtagagaagcaatagggattaaaatgtaaacaagccacccaggtgccatggctcttccctataatcccagttactcctcagatagctgaggtggaaggattgcctgaggccaggagttcgagaccagcctgggccacatagcaagaccccgtctctaaaaaaattaa

SEQ ID NO: 216933 - DNA, 250 bp, Homo sapiens
gccaccattctcagctgatgccttccattacttgttcttgttgaatagctctggttagaacttccattacaatattgaatagcagggcatccttttcttgttcctgatcttagggggaaaactttcagtatttcatcattgatatcctgctagctgtggctttctcataaatgctttatatcgtgttgggaaatggtctctttattcctagttttcttaatttttatcattaaaaggttagattttgtta

SEQ ID NO: 216934 - DNA, 536 bp, Homo sapiens
atttctagtgatattacagagatctttatacatttaacacatagatttaggaaatgtaggaagacattctaaaagttagaactgctagttcatggagtatacgtttatagttttggttatgttaaaaacgaaaaccaagttaactgtctgtggaagctgagccaatttatggctgtacctacaacctgagattaatttccaattttccagcatttctaccaacatactatacgtttagataatttctaccagtctgataggtgcaaagagattctcttggttttattttgtattatttttattagtaaggctgaacttcccttcaagtgtttgaaagccatttgtgttatcttttctctgactgctcagatccttttcctttatccctgttatgtatgttatagtccttaactaatttgtagaatattttatattaaggaaactatctcactgtaatatgaattgcaagttttttttttttttctgtcttgacttcatgttttttgttatgcttgtttcttatttatttatttatt

SEQ ID NO: 216935 - DNA, 416 bp, Homo sapiens
actcttcaccattatgcctcatcttcataggaaaagcatcgtttactgagaggatatattaaaggtgccacattttagaaaaattcaaagcaagggacaaatggtttagttctgcagaaaaaataaatcaaggctgagcatggtgacttatgcctataatcccagtgctttgggaggctgaggcagcaggatcacttaaggccagaagtttgagaccagtctgggcaacagagtgagactttgtctcttacaaaaaataaaaaaacttagctgggggtgatggcacgccttgtagtcctagctacttggaaagctgaggcaggaggattgcttgagcttgggagttcaaggttacagtgagttatgattgtgttactgcactccagcctgggtgaaacaacaagactctgcctcta

SEQ ID NO: 216936 - DNA, 491 bp, Homo sapiens
aaggaaattacttattctctctaggaagctattaggaatgctttcagagagtagggtaagccagactcttcttcaagttatttgaggagagtagtaacttagaagtgaaattttgattttgtgccatcattaaatctttgaataagagttttctgaatgactgacagaggttgatggaatattttatttttgaagaacttttattctaaaagttaggattagagaagtttttgctgtttctattcattattcctttttgcatacaaaaccgtccttgttgggattattcttgaagtatattctttagaatttcttttagagctggttttgaaggtaaataccatcagtgtctctagaaaaatctctctggcgggagggacaatgatcgggatataaacccaggcgttccagggggcaacggcaaccccctttaggtcccctcccatttatgggagctctgttttcactgtattaaatcttgcaattgcaaa

SEQ ID NO: 216937 - DNA, 588 bp, Homo sapiens
ctcctgacctcaagtgatctgcccaccttggcctcccaaagtgctgggattattggtgtgagccaccgcgcctggatgctaatttgtctttaatataatttatgggctgaattatgtccacacccactgccaaatttttacactgaagtcctagcccccagtatctcagaatgtgactgcatttggagaaaggtcttgaaagaggaggctaagttacaacaaggatggagtggggcctaatcaaatcaactggtgtccttagaagaggaaatatggacacacagagggacaccagggatgcccacacacagagcaaagaccctgtgaggacacagcaagaaatgcttcagaagaaaccaaacctgtcgacaccttgatcttggactttcagcctccagaactctgagaaaatacatatcagctgtttaagccacctagtctgtgatattttgttatggaagccctagaaaacgaacgtatttctctttaacatttgaaaggtcttaagtgtttttggatcacgcacttccctaaaatctgatgaaaccgaaggtcatcctcctctgaaaatacacatactgtacctac

SEQ ID NO: 216938 - DNA, 716 bp, Homo sapiens
atctcattgaatgaatcattccttcttgtagggtctcaacctacatagtaactggatgattgcaaagtaatttaaggattaggtactgacgccagaatctcttaagcaagtatgccctagcaagaatctacatgtctaacagggtcccagagaattctcaggataaccaaaatttccaaaccactggagcaagtaacgaacaagaaaaacatataagtacatacatggggtcttcattgacaagtacaaataaggggaaaatatttgctcaatttttttgtacttttattttgttaggcaagatcttaagagaccacaacaccaaatgtgttctcaattatctcattttatcacatgaaagatataattttggaatttcaaaaaatataaatttagttttaagaaggaccacattccaggccgggcgtggtggctcacgcctgtaatcctagcactttgggaggccgaggcgggaggatcacaaggtcaggagatcaagaccatcctggctaacacaatgaaaccccgtctctactaaaaatacaaaaattagccgggcgtggtggcacgggcctgtagtctcagctactcgggaggctgaggcaggagaatcacttgaacccgggaggcagagtttgcagtgagctgagattgcgtcattgcactccagcctgggcgacagagcaaggctccttttcaaaaaaaaaaaaaaaaaa

SEQ ID NO: 216939 - DNA, 476 bp, Homo sapiens
cagttccctggaagtctgtgaatagcaagaaatggggcaggctgggctgtgcttgctgtcatctctgggtggggggagatggaggcctgggcaggagtcctaagaatgctgggtgtccatggctgcctagtcgctggggtctctccagcagaggacggtgtggctgtgcaccttgtccaatgccaggaagccagcagccgggggtggaactcggtattctgcagggatgttgtgactgacacagtaattatgggtttttgcattgtttatgcctctctgggagcagagccaaatgctatgagccggtggctgcaaggcactcagtagatttcatgacagagtatcattgtatttactctttcaggcctcccggactattggcgcctcatgaagctttaacactatttgctgttctcataattaaatcactgactaaataaaaaaaaaaaacaataaaagaaataccaaatcattct

SEQ ID NO: 216940 - DNA, 397 bp, Homo sapiens
gctcgggccttccaggtaccccggcgacccgggcacgcggcccggcgccagttcagtgtgaagatgcctgagaccttcaacccgcagctccccggcctttacggcagcgcgggccgcgggtcccggtacctaaggaccaatagcaagaccgaggtcaccgtgtgaagcggggccgcggtgccctcgaggcatgggctggggtcctgtctgcccgtcggagcctcaggccacagggagaggagcgcctgccgtaaggccagctcttctgtctgcctcaacggcagtggtgtcttggagcctgcaggccgcgggttcgtcttgtaaataagcccttttatgtggttcctgcccctgagaataaagaagccccagcgtggctgcgaggcaccattggtca

SEQ ID NO: 216941 - DNA, 318 bp, Homo sapiens
tatacaccaatagaatagaatagaagccccagaaataaattctcacatatatgttcaattgatttttgacaagggtgccaagaccattcaatggggaaaggacagtctttctaacacatagtattggtaaaatgatatctacatgcgaaagaatgaagttggacccttcccgtattatatataataacctaaatggattaaagtcttaaatataggagcaaagattaggataaactcttagaagaaaacaggtgaaaatcttcatgacactggatttggcaaggatttcttggatatggcaccaaaagcagaagcaac

SEQ ID NO: 216942 - DNA, 406 bp, Homo sapiens
tagtctgttcacacaattcagctgcattttttgccctgcccacttgccacttctgttcgggggaggctgacccctgagatgcatctcctggaccccttgcccccagctttctattggatttggccaatgaaaggctctggtggcagactgagggctggaggaaagggaggccagggatttttctctgctcgctcctgcttccccctccctgcccacagaccctgcacagccaatcatcctccagaactcagccatccctggggttggtaacacttcttccccatgccctttagcctagggctccaccctccccaggaccctgggccggcccatgggtgcctcgccatgctttattggttctgttcattaaagtctcttcatgtgaaccatctggggtcgtcgacgc

SEQ ID NO: 216943 - DNA, 627 bp, Homo sapiens
gcattctgtttgcttaattattgtcagcatcacccacgctggtatattgttgaagggaactgtagtgcctgtcagagcaggcacccgccattctcctttcctcctcactctactcctgtcgttgtgattacagtttaggcattatctatctttgctgcgggaaatgctttattaatcttgcagtcctgtgtccatgtggagatgtggttctgccatccaaccagataggaagacagagcagaaaaagttgctggagaatttcatgaaggtcaaatttagaaaaaggacaatttggttcagttaggtgctttgcacactgaggaacatgcagagaaatcacttgctttatgggtttggattgggaaattatctatttatgtaatcacactgctttgaaagggaagggaattaattgctttaattaactccagtaaagactagattgtcacagggggagtgttgataaaatgtgctttgagtgatctgatacgctcttggatatagtggctggaaataatagctatctctgtaatcaatcattttcctttctctgggacctcactgatgatgttcctgccataaactaggctgcctagagggtcaaaaaaaggaaaggtcaaaaaaaaa

SEQ ID NO: 216944 - DNA, 367 bp, Homo sapiens
cactattacccctaaggaatgagactgcaaagaagctcccgatctgaaaaggtggcatttgctaagttagaaaatggaagtaccacccagtctgggggatcccataggcacccaagagtgcaccaagccactaggaccaagctcacctgagagtcccaccctgctcggaatatgcagacttggtgtcctgtcgctttaaagcactccatgcctggaaatgccacggcccacatggaatgggcacagccaacaactctccaaggagccccagcaatgaatgatgagcatctcccctgaacccatctccccatgtccggtgtttaaagtgaattgaaatgaatatctgataaatgaataaacctgtaaa

SEQ ID NO: 216945 - DNA, 155 bp, Homo sapiens
cagagtaaatgtgaaacggctttagcaagtgggctgtgcggtttgaaatatgaactctgtaatctcttcagtggctcccacatcccagggctgcgctttgggtaattcaggagtgggcaggaaacttcagaggaaacactcctaagaccatgggg

SEQ ID NO: 216946 - DNA, 292 bp, Homo sapiens
aatcattgtattctatctgagtcttttttttctccatatattgtataaggataataaccatttcacagatttgtaatagtaattagtgtgattgtctaaaaatgacataaatatataaaattatagtattaataatatcaacagctattaatatgattgttattgttatattctatactcaaagatcatttaggatgcaattacagctttacctgtatttatgagaaactatataaattcatcttgggtgatgtgggtggctgagcatatttaatagagaagaatatttact

SEQ ID NO: 216947 - DNA, 493 bp, Homo sapiens
ttttggatcttacgatgctgagcatgttctgcactggtgctaatgtctaatataattttatatttacaaacatacgtgctacccagagattaatttagtccacagaaactattgacccctcttgagatgacaacatatacactcctaaatcagtgtgtttagacttttcaggtatctaactcatttccaaacatgcagcatgtttataaacctcttgatttccagcaacatactatagaaaacacctgctattcaaaacacaacttctcagtgtcatccattgctgtcgtgagagacaacatagcaatatctggtatgttgcaagctttcaagatagcctgaacttaaaaagttggtccattagttgtatctgatggatatataaatttgcctcctagttcactttgtgtcaagagctaaaactgtgagcctaactttctcttactggtgggtaataactgaaaataaagatttattttcaagctcaaaaaaa

SEQ ID NO: 216948 - DNA, 316 bp, Homo sapiens
tgcactccagcctgggtgataagagcaaaattcaaaaaaaaaaaaaaaaaaaaaggaaaagagaaaaacccgggaacattatgtagggtcctgaattgggtcatggacccctggaccagcaggacaggagagagaaaactggcaaaaatagaagactgtacgttacttagtattataccagtgttaatttcttggttttaaaaatgtttttggtggttacataaagtaagatgtcaacactggggagattctgggaagagtatatgggaactctacatattttacaacttttctacaagtctaaaattatttcaaa

SEQ ID NO: 216949 - DNA, 1174 bp, Homo sapiens
ggctggagtgcaatggtgcgatctcagctcactgcaacctccacctcctgggttcacaccattctcctgcctcagcctcctgagtagctgggactacaggtgcccgccaccatgccgggctaattttttttatatttttagtagagacagggtttcaccattcacaggatggtctcgatctcctgaccttgtgatctgcctgcctcagcttcccaaagtgctgggattacaggcgtgagccaccacgcccagcctatggtaaatatattttgaactacaaaggtgctgtggtactttaaagaaaaactatttttactagtttatctgaatggtctgtggactttatttagaaactgtttttcagtttagttttttggacatatcctttgctcagtgtattttgttacttctctagtaaaggtagaagtgaagcagatgccattgtaggttttaccagcatttaaatatattatgaattgcttagcaatgaaatgcaagtatgcatcttttacttaaagatactatttatgtattcagctacagagatgaaatagcattttatgtgttaattgttttggctataaaatttaagtccttacagcatttggggattatacacttggatttcaaaattgataaaacccttgtgaacatatctaatagatattctgtttacttgtagaaataatataatgtgtctggttctgttttgttagacattttttatgttctactgaatcagaatagtcagtgttatattccttatttcaagaattcatctattttatggctacatctcatatgtgctatgaggacttctagccagtgggtggcgctgtaataccgaagtactgcactgctttgttcctgtttccttgtgctgattcctttctagtatttaggtaacattaccggatggcatttcccttaaattccaccaactcttaatctttattttaaaaatggctactttttttgggtggttggggtaagggttaaaaccttaaattagtaaccgctgtttattttccagtttatttgttttctgtgattatttataataattgatatttgtttttacaagtcccctgaccctgtaataatgaatgcagctatcttaggcaaagcaaataaataaactgggcatttttaaaataaaaaatttaggaagtca

SEQ ID NO: 216950 - DNA, 441 bp, Homo sapiens
agtgagatgcacctaaaatgtggaagattggctgaaagtctgtttcaaacgccattgacctctgggttccttctcccaccacactcagccagaagactgtccttctcctatccaaccaaagatgggaggtctctggggacactaaaacagagggtgtctggcacaattgagaattaagtgaatgatgtgcactttgtagtgaggactcagccctctttttccagtggattcccagaactcactggatagccagggcttcaccactctgccggagttagggaaagtgctttattgggagtctaaccagcctgagatataaaacttacagatattaactttgaagcttctctaataaattacccagccttatttatctaactaatatttactgaaagcctatgatgtgccaaggatttttctaagtccaagggtttcagcaga

SEQ ID NO: 216951 - DNA, 151 bp, Homo sapiens
gcctggcatgcctgcttcaggagctcagacttttactatagtggtggaaggaataacaaccccagccattttttgagggcctgtgcatgcctaggccctcaaaaacatgtcccatgttagctgcaaactgccagctaccctgcaaagcaca

SEQ ID NO: 216952 - DNA, 659 bp, Homo sapiens
ttgtcactgcatgattaagtagtaaaggatttcagataaactgtggtcttgtggcatgattatagaatctagaaaattaataaaataagcaggcaaacgttttatgtgtttggctgtgtaaaaataaccaattacagtcatttatgtaaacaatttaacgtgtagggcctaattatcatgcaacaccataacaattacatatattattaaatatgcatcagattaaccttgttgttaagttttgattacaataaaagtactttgtactctaaggaacagtcttatagttaattgctaataatgcataagttggttcactatttgcattaattaaatgagacatagctcctgagtttgctctccatttgaggcaaggctggatcctccatcctatattgcaactacacatttgtcctgcgacctgtgagataacatacactttccttagtattctatagtgaggaaaatgctgaagaaactgccagtaaaaaaaaattctgtttaattggctgttgttcctgaaacctacaggtttccagtagataagagtttttgatttaaacaatgaaaaattctatgctgagcactagttaacctatgtagaacaacttctaaataagccccaggatcatcctgtggagcacttctataaataaaat

SEQ ID NO: 216953 - DNA, 399 bp, Homo sapiens
catcattttcctcttcttagatatgaaggcccctttcctgttattcactgggttttgcttagtacggcttcacactacttattccaggtactcccagcagtggcgcagagaccatcctcagttctgtgtgtggatgggaccagagaagccggccggccgagctaatgttcttcccttcctggaagagagtagtttccaaacaacccgatctctgttcctctactggctccacatatgctctaagttcctgttacactgttgagaggctcttgaattagaaactatcgagtataaatggcagtggaatatcactctatagttgtcaccgatatttcccttaccttgagattgtgacaagaccagaaagagaaaaagagtaaaaacaatgtaaactataat

SEQ ID NO: 216954 - DNA, 416 bp, Homo sapiens
agctgtgcatgttcagggcaagattctcagcacctgaatggaaagcagcagctgtgaagctaaacagttatgcaaagactagcagtctgatggtgctggggagtcagaggctggaggtcagggcctgaggaggtagagcaacccttgtaaataaacactgaaacactaggaagctttgaaacactagaagggctgtactctaggagtaaggacaacccagaaaaagatcaacgctagcactagcaaaagttaagcgtcctctcagatggatcaagatctgccagtacccttatctgcctgaattctttctagagaaacgtaacagtttcagagaacagagtctctaattttttcatataaaatcactatccattcacactcacacaccaagcatgccaagaaactaccaaataagt

SEQ ID NO: 216955 - DNA, 1072 bp, Homo sapiens
gaaagaatacgtgggactatgttggattcacatgtgaaatgagagaatgtttgcacaaaggaggtatacaggggaaaaccctagaaattgtatgctataagtaagatcatgcctacttcatctgggcctctggatctagcagggaccagatttgtgtcactgaaacactcttcaggagtggagatactggtaagatgtcaagctaatgagacaggacagagtacaacctcctcatgaaatctctctgactataaggctactgctttcttcataagcactactttgtgacattttactataattttagtagaaacctcattagctggaaatgtagatgacaggaaacagcaggaaaaggtttaattaatcttatacatatcaccatactctttttaaaagaacattaggctaaccacttagctggaaggaatgagttgtcttaaattataaatgtattgaataggctgacgttggtttaaaacgttacctagttgtaccgaggagctagcagttctgcaaatcttgctctatatggtgtattctattgagacataaagttgacatgatactagtaagacagggctctttctttgaaatagtgacttctattttccacttctgttcttgcctttagcttccttcaggcagctgacggtcaggctctgtgattttttggtctcaggggaggtttgtggccaggcagaagtggagatggctccagacatatactttgggattttttgtttttcaaaagcctgatccattaaggcaattatgcttggtgtaccctcccaaagagtggacaaggagagtgcttttgagatgcaacaggtgaggaaaggagctttttggagtccttgggttgtacccacagtacccttgggtgccccatcagcaatcagaaatgaagacttgggagaagaagggctaatgacgcttggctttggcaaagatgacggagttcccaggtgacccagaagctgcaaagccaatggacctaggggaacagtgtaggcccagggtgatgtgtgttctgctatcaggctggtgactatctgagtgaccctaggac

SEQ ID NO: 216956 - DNA, 328 bp, Homo sapiens
gaggcggattcttgctctgtcacccaggttggagtgcagtggtgtgatctcggctcattgcaatctccgcctcccaggttcaagcgattctcctgcctcagccttctgagtagctggactacaggcacccaccactacacctggctaattttttacttttggtggagacggggttttaccatattggccaggctggtctcaaactcctgaccttgtgatccgccgatctgatggtttcataaggggctttcctcctttgctcggcacttctctctcctgccaccttgtgaagaaggacaggttttcttccccttctgccatgattgta

SEQ ID NO: 216957 - DNA, 895 bp, Homo sapiens
tcttgtgatcaacaggtctccctgaaatgtatagagtgagaccgcaccattatggacggacactaaactattcatgaggactctaccttcaagatccaagcacctcccattgatcgcctacttctacaacactgggggtcaaatatcaacatgaagtttggagggcacaaacaaaccacatccaaatcatagcaaggtgtttggctgtgaacaaacaaaacaaaacaaaaaaaaacagaaaaatggggcagtaactagaggagatgagagatcaaaagagagcctgattttttattagacaaagtagagattgtgtattgatgaacaatccattgactgatgatattaactgattgatatggattaatatataattaatatcaattgagtgagttgggagtctgtggcaggtggatcgcttaaacccaggaattcacaactaacctggacagcatattgagacctcatctctaaaaaaagaaagaaagaacaaaagaaggaaggaaggaaagaaagaaagaaaagaaagaaaggacggaaggaaggaaagaaagaaaggaaagaaagaaaataaatcactcaaaaaaaaaactatatgattacatggaaattaaacaatgtgctcctgaatgacttgggtgaacaatgaaattaaggcagaaatcaagaaattctttgaaatgaatgagagagaagatacaacataccagaatgtcagggatgcagctaaagcagtgttaagtgggaagtttataatgctaaatgcccacatcaaagttagagagatctcaaattaacaacctaccatcacaccttgaggaactagagaaagaagagcaaaccaaccctaaagctagcagaagacaagaaataaccaaaatcagagctgaaatga

SEQ ID NO: 216958 - DNA, 646 bp, Homo sapiens
ttgggccttttctaaggctcattttcctacacatcaagaaaaaaaactctctagttaatgttagtgggatgatacccacaagcaggagattcaaagatggcccttttctttatccctggctcacctgaggaaggaggtcagaggcccaagtgacttaattctatgcagatctatgcctaatggaaacaataaattcaaatgggcagtattactttttcccttactatcttactatttatgaaatgtatttctcactgcatttaaaaatgtatttaacatataaattatttcatgatattttatcaggttttaaaaatctgatatttagctgtagtatggaattacaatgctaatgggtttacaaattaatattacaaatgactgaaaagttcacactctgcaacttgttaaacatgtcaccttcagagcttatctcatttttaattaataaatatgtggtcatagtgtgtaaagaagaaatctttatagattaaagatttgtcaccttttggaacagtggactctgttttttaacatttgtattatagaaatttagaatagtatagtatttttccctgtgaactagctatgcagcttaataagtgctcgctgcaagtccttttaccctcaagaatcagctatgacc

SEQ ID NO: 216959 - DNA, 514 bp, Homo sapiens
ttagatttgttaaatgaatagaggggatatggcaatcagaggaaatgcaatcttctgctgagtgtcagaagtactattatatgcaataacaacaaaattaaaatgtctaaaatcagtccctgtatctataaaaatatgaaactatttccaatattattcctatcaaaatttccaatgaaaccagtacttgtatgtgctattagttctaatcatgctgctagaacattgttgagtttgaaattgttagcatcattcaactaatatgcgtatagctgtcacttccgtttgaattattatgacaccaaaagctcaggcaacaaaagaaaaacaaatgagactaactcaaacaaaaaggtttttacacagcaaatgaaacagtcaacaaaataaaaaggcaggctgggtatggtgactcgcacctataatctcagaactttaggaggccaaggcaggaggatcactgaggccagagttcaagactagtctgggcaacatagtaagatccccatctcta

SEQ ID NO: 216960 - DNA, 492 bp, Homo sapiens
ttcatgactgtattttcttatggttagaaacaaaactaaacaatttaaataactctgcttaatggaagtcaggaaagagaaaaggcagctatgaagtgttgttgttacagactgtgcatggaccctaatggtcacctaaatgtgagaggaggctaggcactgagaatgccatgtgcaaggaaataataaaagcaagtcctccaagaacatttcccacagactcaaatattttcgaagtaacaaaaataagaagagtgccctttttgagtcacaaaattggcatgaagtgaactggttctatgcttgctgtaattggtggtcaaggaggcaggggggaagccattgaatgtgttcagtgagctagaaaggtaactttctttcctggaagaaaatgatcaagggtgagaagtcaggaggaaagagatgtttttgaccaggtctcattcttctccctctgtgtctgaccttgaaaaggagagattgcagaatagg

SEQ ID NO: 216961 - DNA, 372 bp, Homo sapiens
atcttaaaacacttttataagaatcccagttcatgtaaaaatctgcattatgcatgtaaaacaccagttacttaacacttattacactcattatttggtatgtttttggacagaatagtgtggaaactgtacagtatcagttatttcttctacactgctccaaacacgtaccataatgtaaataagcaatgagaaaatatgttaaagatacatgatgaatgcaaataactcttagtgaataaccaagaccacgtaaaaaaaaatgtactgattaaagagttgcctgagttagatttggtggtgagaagtgggagaaggggctgttatcatggttgcggttcagtggtgagtcaaaatgtatggaaagattct

SEQ ID NO: 216962 - DNA, 553 bp, Homo sapiens
tcatgtgacaactgctggacaatcaggaaactgccaagtcatcacctgatggtcgtctgacattcctggtgggtggggggagccctctcttgccctgctcatacctgaccagctacctattgtaacagttgtatatatgtgtggtacagtgcattatctcagatattcctttaaaaatggccaggttaggtattgttcctgttttatagatgaagaaactgaggccgagagaatgtcatacagttaataagctgtttgctggtataattcaaagtttgtatgatttaaaatactttataccacactgctatgataaagaaccatgatatgtggctgaactgacattcattcagcagtttttacagtatacatttatagagtacctaccctataccaagtcctgtgctcaatccatgctgtatttttttctgtagtaatcccccctcatctgcagttttgccttctatggtttcagttatccagtattagccatggtccaaaaatattacatggaaaattccagaaataaaccattcataagttttaaattgtg

SEQ ID NO: 216963 - DNA, 404 bp, Homo sapiens
ggagataatacagcaaaattgtaagactgtagtagtataaaaggatataataagcttgatgcatagtaagtgcttaaaaagtatttgcagtcgctatatttatatgttttgctttgatttttattttggaatgggacatgggcatggtgacgagggtcataaaggataacaacatggcacactggaaaatatggggccagtatgaatccaagctgacgtgttcaggggaacccatgtctctgagcccctgtatcattaagaagtctttgtgactaggattgagatcctgtgtatagaattgctttactccatgcctgggatcttagaaacttagtctttgagttgtcgcaatcacctcattcaggacccctgaaacagaccttaggtgtgctcaaaaccacctc

SEQ ID NO: 216964 - DNA, 229 bp, Homo sapiens
cttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatg

SEQ ID NO: 216965 - DNA, 496 bp, Homo sapiens
aggaaatccaggcaatgcatcccattgagatcggctccttgggtacagagcagggtggaaaagaacagaaaataaataaagggtaaagacaggacagggacctaaacaggattgttcaatcttgaatgcctggcacttccaagaggcccaggacacatagaaaagaaatatttattacatgagtgaatggatataagtaggagcaagtctcctgaccctcacttattccaaagactttttcatttcaacatttctgcatgttagcctgttgcaaaaccacaaatctgctgccaaaaggtaaggctggatgtttggttctcttatgaacaggagaagactggcctataactgtggacacaagggaaagcattttctgacattcagatcatttggaagcatataaaagttaaatctgttctacattgtgttggaaagaaagaaaaaataaacaaacaaacaagcacaacaacaacaaatcacagagaggaaggaaaaa

SEQ ID NO: 216966 - DNA, 298 bp, Homo sapiens
ctgggaggctgcagtgcaatgcagcagttaagaaaatccattgtgtagccaactggatacactaaagttgtgagacagcagacacagttatttcacctctctgtaccttagtttcctcaactgtaaactagagagcactatacttgccttataggatcattgtgaagagtaaatgattacatgcaatataatgtgagtatgtaacataggtaacatatgttagcaattttttgttgttgttttggagacagagtctcactctgtcgcccaggctggagtgcactgcagccttacacct

SEQ ID NO: 216967 - DNA, 558 bp, Homo sapiens
ttcaattaatgttctttgggttttcactatgtgaaaggcaccatatttaggacattagctccctcctcagtctcaaatgttagtaggatcttcctaattgtccaaccaaagataattcttttttcattttatctaacttttattttaagttcaggggtacatgtccaggtttgttatacaggtaaacttgtatcatgggagttggttgtacagattatttcatcacccacatattaaactgagtacccattagttatttttcctgatcctctccctcctctcaccttctaccctccaacaggccccagtgcgtgttgttcccctctatgtattctcatgatttagctcacacttataagtgagaacatgtggtatctggttttctgttcctgcattagtttgctaaggacaatggcctccatcttcatccatgttcccatacaggacattatctcattcctttttatggctgcatagtattccatggtgtatatataccgcattttctttatccagtctatcattgactggcatttaggttgattccatgtctttgct

SEQ ID NO: 216968 - DNA, 884 bp, Homo sapiens
actattcatttacttacaggaaactttcttcatgaatatatgaagagaaatttctgcccaaactttaaaattattataaacttaagataatgacatttgggttgactttctggttattgctgagaatttggctgtgtaaaaaggagaggttagaaaaatattatcaaagcaaaaggagaattcttttgataagtgatttgaattaaattatatctccctctcaattattttctgtgcacacttacagtttctacaagatgttggacaagtgattttgttctgtgcctcagttttcccatatgcataatgcaaagatagttattcttgcagctaatatacttcctgagaccatgtcagcatgcacgttgcatacatactgaaacagaagactcaaaggcctttgaagaagagcaccagtatcacaaagtttcatcattttattttttaaaaccaaatatatcttttcatcatttcatagtttgaagactgatgaagaaaatgacagaaacttgtaattagggaaatgtaaaatatttaaagttaaaaactgtctatgtagcagaaaataaagaagagagattactttatactctctttttaagtttgaaaacccacatcaaaaaatgaaagaaaatctaaccatggatgccagagtttgaagactgtaagaaaggccacgtggaggaagaaatatggacatactttaagctgttttaaaagataaagagattagccaggtgtggtggtgagcacctgcagtcccagctacccaggaggctaaggtgggaggatcaccggagcctaggaggtcaagactgcaatgagctgaggccgcaccattgcactccagctgagtgatggagtaagaccctatctcaaagaaa

SEQ ID NO: 216969 - DNA, 390 bp, Homo sapiens
ataggttatattatcatatgtttaaatgtaaattggcatgacctagtagtagagaggaagacatttacccacttgaacatactgtaggctaaatgcatattaagatttcatgcaggccaggcacggtggctcatgcctgttatcccagcactttgggaggccaaggtgggtggatcatgaggtcaggagattgagaccagcctggtcaatatggtgaaacccagtctctagtaaaataccaaaaattagtcaggcatgatggtgtgtatctgtagtcctagctactcaggaggctgaggcaggggaatcgcttggacctgggaggcagaggttgcagtgaacagagattgtgccactgcactccaacctggcaacagagcaagactatct

SEQ ID NO: 216970 - DNA, 1066 bp, Homo sapiens
acacaacagcagcagcagcaaacttatttatactagtttttgctcattccctcatttcccactcattaacctacctgataaactttggctctgtgtccccacccaaatctaatgttgaattgtaattcccaatgttgggggagggacctggtaggaggtgattggatcatgggggcagatttcccccccttgctgttctcatgatagtgagtgagttctcctgaaatctgatggtttaaaagtgagtggcacttacccctttgctctctttctctcctgccaccatgtgaagatgtgcttgcttccctttcgcccttctgccacaattataagttagctgaggcttctccagctatgcttcctataaggcctgtggaaccttgagccaatgaaacctcttttctttataaattacccagtctcaggtagttctttatagcaatgtgagaacagactaatatactaccctaatctggatctggcccaatcactccatagtgaaacagcttttggtaatgttaccaacttattgcaatagattttttttttggtccttatctcatgtaacttctcagaaatattctatccacctgacaaatctttcctttagaaatgctctccttggcctctatgacacagcattctcctggttctttccctaactctctggcttttgtttattttctcatcacagacttatattctttctttagttgacagaatctggagttcttcaatggttagtcctagacagcttctttcctgctatattctaaatgtttgcttccccacaaattcatatgttaaaatcctaaaccccaaggtgattgtcttaggaagtagggtcttttgggaagtgattaactcacaggatactattttatttgtgcctaataaaataggctgaagggagctcctttgccccttcaactatgtgaggaaacagccagatggccttgtgtgtgaactggaacatggaccttacacagacattaatctgccagtgccttaatcttgatttttctccaacctctagaacgtgagaaataaatatcttttatttata

SEQ ID NO: 216971 - DNA, 514 bp, Homo sapiens
cttgtaagaatttagaagtgctcatatgtacacatagctatataaggttacagtgtatgtaatcataagtatgcacatatacattgtgcaaatccatgtagcaaaaatttggctgtgctaagaaaaaattcaaaggaatatatccttcaagaataaattgaagagataaagagatttccattctctgccttttctgaagtcctttgaatagtacatttttctgagagagacattcttgtccccccacatcattccaagtagaagcagagaaacctttaactcttcatcagtgaagttgctgagcctcaataagaggacagattttacaagcttagaacatgtatttgatgtctgtgtagtgtatgtttctgacgttaaggtgtttgaggatactctcatagttaaatgtgtagagtactgccctgttacatcattttctgtggttgtcttggacttcaaattgcaggatttcttaggttgtggcacttttaacttgcatagaaaataatagtct

SEQ ID NO: 216972 - DNA, 152 bp, Homo sapiens
gagacataaatgtggatgtctgggtcattttgccccattttaaagtgttaattcatataagtttaattcatattatctagcatttgatgcacttgatgcaacattacttccaagagttttgttaaatcagaacgtaaataatgaagttaata

SEQ ID NO: 216973 - DNA, 707 bp, Homo sapiens
gcctgcagaggcctaggctttgtcgcctgtggctcccagtgtctgcagagccagcattgagctaatcctgtgggaggatgagagctgatcggcagttgtatgataggttggtagggggcttgtgatctgtgaaattccaggtgatggatgcatccagtgtgcatcactaagaggccctttcccagtggcctctggctggctgcaggctggttccagtgtgaaagattatactgccttttcttttttttattttccttttgaaaacagacaacaaaagacaactgaaaataacttccccagtgagcaggcaagaattctcttctgaaaaatgacgtttgtagttctttcccaagttggccttcaaagagcctggctgcagttgagccagaaggagatgtcttgtgtgaaggctaaagtggaggctgtctctgaaatctccgtgagcaggtggccctaagccatggtggtggatagatgtgcagctttctgcatctctgccccttggtctgtgcccacaggtggccggcgtcagcctccatcccgagcacatgctccgcgggtctttatgtctcactgttcttcacacataggaggaaagagataggagactgaggaagggatggaccctgagaaagggcccctccagcctggctctcacacagtattttgtctttgattctgaataaatttttttttgtggttaatct

SEQ ID NO: 216974 - DNA, 798 bp, Homo sapiens
cagaaggctatagagaaactttaaatgctttttaacccccgcccccccaaccccgactttttgttttacaaaaaagaaaaagtagaagttattccaaagaaattcaaggtaactggaaattcaagaggataggaaaaaggtgattgcatcattgatcaggatctaaactttatctgtttaatttctcttccattttattagtgctaaggatgagaataactgttatttctgatagatatttgcattttattatagttgaaattagagatcttaggaggtgtttactggtaacgttgggggtggttccagtctacagaaatgtacatgcaaggagcacagaagcagccatgcatgctggagtccatgcgcatgtgacattggatgtggaatctcacaggaactgctgcaggaagcccagtggggcagcgtgtgaacaggaaggtgatcaggaagtttctgtccatgccgtggctcccctgcctccaaggctctcacctccagccatctgtgaatgtaaacatctagaccctagccctctctgcgcatcaggattccttgcttctacctggcttgaccagtttatagttgattctcattcttcacactagttatcctctataaagttgccatgaatgctaaattagtgaatactaaataactgcttccaggaaaaatagaagggtatcttcctgtgaacctccagtcacaagattttttcattaactggtaagtaataaacttgctttatgtgtgtttctgtttcacgacaccatatttattatgtattcgctgattcat

SEQ ID NO: 216975 - DNA, 393 bp, Homo sapiens
cacctcttacccctaggacctccttgtatctgtgaggattcagtaatatttgtaagagactttgtacctaggattatctcttgtaagtgtgaagttcaggtcatttggtttttctgctctatttaaggatttattcccttggatcaaacctggatttgacctctcagaggtttaagtttctatcgtgcgacattgtgcttgaatcagaaacactctacttctgtgttttgtcaaaggccaatcctatgacctttttcataatcaggtttgatactgtccatcctactttccatttcggtttctatcacctctacaatcggggtaatatctgaaataagactagaaatttgctgttctaattcttggttgagtgctggctcctgggcctatatt

SEQ ID NO: 216976 - DNA, 389 bp, Homo sapiens
  misc_feature (8)..(8): n is a, c, g, or t
ctgtcccncttctatctcaaatcatttgttcttcagtagcaataatatttctgtagatcttcatgattttctgcactgtttttgtgtcctgaattgagttctattaacccctcatcttcattttatttgcttgtttatttagtaagtaaatagttttcaacatctcctgtagttctaacaggaggtaagtgattcccacttgataatttacctgccttacaggtaatgcattctttgtctaccccaaacacaagctgctccatctccacacccaactcccaaacatgacagtttcctgaaggtaaatgtgaccttgctcataaaagtgcacttctttttatttataaaaatatttttttataagagactatgctctactagtacttttt

SEQ ID NO: 216977 - DNA, 234 bp, Homo sapiens
agcccaattcttatctgctgccagatccattcaatctctgcttaacacctccagggacaacatttcaggttgtatacagttggccctctgtatccactcgttccacatccacggattcaaccaaccattggtcaaaaatatttggatcccaggactttgggaagcagaggcagcaggattgcttgagcccaagagtttgagaccattctgggcaacacagcgagaccccatctc

SEQ ID NO: 216978 - DNA, 145 bp, Homo sapiens
tcttttgacagggtctctatattccaggctaaagtgctgtggtgcaatcatagctccctgcaacctctaactcttgggctcaagggattctcccaccccaacctctcaagtaacctctcttaaattgccctttcttagtcttctc

SEQ ID NO: 216979 - DNA, 734 bp, Homo sapiens
acaagtgacagccccacatacccctccaccaaaagggtcagctttcctgttttctgtgcagatcgataggtttggtgtgtacaaaaagtgaccaggttatgctgacagacagccatgaggatttataacttgcttttaggatgagtgccggtctctctcccatgagcagtgagtcctgatagcagggtcactgtggtctggtgatgttaaggcattccaggtttctttcatctacactcattcttaaactgctgcagaaagagatgtcaagatatcactgggtggggacattagaaaaggattcaggaatctataaacaagaaaagcttaccttccaccaccctctgtgctttgggtgtgttctgcccctgactcagtgcaggatcagaatagggcgatcttgataacaatcatgtgtaggcaaaagcctttgtaccttagcaggatggaatagtaaatatctgggtaggtgattccccatgtgtttccaacagacactcatccgtgcagagttcagtgtggcaggcttttctgtagcacagtccctgtaacctgaacggaagactacctgaatttgcacactttagcttaaaactctttctggggcttgaggattctgttcagagtttatttcatcttagcctgtgcagctgtcagtgtgctcacaggaccagggaacccaccaaagaatctgcttcctccgccatcattaaatctggttaatttagagccca

SEQ ID NO: 216980 - DNA, 444 bp, Homo sapiens
gatgggagtcaaggcagagttgtttcaatgtgcttgtgaatactgcatgttgctaatttaacatttagtgtaagacaaagatgacatttcagattttcttgtgaataattggcatacttaatactgagttttaaaatcagcaaatccaattatttgaacacctgtgtttttaattctgtgctattttccaagaatgtaccatttctttatatagtttctgtagatactttacattttgatttattgtgcacatttcaaaatcacataacatttctattctaaatttaattctctctaaataaattcacttatcgaaagcaaattctattgggaggctgaggcaggacaatggcgtgaacccaggaggtgaagtttgcagtgagccgagattgcgccaccaaactccagcctgggcgacggagcgagactccgtctcaaaaaaaa

SEQ ID NO: 216981 - DNA, 403 bp, Homo sapiens
aggtgatgaactgtctgagcctgaccttgtagaatggaggcaaaaaaactgatttaatgagcctgggcaacaagagcgaaactttattccaaaaggatgtcacattgcttttggagaggtactaaggtgctcaagcagtctctgcaataggatttggttccctgtcttttctatcccttgtctgatcagccctgaaattttactggtacagagactggagaaagaggggtgggtggacaggacatgtaggatgggggaaactcctgcaagtatgtttgccttatgggctccagatggggagccgggacatacctgtgaccatggtgggtcattaggtcttaacatagttctgggaactggtgaaacctgaggtcattagatagtgcatgtttgacctttgggc

SEQ ID NO: 216982 - DNA, 443 bp, Homo sapiens
aatctataaatcactttgggtagtatggccattttcacgatattgattctaatgtagacgacaggttggtgagtgcagcaaaccaccatggcacgtgtatacctatgtaacaaacctgcatgttctgcacatgtaccccagaacataaagtataataaaaaaagaatgaaattaaaaaaaaatttgtgggtacattataggtatattctagtactatgctgaataaaagtggtgacagtagttttccttgtcttgttccagatctttgaagaaagtctttctgtttttcccttttcagtatgatactggctatgggtttgtcatatatgattttttattgtgttgaggtatgttccttctatacccagatttttttagtttttaacataaaaggatgttgaattttattaaatgctttttgatatctattgaaatgatcttat

SEQ ID NO: 216983 - DNA, 598 bp, Homo sapiens
ttataacatggaaattaagttttaatagtcctaggtttgatcatccataaataccatattttaatataatattcttttcaatgacaagctaaaatgccatatgatgttttttgtctttttactaaatgtgcctacagaccacttctggctcactgaaaccaaaataaaacaataccaaagtcccaaaattcagacctaataaggaaagaaggggagaatggtatattactcataaagaacaattaataatcaataatcaattaatgaaagtggaataataacaacagttcccttatatggctgttacaaagattaaagatgttaatacatgtaaactgactcaaacagtggcataatatgataattatcattcaataagtgatggcttttactacagctatcattattcatagcttcttcaacacacacattcaaatacattagtctttatctgaaatttgctctccaagctcaactcccacctccaacattcttattcttgtctaaataaatcttattcaccttttaggtatcagcttaaatatcccttcctccattaaaacttttctcacctggtccccaaccaagatagcattag

SEQ ID NO: 216984 - DNA, 472 bp, Homo sapiens
agacatcggactttgatttgatgctgaaacaagttaagtctttgggaaactattgagaagggatggttgtattttgcaaagtgagaagaacataagatttggggccccaggggaagaatgatatagtttggtttggatgtttgtcccctccaaatgtcatgttgaaatatgatccccaatgttggaagtggggcctagtgggaagtgtctgggtcatggggacagatccctcatgaatgtcttagtgccctccttgtggtaatgagtgagttcttgcaaaatctggttgtttacaaagggtgtggcacctccccactctctctctgtcttgctacatggtatgctggctgcctcttcactttccaccatgattgtaaggttcctgaggtcctcaccagaagccaagcagatgttggtgccatgtctgtaatagcctgaagaactgtgagccaaataaacctcttttctttat

SEQ ID NO: 216985 - DNA, 530 bp, Homo sapiens
ggacaacggagtgagaccctatcgcataaaaaaaactgcacttgcaatgacccagtttccaaataaggtcacattctctaaggtattgaggattaggatttcagcatatgaatttggggggttctcattcaacccataataatcaccattgctctactctccaactattacaatccccccagagtgagagcttctaggggcagggaatctgttttactttgtatccctactctgcccagttccaggagtgaaataggcactcaatagatattgattgaagaatcaatgaagaaatggatgagagtaacatttatttagcacttactaatttccacctttatgataatcattttaaccactttaacagggttttccatgtgccacccccccccccatctctgcattccagccaccaccgtgcctttgtggagtttctcagagctaccaggctcctcccaccacagggcctttgcacgtgccactgtcatcaggacactcttctttggcctctttacccttgcaacttctac

SEQ ID NO: 216986 - DNA, 525 bp, Homo sapiens
ggaaaatacttctatgtatatttcacagacatggcagtacagcatactaggtaagagtataggcactggagccagaaatttgcatttatagtttgtgccagtcatttcctagttttgttaccttgagcaaactgttcagcttttctgagcctcagtttcttcatctctaaaattggtatgtacttcagaaattattgcaaaggttaaaaaagatgatgcttgtttagcaatgtgctaaaaatactgaacatcatgcctagcacatagtaagcacataataaatgctggttaattcataataacagtaataacaatgatggggataacaacaaatattctatgcatattctataatgctttaacatcaggaatgtcttcagctgtaagtaacagaatacacaactatggtggcttaaacagataaggatttattaatctaacaagtctgacataggccagattgaatattaattattcaacaatttttatcaataatctatatgccagctactattctaggcacaa

SEQ ID NO: 216987 - DNA, 426 bp, Homo sapiens
cacggtagctcacacctgtaattccagcaccttgggaggtcaagaggggtgatcacttgaggtcagttcaagaccagcctggtcaacatggtgaaaccccgtttctactaaaggtacaaaaagtacaaagaaaaaaaattagccaggcttggtggcagttgcctgtaatatcaggtactcaggaagctgaggcaggagaatcgcttgaacccgggaggcagaggttgccgtgagccgagatcacgccattgcactccagcctgggggacagagtgagattctgtctccaaaaagacaaatctccagctagtttatgtaaatactccactgtcaaggaagaaagagtgtaactctctctttcttaggtgtaggctgcatgtagtgactcctttcaaagaacagtgtggaaatggggaaggagtaact

SEQ ID NO: 216988 - DNA, 597 bp, Homo sapiens
aaagttcctgggcggtggaaagcgacagttcctgcacttgcagctctttgccaagcccgattgtccaggatgtgttgagcaaagactcctgtgacccaaacgctggcagccagttgacatttgaccctgagcagcctcccacccctctaaggcccaccacacccaagccccagagccctcagagcccccagagccccggggcaggaagtgccagctgtcacagcaatcacagtgccctgtccgcgaattcagaggaaagtgaaggaagggcagaagagcctgctcagagagagccagggcctgtgtccttgcaggatcccctggaagccacacatggtgatgagggcagcaaggaccttctggtgaacattggtgtggcagccggcccagaagaaaaggagaaggaggaggtcgtccctgatggcccctggaggcgaagctcatcacaggatgaggaaaggacagaggcacagagaacccccaagaggagatggggctctgggagacggccaaggcctcggccattctctgactacggccagctggccagccgcagtttgtctattcctgaagactcggttgctgcagacccccaga

SEQ ID NO: 216989 - DNA, 639 bp, Homo sapiens
aaagttcctgggcggtggaaagcgacagttcctgcacttgcagctctttgccaagcccgattgtccaggatgtgttgagcaaagactcctgtgacccaaacgctggcagccagttgacatttgaccctgagcagcctcccacccctctaaggcccaccacacccaagccccagagccctcagagcccccagagccccggggcaggaagtgccagctgtcacagcaatcacagtgccctgtccgcgaattcagaggaaagtgaaggaagggcagaagagcctgctcagagagagccagggcctgtgtccttgcaggatcccctggaagccacacatggtgatgagggcagcaaggaccttctggtgaacattggtgtggcagccggcccagaagaaaaggagaaggaggaggtaagggcagcggcgaggtccctcatgtgggcgaccctcctgcgggaagggagcttgcacaggtgttgcccttggtccctaacctgtcaaggtcagtggccctctgctgaccttgttgcccttacagtattagtgggaatgggagttgtcaagttgctgtttaccaagttcagaagtaatctctatctcctttgaaataaattgacaatgtacgagattcattgagatg

SEQ ID NO: 216990 - DNA, 400 bp, Homo sapiens
gcaaagtccaagatgaaggtactggctggcaactaaactgggtgactaagtcaggtgacccaatacatacataaaagctagttgagccagtttgaggacatacctgaaagaaacactagtcaccaatgcatctgtggctgtttttttcttttttcaaagagattctcaggaggtttagtatttattcattttcctttaaaaaggggacagcgatgagacaaatgtttacatacctgtgagactttagatagtgcccattaaatctacattttacataaggcgaatgtttgaagaacaggagaaaagaagaaaaagatgtctcagggagaagcaaaggcatgattaatctcatgttttctttgttctgtgcctaggaagataagctagtaatcaatattat

SEQ ID NO: 216991 - DNA, 575 bp, Homo sapiens
gatgctacgctgcttccttataatttggctacagggcagtcttcaccactaactcctgtgtgttcctggtctttttgcttgacctctcagtttctgaatttatcttattatcagagagtttggcagctactcatctcaaaagattgctagtaagcccacttggagcatagttaaggtcaaggcactactttaaggagtttattcaattttgaaaccacctgaggaggtaggtaccatcacccctgccttacagatgaggtgatgaggcacagagaggttaagcaactagcccaaggtcacacagctagtaatagtgggctgggattccaatgcagggagtgtggctccagagtcccggctctctgaggttcaaatgagacgacgggtcttgaagtgttctacaaactgtctagcggtcacatctgacctgctgttttcttgaagacctgcatacatcaagggtgagagttcgagaccaattttcctacagatacaaatgttttaacaagtttacgcggtttccattttttgtacctgaagactagtgggatttttaggtcacactatttcaaatc

SEQ ID NO: 216992 - DNA, 473 bp, Homo sapiens
ggttttacatattcttctctattgtgacaatgtcactctgtcatcagaaggtggagtcttttcacttccttgaatctgagtggatccttcgactgttttgaccaagactatgtggtagaagcgaagttccagttccaggtattgctcttatttcacctgacaagtttggtttcctgccttttggaagctgaccactatgttagaaatgtaatcaccctgaaatcactatgtcgtgagaaacccaaaggcaagtgaagaagccctggaggatgcgacatcaagtgtagaggcaaaagagcaccaaggaagaggccaaagaacactaagtgaagaagccattttgaaaatggatcctccagccccagctgccctagttgttacgtaaatcagataaattgcccagtggtacccttcccaatttctgccccataaaatcatgagccaaataaaatggtttgttttaagcttcaaaa

SEQ ID NO: 216993 - DNA, 628 bp, Homo sapiens
agcacctccctttggctgtagtccccaaccaggcagccagacatctgtctttcttaccccacaaccacaaacccgggatgtggctctgcagacaccctctacatggctgctgtctgtagggctggggctgaggtgggatcccagctccagtcctctctccttccctcactttctggagcctgtcagtcaacctaaaatctctggtatctgaaagcttcgatgttccctacttaatttatattgtggtttcaaaaaagccaagagtaagtccctgcccaaggccatagaggggaagttatggaaagcttcagggtgaccgccctgaacccagtctcgtggttgaaggctaggagtccatgttctatgctagagaagtgaaacgttagccctcatgggtactgtggagatggtggggactctgactccagattaaaggtccatttcagctaccctgggccaaaggttgtcttaagacattttggatgtggaagttgccaggcctgggggtaagaaagcaggtcacaggctaccttactgaggtgactattagctacatggcatgagtagattaaaaaaaccatagactgcactgtactccagtctgggtgagacagaccgtgtctcaaag

SEQ ID NO: 216994 - DNA, 467 bp, Homo sapiens
agcacctccctttggctgtagtccccaaccaggcagccagacatctgtctttcttaccccacaaccacaaacccgggatgtggctctgcagacaccctctacatggctgctgtctgtagggctggggctgaggtgggatcccagctccagtcctctctccttccctcactttctggagcctgtcagtcaacctaaaatctctggtatctgaaagcttcgatgttccctacttaatttatattgtggtttcaaaaaagccaagagtaagtccctgcccaaggccatagaggggaagttatggaaagcttcagggtgaccgccctgaacccagtctcgtggttgaaggctaggagtccatgttctatgctgagacaggagaatcgcttgagcttgggaggcggaggttgtaatgagttgaggtcatgccactgtactccagtctgggtgagacagaccgtgtctcaaag

SEQ ID NO: 216995 - DNA, 473 bp, Homo sapiens
caccttctcatacctgcactgaaccagctttgtcatcctgccagtaacctcacttatgagttaaataaaatcctaacatatgctcccattacattaaacattcacactttcagaagtcagtggtagacaagaagccttttattttaattcactgacagacaaatcagcaagcaattgatatgggggcgagagaagggagttgataatgggctgaacattagcatcccccccaaattcatatgttgatgccttaacccccaatgtgatggtatttggaggtggagttgttgggagataaacaggtttagttgagatcgtggggtgagcccatgagaggacacagtaaggaggcggcagcctgtgagccaggatggggaccctcacaatgaagcaaaggtgccagcaccttcatcttggaattcccagattctagaactgtacgaaataaatgtctgttgtttaagccaaacagt

SEQ ID NO: 216996 - DNA, 419 bp, Homo sapiens
aaggaagggcaggcagggtttagggtaactctggttaaagcctattacatggccttgtttcaaacagtgccaggaaaatgttcttttcttactaagatattatttttctgcacttttagattttatttttctttcatttttttttctcctctggtctcttaatgcagacttatgctaaaactgattacaaatgaaatcagatcaatgacctacaaaattaaaattaaatattacaccattgttgaattgattaattctatttaatgttaatgaaagattattaacttttgtaaggtagaacaaaaatgtgtatagtaaataatatccaaaaaagtacctgatgaattactgttatcttagtatatagttttggttcctgtttcacaaaattgtaattttttgggagatagatttctagt

SEQ ID NO: 216997 - DNA, 503 bp, Homo sapiens
  misc_feature (184)..(184): n is a, c, g, or t
  misc_feature (222)..(222): n is a, c, g, or t
  misc_feature (380)..(380): n is a, c, g, or t
  misc_feature (489)..(489): n is a, c, g, or t
agagagcacagaggacagaggaaaaataatatctggatggtttctgagaactttccaatatgataaaatacgataaaagatgtgaattcatacatacaggaagtacaacatattgagcagaataaatagaataaataaacatctagatacattgtgacaaaactacaaaacaccaatgatatcnttaaaagcagggagtaaaaagagatcatctacacaacnaatgaggattagactgaggagacttctttacaaccaacatgtatcaggcctattatatgcccacactgtcctaggtacttagaacacaagtatgaacaagccaggcccagcccctaccctgtggagctacagaacctctaacagggatcgaagatgtngcagtaacaattatagtgtgatgagcgatcctggttggagggcaaaagaatcggcaagaaaacaataccatagaacagcattatgaagattttcctatcccacgtaggnatccacacagggac

SEQ ID NO: 216998 - DNA, 454 bp, Homo sapiens
ccacgcgtccgcaggtgcctgtagtcccagctactcaggaggctgaggcaggagaatcacttgaacccaggaggtggaagttgcagtgagccaagatcctgccactacactccagcctgggcaacagagcaagaatccatctcaaaataaaaaaaaaaaaaagaaaaggaaaaagaaaaaaatctcaatgcaatcccaatcaaaatcacaacaggcttcatatatatatatatatatatatatatgaatcctgttgggatgtctggaaatattgagggctaattgagcatcttctctctctctctctttctctgtgtgtgtgtgtgttgtctcttcatgtagtgtatccccatggctagttgggcttccttaaaacagggtagtcagggtagttggactataaacgtagcaggtgacaggtgaccacctccctcaaggcaagatttccaaaaaa

SEQ ID NO: 216999 - DNA, 537 bp, Homo sapiens
aagtttgtactttaatttctcattaaatacttaatagatatctcttttttcaagttactcaatttatatgggaaaacagaaacataagcaagtcattgagatgcaatgtgataaatactataggggaagttaatttatcatgtcctcaaatatatgtatattactctaatgataccactctataataagtgctgcagatttaactgcgagcaaaatatagaggacctgccctcacataatttacaggtagaaattaatcaagcaatcattcaaataaatgtaagtgcaaagtagagaaaagaaaaaagagagtaattaaattatatggaggagataatatttgagctagaagaaatagcatctgcactgtattttgaagatctgaaaggaatttttcaggcacacaagaggacaaaagagattccagatagaaggtacagtgggcacaaatgcttggaggtgtaagatgtttgtggagcaataaagtaaggagagctagtgcatgtgttgtgtttagggaaatggagggtgagcctg

SEQ ID NO: 217000 - DNA, 257 bp, Homo sapiens
catcatttaccaccgcagatccgagcgctgatgggcaggcagatagccctctgctgggggcacgcgggctccccgtgcccgtaccactcgcctgcctgccggggccactgagtgtgcgccccggtgtgcccggcgtgtttggatggacacgtgggtgtgccagtgcatgggctaacgccgatgcaactgtgcgggtgtgtcaaacaagtgtaccacaaaaaagtgcaggtgtgcgagcccatccatgcacacgcatg

SEQ ID NO: 217001 - DNA, 405 bp, Homo sapiens
aaaaaaagcctgaaccttcctaattccttctccccctcactaagatagtaggctgctgaagaattaaaagacacctacagaatgtatcctaggagaaggttctattctgagagccctagagaataggctggactgagaagtaatttctactgtccagcctcttagttgaacagatccagcagtgggaaggcaaatttctccttcctactcttcaaataggatcgaagaccatttatagccctgctgcaaagctgacactaacttttttaacaatgaagtaccatcccaggacagggggtggtgctgtactgggccgatcctcaatctcaagttcaaagaaaacgagccctgtgaagaaagggtccaactggtgtggaggatgggagagacctataacctacacag

SEQ ID NO: 217002 - DNA, 356 bp, Homo sapiens
cccgacacagcactggcctcctgggaaaagggcccttgaaaacctttgacctcccactcccttcccggccatcagtctcagaaccacagaagccagttcatgaaggtcttggttctctctgtgacccaggcgtgggaccccatgaaagacccctactcttccccagaactctgcccagttcccccagcaaatcactgtcccagctctctccttcagccctcattcttctccaagaagcacttttcattcttttttcttctgtctcctccatattccacgttctgatgatctttttctctaaatgctgctagtgtctgctcatcttttccatttctaccccaccctctacctcagca

SEQ ID NO: 217003 - DNA, 1447 bp, Homo sapiens
tcatggccgccccgccgcgccccgcgccatcgccccccgccccgcggcgcctcgacacgagcgacgtcctgcagcagatcatggccatcaccgaccagagcctggacgaggcacaggccagaaagcatgctctgaattgccatcggatgaagcctgctctgttcagcgtgctctgtgagatcaaggaaaagacagtggtaagcatccgtggcattcaagacgaagatccccctgacgcccagctcctgaggctggataacatgctgctggctgagggcgtgtgcaggcccgagaagagaggaagaggaggagcggtggccagggccggcacagcaacaccaggtggctgtccaaatgacaatagcattgagcactctgactacagggccaagctgtcccagatccgacagatttaccactctgagctagagaaatatgaacaggcctgtcgtgagttcaccacgcacgtcaccaacctcctccaggagcagagcaggatgaggcctgtctcccctaaggagattgagcgcatggtcggcgccattcacggcaagttcagcgccatccagatgcagttgaagcagagcacctgtgaggcagtgatgaccctgcgttcgcggctgctcgatgccaggcgcaagcggcggaatttcagcaagcaggcgacggaagtgctgaatgagtatttttactcccatctgaacaacccttaccccagcgaagaagccaaagaagagctggccaggaagggcggcctcaccatctcccaggtctctaactggtttggcaacaaaagaatccggtataaaaagaacatggggaagtttcaagaagaggctaccatttacacgggtaaaacggctgtggataccacggaagttggggtcccagggaaccacgccagctgcctgtcaacacctagctccggctcctctggacccttcccgctgcccagcgctggggacgccttcctcaccctgcggactctggcctctctccagcctcctcctgggggaggctgcctgcagtcccaggcccagggtagctggcagggggccaccccccaacctgcaactgcctcacctgctggagaccctggcagcatcaactccagtacatctaattaagtttgggggataagcaggaaagagcgctgcgtgagctgccatgtatcgccagccgttgctttgttactgaacgtgccgccgacgacctcagaaaacccagatgggtggtggtgcccatgagcccctgctcctcagccaggcccgtggcgccggctcatgtgtctgctgcgactcgagatggcctgaaacgccactcattctcccacttcagttcgtttttttgacagtaattttatggtaacgctatgaattgaattgtctgttctaggactgggcacagattttcccattaaaatttttgacttattttaaaaaaaatg

SEQ ID NO: 217004 - DNA, 622 bp, Homo sapiens
gatggtggggggagatggggaggaggctcagcctccacgatctgattgattgtgcacaggaggccctgcctctgcttttgaggggccagcttcttgctgatttgagacagcagggagagcgtgaggtgagtgttttgcttagtcccataccctgatgggctctgggccgggcctgcggttctatgtaattccatccagtcagttgcctggggcagctccgttcacaactggggcttgcggccagcggagtgaccactgacagccacatgactggaaagtggcagacccgaggggtcagtcagggcatctgatttaatccatgggttagccttctccctatggggctggggtcccagagatggttcccacttgctgtgggaaggaggcgggagcacagcccgctgccaagtgagagcactgctgagtgggtgagggggcaggtgagcagcttggggaagtcagggcaaaggagggttccctctgagccttctgcttttccccacgtctttgttcctggggagaaaaattaaagcaacttggggttatgttactgtcttagtctactcaggccaccctaacaaaatgccacagactgggtgattttttttttttttgagacgga

SEQ ID NO: 217005 - DNA, 1701 bp, Homo sapiens
gatggtggggggagatggggaggaggctcagcctccacgatctgattgattgtgcacaggaggccctgcctctgcttttgaggggccagcttcttgctgatttgagacagcagggagagcgtgagaaaatgaattgtgacttgtcccggtctctcttatctagtggtaagcatccgtggcattcaagacgaagatccccctgacgcccagctcctgaggctggataacatgctgctggctgagggcgtgtgcaggcccgagaagagaggaagaggaggagcggtggccagggccggcacagcaacaccaggtggctgtccaaatgacaatagcattgagcactctgactacagggccaagctgtcccagatccgacagatttaccactctgagctagagaaatatgaacaggtgatctttctgcatggaagagtttctgtcatgtgaatgcgcatttgtcaaagcgaaacacggaacgctaaccacctttctttcgtggcgcagaacagggagtccatgcagttggtcgctgcagaggtggtccattgttactgaaagccctttccatttacttaacagtcacccgccggtgtgtgaactacagggggtggcaggcggctgctccgctgtggaacctgctgccctgtgccaccctgctgcctagtcacaggccggcgtgtctgtgctcccaccccaggcctgtcgtgagttcaccacgcacgtcaccaacctcctccaggagcagagcaggatgaggcctgtctcccctaaggagattgagcgcatggtcggcgccattcacggcaagttcagcgccatccagatgcagttgaagcagagcacctgtgaggcagtgatgaccctgcgttcgcggctgctcgatgccaggcgcaagcggcggaatttcagcaagcaggcgacggaagtgctgaatgagtatttttactcccatctgaacaacccttaccccagcgaagaagccaaagaagagctggccaggaagggcggcctcaccatctcccaggtctctaactggtttggcaacaaaagaatccggtataaaaagaacatggggaagtttcaagaagaggctaccatttacacgggtaaaacggctgtggataccacggaagttggggtcccagggaaccacgccagctgcctgtcaacacctagctccggctcctctggacccttcccgctgcccagcgctggggacgccttcctcaccctgcggactctggcctctctccagcctcctcctgggggaggctgcctgcagtcccaggcccagggtagctggcagggggccaccccccaacctgcaactgcctcacctgctggagaccctggcagcatcaactccagtacatctaattaagtttgggggataagcaggaaagagcgctgcgtgagctgccatgtatcgccagccgttgctttgttactgaacgtgccgccgacgacctcagaaaacccagatgggtggtggtgcccatgagcccctgctcctcagccaggcccgtggcgccggctcatgtgtctgctgcgactcgagatggcctgaaacgccactcattctcccacttcagttcgtttttttgacagtaattttatggtaacgctatgaattgaattgtctgttctaggactgggcacagattttcccattaaaatttttgacttattttaaaaaaaatg

SEQ ID NO: 217006 - DNA, 1665 bp, Homo sapiens
agtattcctttctcccgaagggttctatgcaaaaatcttcagacataacaccagtgctcacattttctcatggtttgttttctctccagaaaatgaattgtgacttgtcccggtctctcttatctagtggtaagcatccgtggcattcaagacgaagatccccctgacgcccagctcctgaggctggataacatgctgctggctgagggcgtgtgcaggcccgagaagagaggaagaggaggagcggtggccagggccggcacagcaacaccaggtggctgtccaaatgacaatagcattgagcactctgactacagggccaagctgtcccagatccgacagatttaccactctgagctagagaaatatgaacaggtgatctttctgcatggaagagtttctgtcatgtgaatgcgcatttgtcaaagcgaaacacggaacgctaaccacctttctttcgtggcgcagaacagggagtccatgcagttggtcgctgcagaggtggtccattgttactgaaagccctttccatttacttaacagtcacccgccggtgtgtgaactacagggggtggcaggcggctgctccgctgtggaacctgctgccctgtgccaccctgctgcctagtcacaggccggcgtgtctgtgctcccaccccaggcctgtcgtgagttcaccacgcacgtcaccaacctcctccaggagcagagcaggatgaggcctgtctcccctaaggagattgagcgcatggtcggcgccattcacggcaagttcagcgccatccagatgcagttgaagcagagcacctgtgaggcagtgatgaccctgcgttcgcggctgctcgatgccaggcgcaagcggcggaatttcagcaagcaggcgacggaagtgctgaatgagtatttttactcccatctgaacaacccttaccccagcgaagaagccaaagaagagctggccaggaagggcggcctcaccatctcccaggtctctaactggtttggcaacaaaagaatccggtataaaaagaacatggggaagtttcaagaagaggctaccatttacacgggtaaaacggctgtggataccacggaagttggggtcccagggaaccacgccagctgcctgtcaacacctagctccggctcctctggacccttcccgctgcccagcgctggggacgccttcctcaccctgcggactctggcctctctccagcctcctcctgggggaggctgcctgcagtcccaggcccagggtagctggcagggggccaccccccaacctgcaactgcctcacctgctggagaccctggcagcatcaactccagtacatctaattaagtttgggggataagcaggaaagagcgctgcgtgagctgccatgtatcgccagccgttgctttgttactgaacgtgccgccgacgacctcagaaaacccagatgggtggtggtgcccatgagcccctgctcctcagccaggcccgtggcgccggctcatgtgtctgctgcgactcgagatggcctgaaacgccactcattctcccacttcagttcgtttttttgacagtaattttatggtaacgctatgaattgaattgtctgttctaggactgggcacagattttcccattaaaatttttgacttattttaaaaaaaatg

SEQ ID NO: 217007 - DNA, 1924 bp, Homo sapiens
gatggtggggggagatggggaggaggctcagcctccacgatctgattgattgtgcacaggaggccctgcctctgcttttgaggggccagcttcttgctgatttgagacagcagggagagcgtgagaaaatgaattgtgacttgtcccggtctctcttatctagtggtaagcatccgtggcattcaagacgaagatccccctgacgcccagctcctgaggctggataacatgctgctggctgagggcgtgtgcaggcccgagaagagaggaagaggaggagcggtggccagggccggcacagcaacaccaggtggctgtccaaatgacaatagcattgagcactctgactacagggccaagctgtcccagatccgacagatttaccactctgagctagagaaatatgaacaggtgatctttctgcatggaagagtttctgtcatgtgaatgcgcatttgtcaaagcgaaacacggaacgctaaccacctttctttcgtggcgcagaacagggagtccatgcagttggtcgctgcagaggtggtccattgttactgaaagccctttccatttacttaacagtcacccgccggtgtgtgaactacagggggtggcaggcggctgctccgctgtggaacctgctgccctgtgccaccctgctgcctagtcacaggccggcgtgtctgtgctcccaccccaggcctgtcgtgagttcaccacgcacgtcaccaacctcctccaggagcagagcaggatgaggcctgtctcccctaaggagattgagcgcatggtcggcgccattcacggcaagttcagcgccatccagatgcagttgaagcagagcacctgtgaggcagtgatgaccctgcgttcgcggctgctcgatgccaggcgcaagcggcggaatttcagcaagcaggcgacggaagtgctgaatgagtatttttactcccatctgaacaacccttaccccagcgaagaagccaaagaagagctggccaggaagggcggcctcaccatctcccaggtctctaactggtttggcaacaaaagaatccggtataaaaagaacatggggaagtttcaagaagaggctaccatttacacgggtaaaacggctgtggataccacggaagttggggtcccagggaaccacgccagctgcctgtcaacacctagctccggtgagtgaggctggcccagggacagtcatctgtacccatgtggacggccactgagctgcatctggggaggccacagtgggaccacatctcccttcccccagtggtcaactctgtgtaactctttcttctgtttcaactgtgagagttctgttcctcttggccatgatcccaaccaacagatacctgtgctttggggacagaatggcgatactaataagaaaagacatgaaaggtctgggtgcggtggctcacacctgtaatcccagcattttgggaggccaagatgagtggatcacctgaggtcaggagtttgagaccagcctggccaacatggtgaaaccctgtctctactgaaaatacaaaaaaaattagccaggcatgggctgggtgcagtgcctcacacctgtaatcccaggccgaggcgggcggatcacgaggtcaggagatagagaccatcctggctaacacagtgaaaccccatctccactaaaaatacaattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattctcactcataggtgggaattgaacaatgagaacacatggaca

SEQ ID NO: 217008 - DNA, 563 bp, Homo sapiens
gcagtcaaaatgcttcagctgcaggtaataggaagtccagctcaaaccggtttaagcggaggccaggggctgcagggtgggcatctcccatggcacctgctctggtccctcagtccccctgagtggtgcacacttccctccacaaggtgtgttgccgggtggccacggctgtcctgggctcgcatttgctcatgacagtgtctggagagctccgcctttgagggctcttcctggggcctctaacgagagaggactggggggaccacgacaaaaaatatctgggttcttgagacagcagaaaaggtggtggaagctgggtgagtagccagacagtatctactagaatttttttttctccaatttaagtttctccctggtgagttcttaacccgccgctgactggccaatgctagcagacggacacagggaacaaacaagtggcatattaatcttcatggaaaagcctagaaacgggcagtcctttcacagcagttctgtgtctacagtgaacacatgggctgtgtttaactgtgtaaacacaataaagttgtgttatggaagtg

SEQ ID NO: 217009 - DNA, 221 bp, Homo sapiens
gtcttgcaggaggaaatggcccatggagagagagagaagccaaggatcacaaggcaccagacccagaacttttaatattacagaattttaacaatttctctgattctatactgtatctctcctatgcttaaagtctagaatcccaatggcattcattaacataatcactgatcttacaatatatatacaataaatttatatacgataaataagatcactga

SEQ ID NO: 217010 - DNA, 472 bp, Homo sapiens
ttaaaatatattacattttgtttagggtcaaaaatgttttctgcttcagtaactactgccagtttatgtaaccccatgttattatctagatattccatcattccaatttctcaaggctagtatgaggattccttggttagtattttttacaaagcaacattgtatatagttccagttaaccacattaagtgctaacttcaggttctaccactaggaattaaatatttctttgttaaggttacttttcttgtattaaaaatactgccctgtggctcctctcatgcctgtaatcccaacgtgctgggattacaggtgtgagccaccgcgcctgtccctattgctcactttttaagcctgttccccagataggattggagaaatatgccaattatcacaaatgtttttactacatttcttcttgctttatgaattgctgtattaactgcagtaaagctatgaaaatatttcctag

SEQ ID NO: 217011 - DNA, 470 bp, Homo sapiens
tataggatctaacttgtgtcctgaagccagacacactacaaagcaaaccattaagacagtgagtcccaagaatttttgactcaagattttcatgtaatggctcacttagaaaatactgaaggaaagtcagctggttgaactgaagaagctgctcctggctggagatactcggcatcagaacttcagcctcatgcatccataccttaacccctctgcagttcaccagctgggaagctcccaattaataacattaagtggaaaaagactaaaaatttcattattaccaaaatgagtacaacaaggcattcaatgaactctaacttctgtatttcattaagattttgggaaaataaacttggaagttttatttcttaatatgataatctgtgggtattttaaaacagaaactaagagtacacacaaaccaaaagtgttccctttataatacaataaagatgcttcttgcctct

SEQ ID NO: 217012 - DNA, 544 bp, Homo sapiens
gctgtgtgatcttagattaggcactgtttctctctgcctcaacattcttgctcctaaagtggggttaattatatataccttgcagggctattctgagaattaaatgagttaatgcagaagttctgagcctttttggtctcaggactcctttatattctcaataactactgagaatcccagagagtttttatttgtgtaaattatagctactcatgtttattgtattagaaatcaacttaattcattaaaaaaccgattgtggccaggtggtgtggctcacacctgtaatcccagcactttgagaggccgaggctggcagatcacaaggtcaggagatcgagaccatcctggctaacatggtaaaaccctgtctctactaaaaatacaaaaaaatttagccaggtgtggtggcaagcacctgtagtcccagctactcggaaggctgaggcaggagaatggcgtgaacctgggaggtggagcttgcagtgagccgagatagtgccactgcactccagcctgggtgacagagcgagactccgtctca

SEQ ID NO: 217013 - DNA, 482 bp, Homo sapiens
ccgcctcagcctcccaaagtgttgggattataggcgtgagccaccgcacccggcctgaaatctttcttcacttaaaatattgtggccatctttccatatcgatatatcagaaccaccttccaaagaactggctcaaacagaaaagaaagcaaagagtcaagaatgatgccaaactttcctgactagattaggagcctggagtgtactaagaaagaaatgggcaatttcacaatggaagaaagaggattccacttttggaacagatatcagaacaaggaatgcacatttatgattcataagcatggatctgagaaagaatgatctaagtgcagaaagaaaaaggtaacaaatacttattggacacctagtgtatacctggactgcaacaggagccaggagacatggaagaaacaaaagtatataacgtaaaaggcagaactaattctaacgaacaaatagctaattgcaagtgtgaagagctc

SEQ ID NO: 217014 - DNA, 416 bp, Homo sapiens
caaagccggaagcatcacattacccaacttcaaactattaatagaagggtagaaataaccaaaatagacatggtactggtacagaaacacaaacacatagaccaatgtaacagaatagagaacccagaaataaagctgcacactaacagccatataattttcaacaaaggcaacctcagcaatggtgaaaagactccctattcaataaatggtgctagaatagctgtctaggcatatgcagaagaaggaaactggactcctatctttcaccacatacaaaaattaactcaagatgaattaaagatttaaatgtaagatctcaaactctaagaatcttagaagaaaacctagaaaacaccattctgaaccttggccttgggaaataatttatgactgagtcctcaaaagcaactgcc

SEQ ID NO: 217015 - DNA, 517 bp, Homo sapiens
cgttagccaccagggggccgcctgcttggaacaagtggtgtagacgccacagcttttctccaaaccaaccaaaacattccggggcagctttggagcaaagcccaggaacttccctgcaaaggagaacagctctccaactacagaagcctgcaagtcctatggtgcagacttattaagagtagagaagaaagcacggacttctcaccgaggaccaaagggaaatggggtctctggggcctgcaactttcttaaaagtgcatcagtgaaaccctgcttatccagcggggtggttgttaatgctgtcagcaggggtggggggcctctcacccctttccctgggacgctcagaagaagcgagaataaaacatacatgtcactggctggaaatctagagaaccttccaataaataacctatacattgtcaggcagctgaggatccatatcgtcataactctattatactgcgtgttacacgaatagatgtgaatattaaattatgatgtcggaattatttta

SEQ ID NO: 217016 - DNA, 401 bp, Homo sapiens
gtattttattctgtgactggtacagagctaataaaagttcttagcaaaggaaggagtgatgattgggactgaagaagaatagcactcctaggctgggtgcgatggctaacacctgtaatctcagcactttgggaggccaaggtgggcggatcatgaggtcaggagttcaagaccatcctggccaacatggtgaaaccccatctgtactaaagatacaaaaaattagccaggcttggtggcgtgtgcctgtaatccaagctacttgggaggttgagaaaggagaatcgcttgaacttgggaggcggaggttgcagtgagccaagattgcgccattgcactccagcctgggcgacagggcgagactctatctcaaaaaaaacaaaaacaaaaacaaacaaaca

SEQ ID NO: 217017 - DNA, 495 bp, Homo sapiens
aggggactccagtgggagggtctcattctttaaggtctctggcgtgctgttccagagtttacccatcaacaattcttactttaattttttggagccagggtctcgctctgtcgcccaggctggagtgcagtggtgcgatcatggctcactgcaacctcgacctcccgggctcaagcccggcctcctctggcttcagcctccccaaaaacaaaaagttattttaacttaacagaaattgctcatattacattctaatcccctgttttctggattggactttagaggagaagaaggagatgcaaagagaaacttgctgcattctagattaactcatagaacaaattatttctgtcctcctaaagataatccttaaactttactggcttaaaactggtgtgacatttcgcattatatgtgtattttgctttataaaatatgtgcattcctgaaagcttgtgtataaattgaattgtaataaacgactacagagagact

SEQ ID NO: 217018 - DNA, 434 bp, Homo sapiens
ccacacccctcagacagcaccgtctttcctctgcttggaaaggacccagagagcagggatgagcgtatagttcctcagatgctggtggcttggcaccccaagacacaggcattctatgttggcatccactgaaggacctgtgtggtctttggggcactgtgtggcactagctgccagcccatgaggtcacttatgtctaaatcgtctctctctctcctgatccaagccccactgcagtcagccctgaagggcttgacgcctccctgtgtagtcagcagggccctttctcactgttctctcccactgtggtcacgtctctgaactttggtccatgatacataaaaacacattagcccttttctactcttgagagcttgatttctcatcttgctatgagtaaagagagtcactttgaaactcaagctgagcagtgt

SEQ ID NO: 217019 - DNA, 512 bp, Homo sapiens
caaaataattacttgaattgccatagaataaccgaaagcaaaaagatattgtttggaaaccactgatatttatgagctggccataagagctactataagtattaaataacttcaagatataacctacagggtcagtgactcagaggtatgatagtaaatcgtatttataacaaataaaaaaccataatggtggtgaaacaatggagaacacattcatgaattcattatctgtcaatcgttttggaatatgatatatgttcttgctcctcctcaatttccgattttcttttttcaaatctttattgggtattccatatattgtaattttatataacatttctttttttgttgttttttgcatttctagtaaaaagaaagaattggaaaaggctgtagtcaaaaattttatcagaaacttggaaggaaacaaagtgatgctgggcatggtggctcacccccataatcctagcagtttgggaggccatggtgggcagatggcctgagctcaggag

SEQ ID NO: 217020 - DNA, 482 bp, Homo sapiens
cagaacagggaagagttaagccttctgctcacaagtattctgagatgctgacatgccccctgggcaagccagatgcatcttgagcaatgccaatgattttataaatatgctggagccttgaatgaatgtaaaaggctagatgtataactcactattcaagtgattattattcccccaaattgccctccactgcattccagtgggatgagtcacaggaagcagtggccacacttaacatttatttagtctagaacattttaatgacaagaccacaaatatatgctcttttttcattgaaaattaatctaagttgcacagaatatatttgttcaacataaaaaatttcaaataggatagtctctcttgacatttccttcaattccaatccctgtccctgaggcagtactgtttgtgttcacccttttatgtgtgtaagtgtatgcatatatgtgtcaaggaaaatatacggaattattattttt

SEQ ID NO: 217021 - DNA, 393 bp, Homo sapiens
gaaatttaagaatatgagaaattcataagtgtttatactttgaaccagtaaaattcaactgttggaaatctattatgaggaactactctaaattcagaaagccttcaggtataaagttggctaccctggtgctctttttagcaacatataatcaaaagcaacctatcataatatcacaaaaaagtgaaattgtctctggttcaacaataattaaagcaatgcttatgaagattaataatttggaaaaataatcaagatataaaacagtgggccgggcgtggtggctcacacctgtaatcgcagcactttgggagcccgaggcaggcagatcacaaggtcaggagatcgagatcatcctggctaacatggtgaaaccccgtctctactaaaaat

SEQ ID NO: 217022 - DNA, 809 bp, Homo sapiens
ttttgagacagggtcttgctttgttagccaggctgtagtacagtggtggcttagcttactgcagccttgatctcctgggcacaagcaatcctcagaaagacctagtctgaaaaaagtcctttctacaacacttcatcttatagcaattactacattctgtagattctctttttaaaggtctatctctttgactagaatgaagggaagggagaaagactgagaaggaaaggaaggagggaaggggaaactggtccaactgggaagccatgcaaatgctatcaatcacctttgctaaagagcttcattctggaggtttcagatgaagaaatctgccaatgccacctttaagggttcatgacaggagattctctatcagatctaagagcttcatttatcttgtacctatgttaattcaccctattttctgttaactcaggtctctctccgtcatttacatagcatttgagatgactgagtaaagtgtcataaaaatccaccaccattaccttaattttgagtgtagcagtgtttagggtgagaattaaaagatgaattgtgcgtctgcacttagagtagagacaaaagcattccaggcagaaggaactgcctgtgtgagggccctgaggcagcaaagaggttcctccctttatcgttcttctgcctctcagaactcttattagataacactaataaaatgacatctggattgtctggtacattatcagacatttaataaatgctagtttgattcccttccttctctatgccattctttactgtgtagaggtcaacccttctgtcgtcttctc

SEQ ID NO: 217023 - DNA, 1031 bp, Homo sapiens
tatgtgatttgaggcaaaaaagaaaatataatactttaaatatttttacaaaggcattcgcagaaccactgactttcccccattctgatctgctggttatctatagccctgcctacttcttccttcccttaattttttcattccaaaaaaatacgtgatgcctcctacgtgcaggccctgtggtacctgccagggacaaacagtaaataagagaaagactttatgctggggaagctcccattttgggagtagatacaaaaatggactagagaatgacagtagagtgactgtcactatattagtcacaagtacagaattctgtggaagcacagtgaaaaatgacctaactcagccttctgggggttatgaagagctgtccagaaaggcaatgtttcagccaagatctcaaagatgaacaagtagtgttagcccttcacagggacaaggcaggtgaggaaacgagggagggtatcccaggttaaggaaacaggaggcagcaagagaaatgtctgggctgttttctgacaaacacacaaggttccgtaagattgcaggacagaaagaaacaaggtgagctagaaccagctcaggcatggacttgtgtgccgtgcaggataattcaaaattgactgaggaaattgatgacccagagaggggcttaagcatacaatgaaaagatcagtttagcttaaaattttttatttttgctttgtaagaataaaattaatcatgtataataaaaaattcatcaagtaaggaaaggcttattgaggaaaacattaatttctggctcccgccccctcatcttccatctctgaatgataagaaatcatctttagttctttcagttgtttttttcttgtagttacctccatactaatttttaagctatgttgctggttctgcttgacatgataaaaccctttagctttttctctgaacagtttaagatcagaagttcaaagatgtacaagtaaagtttctagtaattagggcaataaaaaagccaaaagtaacacaaatacattttc

SEQ ID NO: 217024 - DNA, 406 bp, Homo sapiens
tcggataagtcccagggctcctggcgctctcagcctggcatgcgaggccctctgcgcctgccctgccctgtcctcaaactctcccctgagagctgcgtctccgtcgcccaggctgtgccctcctgtgcccgacttagaactgttcggaataacactcaaaattttaaggaaattaaacactcgaacaaaggatttttagcaaagcaattttacttctgtacagaggggtgcttgtccttggccagtcgccatgagagcacacctgaacaaagggacacgagagcctttattcctgatgcaagtcctgctcctgtaccctctccccattggccggggtcgggtcatacaatctaaaccaattttggttggctaaacatttgaatttttgtagataaggtgggcacgt

SEQ ID NO: 217025 - DNA, 350 bp, Homo sapiens
ggaattcgagaccagcgtgggcaacgttgggagacctcatttctacaaaaaaaaaaaaaaaaaaaaaaaaagccaggtgtgatgatgtgcaactatggtcccagctactcaggagactgaggtgggaggatcacttgtgcccaggagcaatgagctgtgagctgtgagtgtgccactgcactctagcctggggtaacagaacaagatcctgtctcagggtgcatctgttgttttccacctctattgtatgtgttttttttctctaagccaataggagtaagctacaggatatgacaccccttgacctcttaatatttcagtgtatttcctagaagcgaatgcattatcct

SEQ ID NO: 217026 - DNA, 316 bp, Homo sapiens
caatcctacaaataaatacatttaggatgatcccagcattccaattaactgatgtgaaggtgaaaccatgaagtgttgaaatctaaagtattaataagcaacgttttattctattaattaaaagtacattaatcaataatttctacaatgttgattaattcaccaaaatgctgcttctgagcattactgtcaaatttacttattacttaagactgtgtttactaaatggaatacattgttaggtactatagagtacctaacaattaaaatattccctcctcctctaatacataacttatataagacagataaaaaa

SEQ ID NO: 217027 - DNA, 491 bp, Homo sapiens
attgaaggaaatgaaaatgagaattattttatgctctatgttttataatgaagtaaaatttccgaaattcccagtatttccctatctatattaagtgtatacttgtgaattcatactgttgtacatgtgtcaacaataattaatgcttgaatagagttgcctaatgtaaagaagatggccttcatacagacaatcttattggtacttcatgcaaaccctgagagaggtcatgactggcttaagggaatacaaatgttatgtgtcaaacccaggcataaaacccagacattaactaaattagcactaatttaaagatgtgtgtctatgtatgtatatgtatgtatatccctaaagatagctcaatggtaaattatttcgccattcagtattgaatctaatgaaaactaagaatttgtagcaactaaatgatgctatacgcaagttcattttttagattgaaaggttatctttgctttctttctgtggaatta

SEQ ID NO: 217028 - DNA, 316 bp, Homo sapiens
gctgctacaattatctgactacaatctgtgaaggcatcacagaagaggtgacagctgttctgggttttgaagtttacataggagtttgccaggtgaagagaagagagaaagtaaaaggaagaagcctgagttctgaatgttccaaagcaaagtactttggggccagcagggtggggctgtggggatctttagtggggccttgatacagggaattacagtagccccagaaactgtggtaagtacttacatttttatgtaactctaaattcttccaaaaatggccagggctcggtggctcacgcctgtaatcccagca

SEQ ID NO: 217029 - DNA, 598 bp, Homo sapiens
tcccatatggcctctcttaaaaaagaaagtcctgattaagaagcaacttcgtattacctctgaagattttcatggctgctgcattgagatattattctaagctaatagattgtcaatcacattatttacataactccttcaatcatttgtccatccagtatatactgagcaccttcttcataccaagccttgttttaggtactggggatacagcagacaagaaccactgccctcatggagctttcactctactccttgcaaatgtacattctgctaggtccgtgcagcccaaacggcaggtgtaacatcatgaggctactgccgctgaaccatcatctttccattttatattcattaactcttttttatttagtccacattgagtcacatgttaacttgcaggtccagatattcagccaagagtggagtaaagaggagatagagtcttctgatgcatgatacttaatattagttcattcattggctcagcaagtatttatcaggagcctacttctagcacctattgtgctaagtgctagtaatgcaaaaattagtgagacattatttctgctgtggcccaggaaaaggaataaacagt

SEQ ID NO: 217030 - DNA, 315 bp, Homo sapiens
gaaattgaatggagagccccgaaataaacactagtttatacggtccaacagtgtttgacaagggtgccaagacgactcagtcaggaaaggatagcctcttcaccagatagtgttgggaaaaactgatatccctatgtgaaaaaatgaagttgtatatcttataccatacacaaagattaacacaaaatggattaaagacctaaagataagacctaaaactataaagctcctagaagaaaacataggagaaaagctttatgacattgagtttggcagtttcttggatatgacagcaaaagcacagacaataaaagc

SEQ ID NO: 217031 - DNA, 121 bp, Homo sapiens
ggtgtgttttggtatttatcttgattggtgttatctgaggatctatacttcgcttgcttctattaattttggaaaattctcgggcattatttcttcaaatatttcctctatttttttcttc

SEQ ID NO: 217032 - DNA, 482 bp, Homo sapiens
tcttaaatgttcttattctagagtttgcattaaaagcaaaggaaaagctgcaaaaatagttgattagatacatctgagtccacattttagatatattgaatttgaaaagaatcaatgataaaaataggacttgacaacataactaatagttgaaaattttcttaacaatgaaaatgagaatttttgttcaattttgagggttttttttgttgtttctgtttttgttttgttttgagtttttcagttggcctatgggaagaaatatttgcagcagcatataatacccagaataatcttgaacttgccctgaggactgtagggaaaacccctacttgccttagcatgttcttggaaacaataccacaaagtgatttatgtttttctatgagaacaacattgtgaaagcagcatcttttctgaccaaagacttggcatcatataaaccatcttaccaacagtacgccataaaaacagatatgaat

SEQ ID NO: 217033 - DNA, 507 bp, Homo sapiens
ttagaatcagaagtgccatctgacccagcaatcccattactgggtatatacccaaaggaatgtaaatcatcctattataaagatacatacacacatatgttcaaaacgttagattttaaagtaaaaactcagggatagcacggcccccagcagtagattaagctggataaaaagagccaggaactggaaagggcatggggaggcgcagagctgaggccaagggtcaagcacctcgccgggaaatgccactgagcacagttctccagccgctgcccaagtccctcttgaaatgggcaggacagggagggtgcggccgcaggtgctggggttcatttcttaggcctgcgtcatggctatggcccttagctgggtggtgtgtgggctgtgtctatgacaccaccgaggacgtgggtatccctggggtcccttagaataggaggtggatcctgtggcactttggtgaagccagcggtggtcccatctggccctttgctccgaccctcacgg

SEQ ID NO: 217034 - DNA, 408 bp, Homo sapiens
tgcttcttcctagatgctgtctacagcctccccagacccacatgagacagactggggtctcaccttgtcgctgacctgccttgagacctcagacaacaccaataattaagcaagcccgagtgagcacatgctccgtcctcacctgtttattcacatgtcaactccgctcatcccattgcagccctgtaagaggatgggtgggtccctagtgaggggactgaggaccactgtggggaccccagagccctcagattcctggtgacagcagctggtctgccccctgtctgccagcctctgagcctctgctaatacaccctggaaggcaggagaagccggatgaccctgaggtcttttgcacctggtgccactgagggcctcagttgtgctgtcctggttgctctgcaaaag

SEQ ID NO: 217035 - DNA, 410 bp, Homo sapiens
tatgttgctctatggtgttttgatggaaggacatgaagaaaatctagctcacacagatacatagttggaaatgggtgaagtattttcatcatcttttgataactgtggatattctctgattctacaccagaaatcaacaagtggtagcttttaaatgtggagtctgaaatgtggtacctgaaaatctgtcaataaactttttttactttgttaatattaaaatctattggtctatcttgcgctttgaatggatttttcacctgtgcataattttataacattacccatttggtcatttggaaatacttgttcactaagttcggagatctttgagatcttttgaatgtttcacatttcatgatccaataccaaattctccacattcattaatatcaccatcaatctcgtca

SEQ ID NO: 217036 - DNA, 617 bp, Homo sapiens
tgagacagtttctcctctgttgcccaggctggagttcagtggtacagtcagggcttcctgcgacctcagactccggggctcaagtgatcctccagtgtcaacctcctgagtagctggaactacaggcatgtgccatacccaactacaaggcatcttattgatttcagggcagctgctttacaaagcatctctattaataacatcactgcatagcacactgagtggcctaaaacacttataatctcatggtttctgaagggcaggaatccaagcatgacttagctgagcccaccagcttagggtggttcacaggctgcaatcagctggggctgcagttatctcaacttcaactagagaaggatgggcttccaagctcacccacacagctgttgttaggagtcagttttttgctagctgttggccagaggcttcctgcagccacttgccacgtgggcctctccacagggcagtcacaacatggcaccatgcttcactagagggagcaaacaagaggagcaagaaccagagtgagcaggagaaaagggagtgactctttctataacctgatcacagaagtgacatctccttagtcttgcctattcaattcataataaatg

SEQ ID NO: 217037 - DNA, 571 bp, Homo sapiens
ctggtcttgaactcctgacctcgtgatccacccaccttggcctcccaaagtgctaggattacaggggaaagcaggctttaaacaggatgtggaaagctttgaatgagaggctaagaagtttagatttaatcctagaggcaaaaggaagcactgaaggtgtggcagggtcatttcctgaaatatgaatttgtaaggcccccaatgttaataaagacacaaaatgtttcagattacatctcaaaggaagtatgcaaaatgcatacgaagaaaaccttaaaaggctcctgaggcaggcacaagaaaatctggacaaatggaaaggcacgctgaggtcttgaataaaaaactcaacatcatcaagatatcaatttaccctaaatcaatatatatttaatagtgttttaaatatatttaaattatacaatttgaatttgtgggaaaaaagacaaatgattaaaaacttcattgaaaaaacatgcaaccacaaataggaatattccaaaaaataagagtaataaagggctaccaacctttccagatgttttgtctatcaaagaatagtgtaaactta

SEQ ID NO: 217038 - DNA, 298 bp, Homo sapiens
  misc_feature (38)..(38): n is a, c, g, or t
  misc_feature (48)..(48): n is a, c, g, or t
  misc_feature (67)..(67): n is a, c, g, or t
  misc_feature (72)..(72): n is a, c, g, or t
aggagctgatacttcggcagaataagacaatcagcagnataatatatnatgtatcagatggtgatanatgtngtgaagaaaagtaatgtttgtatgttgtgtgtatgtattgtgtgtctgtgtgtgtgtaagggtggagccccaggtgaggatgggagagtgggcagggcagtggtgtgtgtctcaggagaaaaagaaaggccgctggccctgacctgttctgcggggatcactgctgtgtatgttgtgtgtgtgtgtctgtgtgttgtgtgtgtatggtgtgtctgtaagtcgtatg

SEQ ID NO: 217039 - DNA, 403 bp, Homo sapiens
ctacttatgaggatccggattgagatagcacggtgacatggcagctgtggtggggctctgaggctgaggaggtggggactctgaagaactgaaagaaggatgaagacagctggaagtcaggagcacgaggagagtgtgtgtgtctatgtgtatgttgtgtgtgtgtacgttgtatgtgtgtatgtttgtaatgtttgtatgttgtgtgtatgtattgtgtgtctgtgtgtgtgtaagggtggagccccaggtgaggatgggagagtgggcagggcagtggtgtgtgtctcaggagaaaaagaaaggccgctggccctgacctgttctgcggggatcactgctgtgtatgttgtgtgtgtgtgtctgtgtgttgtgtgtgtatggtgtgtctgtaagtcgtatg

SEQ ID NO: 217040 - DNA, 462 bp, Homo sapiens
ttaataatacgacaggcacctctcagatctgctgcatccgtatttcttggaggacaacaggacacctaatttttagtctctctcccagggaagttttgttcaataactctgtactttgtgccactcgggttagatctcgtttgtatatgttctcagagctctctgcattcattctgtaccactttttcttagcaccagaattgcacttttgcagttattagtgtaattactagtttaaagtcacaatacaggctccatgtgggcatggattttgtctgtcttatttatttgttgtatttccactatcagtttcaaagcctgagacctagtagtagacactcactaaatatttatttaataaatgagtgaatagagggtgctatgcaaagcataccaaacaatacaatatagtacttaagagcatcaattttagagggagaaatttttgattttgagtctttc

SEQ ID NO: 217041 - DNA, 1090 bp, Homo sapiens
ggtaaattgccatttttacttaccacactggattctccaagtcagactaggatttgggttacaatggggatcattggggttaaattacttaagggataatgagatttacacagacccattaatctttctaagctattgagaaattttacacgtactgtgactgaggagaacctgatactgtaaaagagcaattcagtacagtttcaccatccaaggacttaccgatgcaaattcaaatacacgtgctaagtaaaatgggagagatagagcaagggagatataaaaattccaatagagcaattccagatgccccatctgccaccacgtgcaatggatctatgttcactagtaagtgtgattgaggtaggagatgtggatctaccactcttcccatctcagttcctttggtgaactgttgagtgtgaacattttgccttacattgggtgattcaaggggttctccacggtaaaagtgactatgtcagattcttgccacataatctaagagatgactccactgaagtttgtgttactctaccatcaaaagatgtatctatgtttacagacattcttttattcaatttgaaaagaaatttcaatgtcaataataaatattagcctcatttgtgaattaaacagatgttaagattgcatgcacgtcagtaaaaaaactgttgtacaggaaactctatgcacaggagcctcctaccatgtcatccagctcagctacctttttctattcagctttctgcaagtatttattttatataatgcacatgtaactataaggatacaaacatggatcatacaaagaacctgccctcatggagcttaaaatctaaagacagatgataagtgctaaacataaataactgtccacaacattaagatatcagtaaattcattcattcatttaattcactcatacattcacttgtgcagcaaacatttactgaataggaactgatttcaaaattttcagctaggaatgcaaaactgagagagaaaaattcttagccttcaaaaaaatcaaagtcgaactgctcagacaaaaattcaaagggaaaaataaattataactacataagga

SEQ ID NO: 217042 - DNA, 272 bp, Homo sapiens
ggctgagtggtactgctgtgacatgtgcgcatgttctcgcagccctgtgtaagctcaggacgtccctggtacccaagagcagcaggccaggcctctacgggaagcctgtggccatgagcatccctgcacagattgactcattcaaagcccatgggatgtgccagtggcaagccgtaaagcacaagtgaacacaggtctccctgcaccactcttgccctcccagccttgttcccacacgtggtacagaaacaccactctggcctgtcactccc

SEQ ID NO: 217043 - DNA, 1049 bp, Homo sapiens
agtgaccaggcagaacatgtcaccagctagttcatgccagggagagcctgtctcagttcattgggatggccagagtctgttcaccaacagtcttggagaaagtgttacaaataaccctgtcagtactcttagctactgtttactcaacatgatgtgtgtgagacagctggcaaacactgccattaaccctggtgtgccccatattagtgatgagaacactgaggctcagctcaggtggcttctacaaagtgattcagaagtggcaggagacagtcacatctgtggtgccgaaagccagtgcctgtgctcactctctctctgccagatgctctagccctggctgtgcttcagtgggtgtgcttcacctgcagatgctgggctctgtgccaaaccttcatgagaatctcgaggggctggctgcacagatgacttcaatgtacagacaccgttgagaaccactgcaggagagttatttgtctccccttctggcttgtttttaaaaatcacattctgttcctctaaccctgtggtttggtagtgacaagacttagatctgttacctgtatttttctcgacctgtaggtgctggttacttcccagctcggtaccctaagcaccagctgctttggtttttttggaatcagagacttggttttctattaccatctcccagtccattcatacctcctcctccagtgccccagccacagaccattgctcagccaagactctgtgtcacgtggattcatggtaataaccaacttgtaattccactgtggttttccctctgttgctgtcgccctgcctggctctgggcggctcctcccactgttgagggcactcagaaactgcaagattactgtgactgttgctagagccagctagagctagaccttcctggaccagcaaagttgctgccacaaaaaaagagagtttcattcacctagcagccctaaaccaaacatagggcaggcactgcctccattgttcttccacagcagggaggatggcatcatgtctatggtgggtctggggggttctgtcacctg

SEQ ID NO: 217044 - DNA, 473 bp, Homo sapiens
ctgggtttatgccattctcctgcctcagcctcccgagtagctgggactacaggtgcctgccaccatgcctggctaatttttttgtatttttagtagagacagggtttcaccatgttagccaggatggtctcaatctcctgacctcgtgatccacctgccttggcctcccaaaatgctgggattacagacgtgagccactgtgtctggccggctaatttttgtataattagtagagatggggtttcgccacattggccaggctggtcttgaactcctggcctcaagtgatctacccaccttggcctcccaaagtgctgggattacaagcatgagccactgctctcagccttcattcactttttataaagcctttagtgcaggagctgtcaacaagctacacagaaggccatggagttgcagtatcacatctcagtaccagcaggaaaacaaacaaacaaaaaagcacatttaac

SEQ ID NO: 217045 - DNA, 625 bp, Homo sapiens
tgtattataacagaatgtcagtgaataagttattttatatgaagttttgattttttttaaaactctggatcacaggttctgggttttaattttcctctatcactagttagcaaacttgacaaattaccttagcatctttaagtagcttcttaatttgagaaggtttgattagatattatgattattataataggtctcttcttgtgttgtactcattaatgttattatgaggttaatgttattattaggcttttaacaatatgactgtgtacacatgactacatagattatcagagctgggagggatatcaagaagctgtgtggcctgtttttacattttttatttctttttgctttttgttttgttttttcatatttgtaggggttgtgaagtccctagaaaacagagaatccagttgtaagaaacatggctttaaagttgaacattaccactttaggtgatcacttagtgtcagtgtagttgtaaatgctgatgtaagtatggcccataaatttgtgtgagaggaggcttttataagattgtcatctagatcataattaatttttaaatattttcattacaaactcatgaaatttagagattgttaaagacatatcatcatcg

SEQ ID NO: 217046 - DNA, 387 bp, Homo sapiens
  misc_feature (31)..(31): n is a, c, g, or t
acatggtctgtccctgtgagccagtggaacnaatctaaccagtggcttgactgcagacaagggccattgataacgcagcctggatggggttgctcagcctgaccagcgccaccgccgcccagcccacatgggacgtgggttgctgcttccagctcttgttccggatttcttttcttttcttttttttttttttaagacaaagtcttgctatgttggccaggctggtcttgaactccaagtctcaagtggtcctcctgcctcagcctctgaaagtgcggagatacaggtgtgagtcaccacatccggccccacagccccgtttctggagtggcagtgcaggattctcgtctacctcataaccatgggggttaagaaggtggggaggag

SEQ ID NO: 217047 - DNA, 408 bp, Homo sapiens
accctccttattgtctctccaatgccagtttcacttcacccattttaggtagtttgatccctatggacattggagttcacactctgctgtagtcagatgtatgtgattctacctaatgaagatgattacactgatgaatcatatgatttggctcaagtgtcaaaatcccagacattttcctgtctctggatggcaaactccacaggctgggttacagagtgattgcaggatgggcttgtagcttcagaccttgaacaagaagctaagaaggactgaggtcatagcatgtgtaccgccacccttaaaacagaatatttcactagccaagacaggattatgtaaattatattgtgtgttagtccattcttacactgctaataaagacatacccaaggatgggtaatgtat

SEQ ID NO: 217048 - DNA, 261 bp, Homo sapiens
tttctaaagaataaatagaaaaagacaactcgtgtggataaaataagtagagaagttgcctcaaaaatcacaagtagcctggttgtgtccaaacgtatgaaaataatatctaatgtaaaaagaaaagaaaaatctttcctgtttagctgtgcagtcccttgccctattcctgtagagccttgtaagattccttgctttctctcccgttctacatccagtttccaagtcttacatctttcctctgtctctttcttggtccat

SEQ ID NO: 217049 - DNA, 333 bp, Homo sapiens
gcggtggccgtgatctcgctcactgcaacctctgcctcccaggttcaggcaattctcctgtctcagcctccctagtagctgggactacaggcatgcaccaccacacctggctaattgtatttttggtagagacaggatttcgccatgttggccatgctggtctgagctttcatttttaaaacacttatctctgacccatcttatttcccttactttatttttatgtcaacttcttcagggattaattagtattattttatactattttttttcagacatggtctcgctctgtcactcaggctagggtgcggtggcaccatcatggctcactgc

SEQ ID NO: 217050 - DNA, 565 bp, Homo sapiens
attagtgaagcaaataataaaattgttgtgtactaccatttgacctacatgttgtgatattaactggaacttctggctttacaagacaaattaaatatgagataataagcattttctgtagacagaggttccaaaccccaagcttataggagcggggtttgtagtctcttttgtatccctagcacttgaaaccgtgcctggtttatagttagcacttgttaagttaatcactttaaatgtttgaataagtgactattttgcttttttttagagacagggtcttgttctgtcgcccaggctagagtgcagtggggccatcatagctcactgtagcctcctgggttcaagcaatcatcctgccttagcctctcaagtagctgggactacaggtgcatgccagcacagccagctaatgaatgaatgactttttaagaagaaaattctgtttttgagggggaagatcatgagcaaataccatttttgaattccacattaaaaagtcaggacatttccattttgcagttaaaaaaaatcttctggagatggatggtagtagggatggttg

SEQ ID NO: 217051 - DNA, 447 bp, Homo sapiens
gtcagaggattttactatgttggaactgaatttattaacatagttatagaaagagtctgtcaatgaaaggagaattagttgcctatggaaactgagctacagatgaatctttaaggcataaatctcttttccacctaagtggaagtccaattcctgaggcaggaagtctgggcaagtgaaattgccagttaagttggtaagccttcctacaataaaaataaatgcatgtgcacatttatattagcttgatggtgttaaatattctaatcattgaactttatttttctgatctaatacatacccagctatcatgtgactacattttgttttcccatacagatgtgcgtttgggtggaaagtatgtactgtttatgctgaagtaagaattttattttatataacatagttcttgttataaattaataaactaacattctgattgtttat

SEQ ID NO: 217052 - DNA, 225 bp, Homo sapiens
gtctcaaaaaaaaaaaaaaaaaaaatagcatagatctctagagctattccatctgtcataccagttcctattatgttttcctaacaatcgccttgttactctataaaagttagctaaggttttatttcttctgtgaaacctttttaaagagctccccctcaatttctccaaaacgtagagctaaatagcctcacttctcttcactcccttcatataatgtattta

SEQ ID NO: 217053 - DNA, 392 bp, Homo sapiens
aacaatctattactgacactttacctaatcattagcattactgttgaaaatatttaattttgaaaagataaggaaaaagtgctagattcaagttatcttgattttcataaagaattctcccaaaatatacctcgcttgaaataaagttaagtggcacactgtaactcgaataattaagaatacatcctttgcttaaatacttcaaacaatatactgcaaagcatggttcaatttttggttccaataatattttgaaatattgggattgcagatgccacactggtttcccaaacaatggtttcataatgatatgtaatttacattgcctggattttagaaaagaaacctgtgaaaaaaaataatttaaagtaataaaattcattaatttaaat

SEQ ID NO: 217054 - DNA, 490 bp, Homo sapiens
gagtaacttgcagttatagcttgcaaacatctatgactcagagcacctcctcattgccgtctattggtaagtctcaaagaaggtagatcaattttagatatgatttgatcaaagtataatcaggataatggctctggagaagtgaaacataagcactccttaaacaaatataaatgtttattatttgtgcagttgtcagacaatttagcataaatgagacttttcctaataactctcaactttagttattcctttcctttctttaacttcataatgcaaatatggcccaagactacttagtggagtcacaaattgctctgtagccattgcatgtttacaggaacatgttaaatttctaagtgtacatatcacctataatatgtaaatatagttagcaacagggtcacttagcttacaaataaatgccttataggcgagttggaaggaagaaagattatttttctaccttgtggaggaaggttccttggtt

SEQ ID NO: 217055 - DNA, 839 bp, Homo sapiens
tggttagcgtccgctttaattcctttgtctcagtttcctcccctataactttgaggtatttgattctgccaggtgcccagggctactatcatcctagattcactttaaattttctattggaggtagctgaggtcacaaaaattaagagccaaaatccaaataaatgctgtcttattatggctaagaaatctccaagtacacatctcctctgccttcaaccctgttccaccaaggactcatgatcagaggtttgtatcttcatagtctcttgctctgcttttttatcagattcacccactgaaggtatgatatttgagaactgtggaagtgtttccaatctgagtttccactctgctcagttcctaggactttttacactctcctcttcctgggagactatcaatagcccatctctatgccctctgatatttgaaactcaccagctcagctattgattaagactattttttttaattgtgacatatttgtgtatacatagacacacacacacacacacacacatacgtgaagttattttttgtattgccccaaaacttcttggtgtgtgctatacaaggagagtttttattctgaacagctaagcttctattgtcaaaaatggaagctttttgcctctgtgccctgctatcttcttactcttatctgctgcgctgtaggaaatgattgattgaaattaatataactgtatctaagtattaatttatagattagaatcttatactttcttcattataattttcacattgtcttttgttttctaacaagttataacttttttgtaatattttctttaaaaataaaacatgactacatgaaaa

SEQ ID NO: 217056 - DNA, 292 bp, Homo sapiens
tcaaaagcattgtgtagtagactgaaaaagagtcatcaaagacatccatagcctaatcttcagaaaccatgaatatgttaccttaaatgacaaaagggactttgcaaatgtggattgaggaccctgagatgggaagcttatcttgcattatctggtgagtcttaaatgtaatcacaaatgtcattataagagagaggcaggggtgaatattagattttagaagtaggagatgtgaaaacagaagcaagagattagaggagttcaaggaaggggccctgagccaagaaatgca

SEQ ID NO: 217057 - DNA, 401 bp, Homo sapiens
ataaaaattttaaaaaagatccataggaaagtatagatcttggaaaagagaaagagctataagatctgtagaaagggcagagtacctcaggaaagggtggctgtcacattgagattcaggtcaggggttggggcgtggctggtttcaaaggtgacagaggcttcaggcttcaaggatttggggctctatcctgcaagcaacagtgagccaaggaagggttttgaacagggaaaggacagtacatgaacagagctgggaaccaaggctgagaggtaggcagcagagcaagaccttgaacccaggtcttgctggctccaaagcctgtccatgaccttagactgcagccattaacaatgagggtatggggccaggtgtggtgtctcatgcctgtaatcccagca

SEQ ID NO: 217058 - DNA, 537 bp, Homo sapiens
gataggagcttctctttgttttggatgtaataggtccattgcgcctggggccattacaatttttgttgccttacaatttcttaaaaacatttactaagtaccaataaataaatggtaaacgcagttaagcacttctactttactggtatttcatttaatcctcacaattacctggagaggtaggactcaacatatttttacagataagaaactgagccccagagaactgttatgtaacctatgagttaaacttctgaaaagtaaacctgcatatgtatttaaatattgcttcaaaaagctaacctattagaccttataacatgtacctgacagtaggaaaccaacagaagaaaaggtgtcaagaaacagggcatgttctaacacaagggaggtgctctacagtcagggaacattcagattacctcaaggagcatctcagtttctccttccaccaagcaacccccaccagataaagaagagatactggattttttaaaatttaaaatatattatttcccatgtaaagagtcactggaa

SEQ ID NO: 217059 - DNA, 461 bp, Homo sapiens
aactgtattgaggtataattcatatataataaatcgcacatagttaagatatacactttggtgtgctttgaaatatggatatgactgtgaaaccatcaccacaatcaagacaatgaacatctccatcctcccccaaaatttccttgtggcccttggtaaattcctccctctagggcacccccttgcccacacccaggtaacagcttacctgctctatcactgtagattcgtttgcattttaaagcattttatataaatggaaccaaacagcatatactctgacttctttcactgaacataattattttgagtttcatccacatgtcgcatgtatcaatggttcattattttaattgcagagcagtatggatgtaccatacattgtttacacattcacctgttgatggaaatctgggtcggtctaggttgcagccattacaaataaacctgctgcaaacgtt

SEQ ID NO: 217060 - DNA, 668 bp, Homo sapiens
aacacttatggccgctgggaagttgggagagccaggctggggctccggcaggcccagggaaagttccctttctaggctctttattaaaaaatttaaaaggaggagttgaggcgccttgaattttccttcgcgagtttggagaccagccgatttttcatgaagcaagcaagggccgcggtcccggatcctgcaacatatacctcattttctccaggcctctccacttgcccgagctctcagccaccaggagacagacggaaggggcttctgggctgtgttgggagcgggcattgtcccctacccactcctgcacagtttcccaaagtccagcgacctccgaccctccttggggaaaaaaataccagtacccagacacctctgcaccctgttatatgactgggcttgcttcaggaatatcttacaaagaagaagaaggaggaggaacggcttggagtcatgtttacatctagttctactgatccgttcacatctggagagtttatttataactccctctataactctctgtttggaggcactggtggctctactgacagactgatgtctaggaaatattgctctatgtctaatggtacctaaatgtgctgtggttgtatttacagatttacgtttgagggaaatataattatttccattgtatttgtgca

SEQ ID NO: 217061 - DNA, 464 bp, Homo sapiens
aacacttatggccgctgggaagttgggagagccaggctggggctccggcaggcccagggaaagttccctttctaggctctttattaaaaaatttaaaaggaggagttgaggcgccttgaattttccttcgcgagtttggagaccagccgatttttcatgaagcaagcaagggccgcggtcccggatcctgcaacatatacctcattttctccaggtacagttttctggtcatttaattcgtttgttttcttgggggagatgggaatcacaggcgtagagatagtaagtttgctagagaggaagccaccccacagtttcgggtctaacgaaatccctcctttaaaaacatttgtacccccaataaaaataaaattaaagaggaatatagaaacacaaattagccaacttttttaaaacagaaaaaagaaaagaaaatcatcgtaacagatgagcgtgagaacttc

SEQ ID NO: 217062 - DNA, 600 bp, Homo sapiens
cagccctggatcagggcagccatctactaaatggccttaaaggctctatactctcgcctttgtaatcagagaaagtttccttaaaacaatcacttaggtcatttcccacaaacaataagttcctcttgccctcaatcaaaattctgcaacctggagaactgcttgaactcgggaggtggaggctgcggtaagccaagatcacgctgctgcactccagcctggacgacagagcaagactctgtctcaaacaaaaacaaaaaacaaaaaacacatcactatgtaccccatgaatatgtacaatgattatttgccaatcaaaattctgcatcctccagaagcatgctatccaaacttctttcatcatccctctccctctggaggaggactcctggctttccaagccgaaaatcacagggatagtcactactgtctaaggtatttatctgttctgtaattcaataaggaacagggctgacaggaaaggaaagaaaaatcctgttcacacctagaggaaaacatggacaaaaatcacaagtcaattgttgtctagaactgatgattccctctgtgacttacatagatctctttcccctgaacttt

SEQ ID NO: 217063 - DNA, 394 bp, Homo sapiens
tgagtagttccattccaattacagacacaccttgaactccaccttccgtaagtcacctgctttttcttcttcaacccaccaaactcacataatctatgctcacagtgtcttcttcctcacctttaattggcaacctaatctaatctgcttttccctcaacctagtcttaaaaatgtcctgtcaaaatgctgttaattgctaagcccagtcatatcttttcatgtttcatgttagttgatctcctagtagcattggataaaatctctttcttctttctagaaaatcctcctaatgtagatgacaggttggtgggtgcagcaaacccccatggcacgtgtatacctatgtaataaacctgcccattctgcacatgtaccccagaactgaaagtata

SEQ ID NO: 217064 - DNA, 241 bp, Homo sapiens
aatcccagaatgatgactgtactcccagaaagaagagaaaatcatacattttttggaaaatcggaatgctattaaataatgttcagtaaataagaaaaagtttttgaaaattaaaaatatgaaagttgaaataaaaattcagtgggagggctgggagataaaatgaaattttcccaaaaataaaacagaaagattaagaaatggcaaattagaaaagtaagaataaagagaataagttcat

SEQ ID NO: 217065 - DNA, 671 bp, Homo sapiens
aatttcatagagtactgtgtgtaatgagcctgggggcaagtagacgactttgacgcccttggtgttaactcgtggggctctgagtgcctgcagcattgaagaactttaaaaaggtgtaccttactggcaaggtacatcctgacttcaaggacaaggcatcaatggaattaatccagaaaaagcgttcttgtccagacgttgtacaaccaaaagatcagcagctgtgtttatcttttcccgttaagtctcaggtgttagcagttttataggtaagagctcgcctgatcataaacacagctgcacctgcacaaaacaggacagttagcttagccctgcgtgccttcaatcctggggctcacttcccttctttacttaatagatgtcctttgtggttccctcccatgcccccagattagggcagttttgtctgcattaaaaacctgttgacacaggtatcccatctcctccatgattttctttatggcatctgggaacttgtctgctgcctcttggttggcggaagctgcttctcctgttatcttgacatttttaaaagccaaacctcttcctaaaattatcaaaccatcatttgctggcattaaactctccagctttagatctttcaccatcctttggcttcaagttgtcatataatgactttgctttttcta

SEQ ID NO: 217066 - DNA, 1008 bp, Homo sapiens
atttgacacaattgatcatcttctctttattgaaacattctttgtcttgacattttaacctcaacttttttttatacatttttgacccactcagtacttcacctcctttgctagttctttctactctacctagaatttaactatcggatttctttaattgctcagtcctcttcccttttcttttccattataagtttctgctatatcagaagtcatatttcctttttgttcctaaaattgtttcttgtgccttttctccatcaccaaaggaaaaactatttattgcaataaattaatacagcaggtattcctgtgaaagcgcaagttagtttgttagggcaattaaaacttctacgacatatgctccggcagagttccgtctctgccactggcagcttaagatctgccttcttgagagtggtttttgccagttccttttcccactcagttgccttttgctttctggaccacctgtttccagtcgtgggtgtggtcatttttgggtggaactgtggctctcccctcctcagctccagtcatgggtgtggtgatatttgggtggaactgtggctctccctcctcagctccagagctcctgtgcactgtcatttttctgctgctgcttgggtggctgctgggttcagtcaccagctttagcttcaccccttcattcatattttaatttttttcttgaacagacttataagagtttgtcaattaaaatttttttcaaagagtcagctagtatctgctttctgttttgtgaatgtcatctttatttcctttctttaggtttactctgttctttttctagcttactgaattgaaaacgtgttcatcctttcttgctttttaatggtggctcaaggctgtaacattccctctaagtgttgtttgaggagcttcttgtatgttagctgtgtgggtataatcattgtggtattaaataatagtcttcagcatgtcaagacctaattttttgtttctttttcttttcttttctttttt

SEQ ID NO: 217067 - DNA, 402 bp, Homo sapiens
acagaggaggtatctagccctccctgcagaaaagatactgaggactgttgattgagggctccagttccctagtcatcttgagaacatcaaaatttttcaaattagctcaggttaattgtccagctgggtgcagtggctcacacctgcaatcccagcactttgagaggccgaggaaggctgatctcttgcgcccgggagtttgagaccagcttgggcaacgtagtgagaacccttctctacaaaaaataaaaataaattagccaggcatggtggtgtgcacctgtagtcccagctactcaggacactgatgcaggaggacctcttgagcccagaagatcaaggcaacatgagccgagatcacaccattgcactccagtctggctgacagagtgagaccatcac

SEQ ID NO: 217068 - DNA, 303 bp, Homo sapiens
taggaagcctcaggagagctgagaacctgctttggttttggttttgttttgatttgtcccttttgagagaaaggtctggctgtgttgcccaggctggagtgcagtagtatagtcacagctcactgcaacctggaactcctggtctccagccatcctcctgcctgagcttcctgagtgagttgctgggactacaggcatgagccccactgtgcccaacttattctatttttggtaggaactgggtcttgctatgttccccaagctggcctcgaacccctggcctcacgtgatctctctccttgg

SEQ ID NO: 217069 - DNA, 540 bp, Homo sapiens
tttcttcaaaatttcaggaccaatttgaaaaaaaaaatgttactttatcagttagccacctttacatttttgaaaaattcatttatatctctcctgtttagaaatcaattttaaacataaatcaattttaaaatgaaatggaatacattttaaaatgtatataacataaaataaaacaacatttatctttctgtatgaaatataagagaatttgttcatttaacttttcacattttatcttccttcattttttctctgttttagttggtatggcaagacatttttgacaatatttatatagttttaaatagttttacaggtgataattttagtaatgttcattagtaaattcattctaaatatattcaccatttaataagtatatatactgaagtttttaaaatttgcattattttgataaccttttaaaacattgctaaagataaaaattttaaagtactttctaatcatatttatttttttaacccagaatgtttacaagattgttttttgcactgttgattcaatttgcatttcatt

SEQ ID NO: 217070 - DNA, 188 bp, Homo sapiens
ttacaggtgctgaaatgtagaggttgctaggagataaagtgtcaggaatagattcttgaggaacacctacattggtggagaggccaggagcagtggctcaaacttgtaatcccaacaccttggaggccaaggtgggtggatcgctggagcccaggggttccagaccagcctgagcaacatggtgaaaa

SEQ ID NO: 217071 - DNA, 409 bp, Homo sapiens
tacaaaaaaaaaaaaaaaaaaaaaagttgattccaccaagaattatcaatggatgctaaaactagtgagttgaaaggttgacaaagtatgtaacatttatatagtctcaaaagtatcctcccatgaattacttattaattgcaaacggaagaatggttaagtttacagtgagtttatttagcagataccatagtgaccaaagtaaccaactttgcaattagagttatgttaccatagtggagcagacacctcctgacatcatgttttgagaaagacattatttctggctgggcatggtggctcatgcttgtaatcccagtgcagcattttgggggctgaagcaggaggattccttgagaccagtagttggagaccagcctgggcaatgtagtgacaccccatctttaca

SEQ ID NO: 217072 - DNA, 406 bp, Homo sapiens
caatttgggtaaatgcgtccaagaggaagaaataaaaatgaaaagactgacagtttaaaagcatgtggagggcttagaagataaagacgagtgcaagaaagggagagcgcggccggccgcggtgtctcacgcctgtcatcctagcactttgggaggccgaagagatcggatcacttgaggtccggagttcaaatccagcctggccaacatggtgaaaccccgtctctactaaaaatacaaaaaaattagccggacctggtggcgggcgtctgtaatgccagctactcgggaggctgaggcgggagaatcgcttgaacccgggaggcggaggttgcagtgagccgagatcgcgccactgcattccagcctgggcaacagactgagaccctgcctcaaaagaaaaaaa

SEQ ID NO: 217073 - DNA, 473 bp, Homo sapiens
aagttatatgaaatatctagtcttttcagctatttagaagtgcttgatgtatttaaaagcagaagtagttgaataacactttgtaaatagcttttaaagactgatgggaaatactgtatttggaagtggaattgttaaaccacctctctgaacagtgtgctctctacttgttcgttgagttgagggaggtaggaggaaagaaactgcaaaaggtgttttgctagtgtgtactagaaaatttcagcttatccattgccttatatgttatgtgcttttcatttaactttgctatactgcgcatattgtgtatatactggacaaatgagttgttgagtgtatattttataatatacagtctctatatattaaattttataatatctagtcaattttgtaacatctagtctctagatattaaagagattgccagtgtatgacaaaagtagtgttaataaactaacccattttgtaca

SEQ ID NO: 217074 - DNA, 234 bp, Homo sapiens
gcttttacagtttcacatgtgtacataggttccctcccagtcccttccatacccattagttattgaactttctaattctattgaaacattacaacagtgttttgttgcaccaattttataaacttatgccgtgcaatacgtgttatttttctgaggcagaccaaaggtaaatttctcaaggttcttgctgccttctttagcagtatttgagggaggatcttttatacatttgta

SEQ ID NO: 217075 - DNA, 363 bp, Homo sapiens
tgcagtggctcatgcctgtaatcccagcagtttgggaggccaaggcgggcagatcacgagttcaagagtttgagaccagcctggccaacatggtgaaaccccatccctactaaaattacaaaaactagctgggcgtggtggtgggctcctgtaatcccagctactcgggtggctgaggcaggagaatcgcttgaacccaggaggtggaggttgcagtgagccgagattgcaccactgcactccagcctgggcaacagagcaagagcaagactctatctcaaaaaaaagatgacagattctagaacctctcctgggccttctggaatcagaatttccagtctacattcttgtgagagctccctt

SEQ ID NO: 217076 - DNA, 407 bp, Homo sapiens
ggctgggtgcggtggttcacgcctataatcccagcactttgggaggccgaggtgggcagatcacctgaggttgggagttccgagaccagcctggtcaacatggtgaaaccctgtctctactaaaaatacaaaaattagccgggtgtggtggcacatgcctataatcaaagctactcaagagactgtggcaggagaatcgcttaaacctgggaggtggaggttgcagtgagccaagaccgcaccattgcactccagcctgggcgacagagcaaaactccgtctcaaaaaaaaaaaaaaaaaaaaaagggagatataatgctagttctacacaatctcttccatgatatagaatgtcatagaaactttccacctcattttatgaggctaactgtattctgatattaaaa

SEQ ID NO: 217077 - DNA, 543 bp, Homo sapiens
ggagcacagtgtggctttgcagaggggagaaaagggcaggaagcagcactgaaggaccctttccctgggaacaggcacttccacccatctgctccccgaggtctctgaacatccctcaggggctcagtggactggtgtgaactcaactctctgtattttcttgtggtagccttgaggtctcatgccttttgaactcgtgggaggcagtatgaagttggaaaagcatttttttttttttaaatgagatcaactcagtttgaatgctggctcagcctcttagatgtaagatcttggactagctacttaacccgtgtaggcctcaatttccttgtctggaatgttgggatatctcctaagacagttacagagactaattagtaataaacaacaatacttttagtgtttttgatctatagaggattctcagtaaatgttaatcctcttcccctgggaccatgttttagacctggcacctgtggaatttgtatgattttgtaattaatggctaccccacctaagatggcaccagcaatatgcctaatg

SEQ ID NO: 217078 - DNA, 358 bp, Homo sapiens
tttgacggctgtctgaaaggtgcttagggttcactgggccactgagaggcagggaggcccaggtggagggagagcatgggcaaaggccctgaggtgggaggtcacaggtcggccggctgaagcggctgctggacagagagctggggagtgccagggctggaggactcagctggccagaccatgaaagctgcataaaacaccgtaaggagtttatcctaagaagcttcagcccttacagggtggtgagcagatcctcacgaactcttgatgcgaagggaagagcggacccattccgggtctcgggcagtgtctgagcaaggggccggtggtctgcgcatctgcacactaggcccttcct

SEQ ID NO: 217079 - DNA, 442 bp, Homo sapiens
tgcgtactcgtagcttagctcccacttttaagtgaaaacgtatggtttttggttttccactcctgagttacttcacttagaatatggcctccagtgccatttatgttgctgtagaacacattattttgtccctttttagtggctgagtagtattccattgtgtgtgtatgtgtatatatatatatatacacatatgtgtatgtatactatatatgtatagatatatgtatgtatgtatatgtgtgtatatatatatatataaaacatgttctgtatccactcattagttgatgggcacttagattggttgcacaatatattatgatactctttaatatattttatttaacatttgtattgttttaaagtacttaaatgccttttaatttttgtcgatgtaatagtttaataccagtaaaataaatttcattattttacatga

SEQ ID NO: 217080 - DNA, 566 bp, Homo sapiens
ctttatacaacagtttcgaagcttgaaagtaagaaaatctttttaggaaacattcgctaataaactgtatgatcttagcagagaatgttatggcttcagtacctaacagattttttgaagtcttagagccactcacatcaggtaaatacccattttacatccagcatttccccttgatgggtctttatcccatatttatatgtttgctctagattttcttccttttctagattgtatctagaaattctctttactcttcaggagaatatatccaaccacatatccaactggtataaatatatcaaaagaatataatattaaaacatatttttatagtaaattttgaaaacttgtggatacccattttaacttatcagccgagatgtaaccccgaaagaaatgttctgcagaattttatctgaaagactctagggaagctatgtatgtctaacaagtatcaaacactaatcagaaactttaaacatcagattttcactttagtatcttttaagtaaatactaggaaaaattttttaaagcttttcacaggataagcataaactgtta

SEQ ID NO: 217081 - DNA, 716 bp, Homo sapiens
aggcagaggttgcagtgagcaaagattgtgccactgcactgcaggctgggtgacagagtaagactctgtctcaaaaaaaaaacgaaacaaaacaaaacaaaaaaacaggacaataatgctgacagcaatgagtagctgtgtaactgggtttctcaactgtctttccactctgcaatgatgaagactgttatttgatgtgtgatatctctgatgacagttctccttttaaattcatcatctgtatttaggacttaagatgagtttctcttcagcatggtggataaaaagaaggatccagacacacgagtcagatcacttggatgaacctgtcatttaaatggctgcctgaccctaggtccacctaggtctcagctttctcagttttaagggcccggcactcacgcctataagcccagcactttgggaagctgaggtgggtgcatcacttgaggccaggagtttgagaccagcatggccaacatggtgaaacccgtctctactaaaaatacaaaaattagccaggcttggtggtgcatgcctataatcccagctacttgggaggctgaagcagaagaatcgcttgaaccgggaggcggaggttgcagtgagctgagattgtgccattgcactccggcctgggcaacggagcaagactctgtctctaaaaaataaataaataaataaataaataaataaataaataaaataaaataaaa

SEQ ID NO: 217082 - DNA, 427 bp, Homo sapiens
cttcaggataaggtccaaactttaagcatgaactggctgctgccttcctttccagattagtctccagcctgtgtcccctaatatcccatatcctcaccagtccaaattacctgccgtgtgaattcacacctccatatatctgttagttcttttgtctctctttctcctttcttcacctgacaaactgttgagccttggagatccagttcaggcaggatgtcctctgatcttcccaaggtgaatgcctcttgagtacttcacctgttttcatttgacacctaaccttgattgatttttctttcatctcctccgctacactgtaggcaacctgatcgcaagggctgtgtctcagccatctttgtgtcttcgttcttagtcttcaatagaattttacttaataaataaatacttaacatatggactgata

SEQ ID NO: 217083 - DNA, 385 bp, Homo sapiens
gatcctcccaccttggcctcccaaagcaatgagagtacaggcgtgagccactgcctccagcctcagcacctctctttttagccccctattttcttagggacttggtggttttcatttggtgcccaaaatagagcctgggttcttgagccagacccacactggaatcctggctctgttatttcctaagtgatcttcggcaaatcactgagccttccaggtccagagtttctggaccgttgagtgtacagtgagcaaaataaccctgccttggccaggcgcggtggctcacgcttgtaatcccagccctttgggagaccaaggtgggtggatcacttgaggccaggagtttgagaccagccaggccaacgtggtgaaaccccatctt

SEQ ID NO: 217084 - DNA, 737 bp, Homo sapiens
ttaccaacagcccccctacacccactcagggtgccttctgcccttcacaattctccactctactccagccaaagggcttttcacaaatcgacacatgaccatgttactatccccaactcctctggggtttgtattcacttatctagggagagacaccaaatcccaaatctataaagcctctagcccaagggtatccaatcttttggcttccttgggccacacataaaatacattaacactaacaatagctgatgagcttaaaacaaaaacaaaaaacaaaaccctcagtattttaagaaagtttacaaatttgtgttgggccacattcaaagccattctaggctgcaggttggacaagcctgctctagcctcattttccatgcccaccaacaaccgaccccaatcttcactctgcccttttggccactctggccctttctcaggtcttcacctgagagccttactcttaacccattacacatgcccatttatctttttctgataaactcatctctcagatgctattcttgttatgctgaacacctctctcaggtaccttcttagattatttttattatttttatttttcatttttattttttgagacagagtctcattcagtcacccagactggactgcagtggtgccatctgggctcactgcaacctctgcctcctgggttcaagcgattctcctgcctcagcctactgagtagctgggattacaggcacctgcaa

SEQ ID NO: 217085 - DNA, 847 bp, Homo sapiens
aataaaacatttggcttcagccagcttgagttttctcagaaaactatgagatcagagaaatcttgcttttgtgaaatttccaaccaatctgcctctggttggggacacatggaggaagtattcgaaaactgatagatagaaattaaaccatccatttttcaagcccttcttgtcaccactctatgtctggtgtccagcagagtgtctgaaacactattgcattatttggtttttcaatccactcttggaggatctgaatgtaagaaaatggaaccacctgagttgattagccccttcgtttcatttgacaaagtagtgtccagtaagaactacaagaacagagtaatcaagtaagagttaccccagattatggagtattcagcaatctgacttggatacatcaataagaagttattggtccctaaaatggctgttgacagggaggctgtgtagagggcatctctgagcacaccctgtacatttctgaaagaaatccagaaatgagaagccatgcgacaaaggggggagtagacgacctttgcccacaaaggacacagctgcaggtctaggctccagcactttctgtctttggtgatttgggacaccttctgtaacctgtctaaatttcagatacctcctatgtaacatggtgagaatagtaaaaggtccccaagaggcttctgagagatcagatgagacaaggcatgagaaagcactttgtaaattgctgaagtgccacagaaatgttattaaatttactgtttctgtaaaacatgacttggcagtccttgaaaaaacactgcaccatattctgttctaaataaatgcagatagaaaattgggaccc

SEQ ID NO: 217086 - DNA, 204 bp, Homo sapiens
gggcaacatagtgatactttgtctctacaaaagtttttttttttaaattagccaggtgtgttggcccaagcctgtggtcccagctatttgggagtctgaggtgggaggatcgcttgaacccgggagctggaggttgcagtgagcttagatggtaccactgcactccagtctgggcaacagagcgagaccctgtctcaaagaaag

SEQ ID NO: 217087 - DNA, 278 bp, Homo sapiens
atcatccaggctggaaggcagtggcacaattatagctcactgcaaccttgacctcctgagtgctatagttaactggactcattcaagtcttccaataatactgtaccatattcctcccttgcccacaatctcctcgctttgcctctcaacaaaaaaacacaccaaagaatatatgcaaaagtaaacctcaaatgacacagaaaataaatcctatatcaagaaacctaaacctctggctttctttccagaaattgtttttatgtgagaaatagctaaga

SEQ ID NO: 217088 - DNA, 308 bp, Homo sapiens
ttccccagctccctctcagccaatgacatcacctcatggttcgttcagaagatagcagctttcagagatgaaagcccacactccccacctcaatgctgcaaaaccgctccatactgctgatgcggaccaatgcagggcgtgtcctaaccccacggccaagccctccatgtgccctctgcacctgctccatgccacgtctccacatctcttcaggttgcctttctaggtgctcctcccccttctccatgttgttctgcaccccaggaaactcacttgctggctccaccccccggggctcatgccctctg

SEQ ID NO: 217089 - DNA, 405 bp, Homo sapiens
atgaatggacgagccagatgccaatttataaatttcctactgcacaccttgaatgtgaaaggtactcccagagtaatttctctcgtgttctggttaccttttattgtcagggcgcctggggacggccttaggtgtcttaggacatttgacgagttccactttgatgggagatgtttaatctgggcctccacatggagatttctctccaccttgttagtgtctagaagacttccacctccaatagcaggattatgatcttttgaaaagcctgtgtaaatttgagtcttttcttttataactccttatcagtcaccgacagcttttcccataattgctattataattggatcacacatttgttatgtttttggatgaaatacactatacccctgccgaccctcacaa

SEQ ID NO: 217090 - DNA, 514 bp, Homo sapiens
agttgtgtgagctccgggaaagaggggaactctgtggcggtagccatagtgtctgtgtggcttctgcagaagatggagctgctgcagaacattaagagacaggcagagaggaggagcaagaaaatataagcttgggagagctacatggataaagcaatggtgcaagaacaaccagggcagtacacggagaaataaggagacctgtcaatggggacagaaggctgagtgacatcagagcaagtgaaacacgtagagccacagttctgatcttctcacgtaggcattgggatataccaaagccttcatgaagagggatagcatgaacgaaagcaagcattaggaatctggctgtgatagggaatttcttgtcatggtaccagcacacaggcaaataagaccacaacagctgaaatatattaagcattttaaaataaaccaaacactgtgataagagcttgacatgactcatctactctccactatgaccttggtagctagatgttactttcattga

SEQ ID NO: 217091 - DNA, 362 bp, Homo sapiens
gcatgacaaaaagtattgttctattgatttaaaggaaactgtccttgacattttcgtgtctcactgtggggcaggggaggatggacccactggcagagactggactgagaaaagttgcacaatttaaggtgtcgctatgctagcaaactcagtcatcaggctaactctcaggaggatttgcagtggaagcaaagccagcatcccctctccatttattctgttatctaggagacacttcataatgccaaacaggggccagggttgtaggatctcttccctaccagtgatccatgtaatactttttttctccaaaaattctatcctttgaaataacttatccaataaatatgctgcatatacta

SEQ ID NO: 217092 - DNA, 525 bp, Homo sapiens
actcagtgattctgataactgtggttagcttgggtatcatgtgtgtgtgtacatatgtgtgtgtgtgtgtgtgtgagagagagagagcgagagagagagattctctaactctgatttccaggattggctcctgtcacttggcacccttgctgactgcacctgtttgcaacattgggctacaggaggagtcctggaatggaagcctgatgaaaatgactgggtaattcttaggatgaaatagaagaagaaatgtaagacatttggagttggcaagcaggcaccctaccagttttgagatggggcaggtaggatttcaatggcatgttacataaccatcctctaaagggacagaatgtacatttcagtggcagaaaaagaaaagcactctgttctactatggttaattgttattaataatttaaatgttgctttatcatattacatatttctgcttacatccaatgacttacataaaaaaatccttagatcctagatttttggactaagtaatctttttttaaaaaa

SEQ ID NO: 217093 - DNA, 664 bp, Homo sapiens
actcagtgattctgataactgtggttagcttgggtatcatgtgtgtgtgtacatatgtgtgtgtgtgtgtgtgtgagagagagagagcgagagagagagattctctaactctgatttccaggattggctcctgtcacttggcacccttgctgactgcacctgtttgcaacattgggctacaggaggagtcctggaatggaagcctgatgaaaatgactgggtaattcttaggatgaaatagaagaagaaatgtaagacatttggagttggcaagcaggcaccctaccagttttgagatggggcagacactcagcagcacatttctgccttgaatcaattcccagtagagttagaagaccaaactactgcaggctgaaaagcacctgaatggtggacattgtgtcaagaaaggtggtgaaccctactctcggactgaggtggaggcaaggataagtgtgcattcttcagaaaaggctccagggatcatctggaagaagagaagttatgggtcatactttaccatctcaggcttgtggacattgctcatatttatgtaacaaagtctttatatcaatattagcttttctatgtaccaatttgtttctaatttaaaacaagcaagtatagaaacttattattgactagtcttggctactaaatatgt

SEQ ID NO: 217094 - DNA, 553 bp, Homo sapiens
tgaaaagtgaagctaagagatctagcattctgcagaaaagtactggagatgactcaggactgaaaatgatcatgaagcccctttgcaaatatcaaagtggtgatgaagcagtcatgaactttgaccagaagccgtgttttgtgggattgccactttaatcgctcctgttcatcattaggactgcagccagagtgtggaaggagggactccaaatatataagaagatgctaccacaccctgggagattggattccccactgcgctggctttctcaagctctgtgaaatgtgatgttggctggaacttatcatgaagagctttgctgtaaaacagatctggggtaaagtgggtcttaaaaatcctttctctatacatccatgtagatagagaccatctccattaacagaagagggaatgatgccattcttataaagaagctgtactgtgggcacatttattcctaagttgatagtagctattttaactatgaaaaggatctgcccagatgaaagaggggctgcctgtggagcacagctggatgggggaagcaagg

SEQ ID NO: 217095 - DNA, 639 bp, Homo sapiens
agtggagcccaggggttccaggccagcctgggcaacatagacctctctaaagtagtaaaatttatatgggaaggcaaattatgctgtaacaattctgtaatgggaagaaattggaggagtcactacctgatttggactcaatataaagatgcagtaacgtattagcaaaaggatagacatgtattgatggaacagaatagccgaaaaatagacccacacaaatatagttgatttttgacagtgcaaaggccattcaatgaagaaaatagagtcttcaataagtgatattgaatatgttgcaaaaaatctttcacccattccttgtgccttctataaaaactcaaaatggatcatacggccaggcacagtggctcaggcctgtaatcccaatactttgggaggctaaggcaggcagataacttgaggccaagagttcaagaccaacctggccaacatcacaaaacaccacctctactgaatatataaaaattagctgggcgtggtggtgcatgcctgtagtcccagctacttaggaggctaaggcacaagaattgcttgaacccgggagagggcggttgcaatgagccaagattgcgccactgcactccagcctgggtgacagagcaagaccctatctca

SEQ ID NO: 217096 - DNA, 525 bp, Homo sapiens
cttcagaaaaaaaaaaatgctttcaggattgcctcttcagacatggttacaatacatatactcagttttctttattaactggaccagattaatcttcattaaactgactgaactagtaatcttttaattttatgtcatcagacataaacatttgtcttttttttcgttttgcattagcttaaattggtttacctctcctgatagtctccctataccctttttctttgtcctttatactccaagtaaatcatataccatatgtgggatcaaatggggagtaaagtatcctccatcctcctgtcctcatttgctgtaaaccggtgtaaattcttacttgtgcatctacaatctgtattattgggtatgttcttaatgtaatctttgttcagctgatagtttatttcaaattatgaaatctgtttatatcattacttgtttttcctatgacatgtagtttttcacaatagcaaagagttgatgtgatttttgtagatatgctagaaaataaaaactttttaaataaca

SEQ ID NO: 217097 - DNA, 646 bp, Homo sapiens
atagaggactcacagacagggtccagatctgccttctttttgcaccaatttcttcatctataaactacaagtattctaaacatttcagaaagaggatgtaaaaagaaattatatgtagcttagacattgtaaaatattgagaaataagtaaataaaagcacaggcctaacaaaaacaaattaaggcatcatttttaaatcatctaaacaaatggaaataccaatcatgttctaggctgtgggaatttgttatgatccttccaaatgtggcaaatcctccaacaactgagagatatatagtcacaactgtggtgtattggaataggaataataaagttgatcagtggagcacagtagaaagtttagaagtagacactggtgtttatagaaacattgtaaataagttaatagacatgcttaaaaattctgggtatattaaatatttaaatttatttattcaactattctcttaactaatatttattgaagatctactgtggcttttctaggaaactacattaacaatgcttagctctgtatgatgggatttctgatgatttttgctttttttaaaatataggagaaattactaaaacacattctaagtataatttgtcccagaaattatgaatactattagtaatgac

SEQ ID NO: 217098 - DNA, 330 bp, Homo sapiens
ggagagaaaaaccaactcagtgtctacgaaccagcttaaacagaatggatgaccagctcagccaataggaaagaatgagctatggcaagcacacctgttttgtgcatttgcatggcatcaaatgcttaagaatagtttaaactggttatatatgccctttgcagtcctgtttaccttttccttttgttgaatgaatgaaaggctaagtgtttgaatgacagtgtactgtagccatagtattatacttggctttgaagtcctaatagatctatccatgattggtggtggaaacagaaaacagtgctagttctgaagatgtggagttgacta

SEQ ID NO: 217099 - DNA, 441 bp, Homo sapiens
gaaagaaaagaagggagggatttgtgacgaaaagggctttccagaaaagcagcgtttcagtgcagtgtttcccactgttccgagaaacaataactaaagtccttcccaaatctgtgactcctgtgatcaaaaaaaaaagattacaacccagatatgagttggttgtaattaatataatttgtttaagattaaagtgaattaattaattgctttctttttcatttttaaaccaacctacctactgttggctgaaatttagcagtcttcacatctaatttcagtggctctgtcctctactgagctttaaatctcaggtcaactcactgttgatggcatcacataggccaaggacaaaattcagagaggtcagatatgttcctttaaacatgtattccaaattatagagaagaatccctgatgtatcaaaaatggtaataactg

SEQ ID NO: 217100 - DNA, 428 bp, Homo sapiens
ctgatgggcttttgttacatcccatcctttgcataagggcgctggctttaaatatttaacttaaccactcagtactgaaacagttgttagtgagacctggccttggcctcccaaactgctgggattataggtgtgagccaccacacccagccttagtattaggtcttttggtattttttctttctgtagactatggaaaaattgcacaaaacatagcatttttttccgcttcatttttttttccctctaacatacatgggcaaaagtaatttgaatgcaagtgctcattactaatctgttgaacagtcttcagatgaaagcactggatgaccattgtgtataagccagtaaatctctataactattcatgtaaatataatgtgaacattgtttaggagaataaaaatcacataaattacagacttttt

SEQ ID NO: 217101 - DNA, 410 bp, Homo sapiens
agcatatgatatattgtattttaaatatacataaatatgcatatatatgtatgtcccctgaaaagacctagaaacagtatgaaaccagtagctatgagcatctctaacacacagagtgcgggcttgaattaatattttccactaaccagggcttcttggagaagagactgaaattggaaatgtacaagattagtctgaaatatcaaaccaggtaacaaagaagctaacaaagactgctagagtaaggtcaaaggactcaggagccaactggaagaggcttccattggccaaaaatgagaattttgagtttcagtaaaaataagaactataatagattaaaatccactaagtacgtttaaattgataagttcaagccatgggcagtgaagcatgcatgtaatcacagctac

SEQ ID NO: 217102 - DNA, 567 bp, Homo sapiens
atcttgtggaagtcagggagtagaggtggtctctctcccccaagtgaaggcagcagccaggacctaccgtcagagaccagcaaggagcagagaaaggtcaggctggtgcctcagaaagcatcagcatttctgcacaacttaattaaattactgaaaccttttctgagcttggagccatctttcttggagagtaatacaattgaaacagataatttaagccaaggaggaaggacagaattggtgagctcacatatgtagatggacatgtaatgacgtctgactaaaacacagaggaaaaaccttaaagtgaatcatgtttattcaatttccaaacaagtgcaaagacccaggcagcgtgcttcatgtttggactcttgaagaacacacatggaaaaaaaaaaagaaaaaaacctcttcccctctcaacccttttctaagtttttattaagaatatattaatttgagcattaatatgcaatgtatccatctttgtcagttattttccagaaaaatctagctcattttttgaggcaacttctagccaagttgtttcagttgtggagaatt

SEQ ID NO: 217103 - DNA, 466 bp, Homo sapiens
aattccagcatataagagtattttataatcatggaattgataaaaataaaataggttttgttgatcagaggctgatactcaaaaatgaggacattttaaggccataaaaatccccagttaaatgtcaacacctgcagacacaatggcatggctgccccaggctgttgacaaatagtgacaaacaggaactaagtgtcaaaagttctaaatatagagttagggatttctggatgtgagaaaaatgtatgggttaaggaagagtatggtaagtaccagttggatgagctactagaatcaagaaaattctacaagtatttgtaagtatttgtaagtttataagtgttgacagaagattccaccactaaaatgcctagcatgcctcaggcctgatcgtaccacatattctaacaaacacagattaggagacatcctgatgccttccaatttcataataaaactcaaggag

SEQ ID NO: 217104 - DNA, 431 bp, Homo sapiens
caggcttgtgaagccaggacccatgcattcaaagaccatgccaggtgcccccactgcacacctcatccccacataccagtgagggggagagaaatgctcctgcactgcctctgattaactgctttcctagaagtcacacatataaaagggatttaattctagtgggattgaatctcaatagtttccttattaggttgatttctgttaatagtttaagtactggatatacatgaattagaaaatctagattattagcaaatgcaaactataaagtattttataaatgttatcttgtttgtcaggggatgagtgagatattcattatacaaaaagtagtgtggattttgaggtagaaggtttactaaggatcataccgtagtatgaaatagccacaaacattcagtgaaaccaaacacccccgcttaacctca

SEQ ID NO: 217105 - DNA, 1552 bp, Homo sapiens
tgcctgtaatcccagcactttgagaggctgaggcagaaggattgcttgaaagccaggagtttgagaccagcttgggcagcaaagtgagaccttgtctctacaagaaaaatttaaaaaaaaaacaacaacaaaaactaggcaggtgtggtggtgaatacctgtcatctcagctacttgggaggctaaggcaggaggattgcttgagccaaggagtttgaggctacagtgagctgtgatcgggctactgtactccagcctgggtgactgagaccctggctcttaaaaaaaaaaaaaaaaggcttatgtatgtattttgttgatttttgactaaagtacaaaggtaattcaatggggaagtgatagtgttgtgtttttgagctagaagaactagcttctatctacatgggggcggagtaaagaacctcagcctttgcttcatacacaaaaagattaacctgaaatggaacataagttaaaaagctaaaaccataaaacttttaagagaaaacaggagaaaatctttttacccactcgaatgggtaaaatattggcaaggatgttgatagtaagaaaaataaatgtaaacatgccccgatttacggttttccttgtcaaacatacccatattttcatggctttgtggactttggtctctatcatttaagaatgtcatagaataaaattctttgaaataggaagggatattagagttcatctataataatgtttctcaaactgcttccttccagttttgttacctcaaagacttattttttctctctgacctctttcattatgtgtaaatgagtaaaatgggtatgatgccaaaagtttagtattgttacaggtattatatctggaaataaatgttttataaaactgtaaaaactctagtagttgggagctgtggcttatacctgtaatcccagagctttgagaggccaaggcaggaggattgcttgaggccaggactgagagatcagcctgggcaacatagtgagacccccatctctacaaaaaatttagaaaattagccagtcttagtggcatgggccaatagttctagctactccataggccgaggcaggaggatcctttaagctcaagggtaagcagctgtagtgagctttgattgtgccactgcactccagcctgggcgaccgtgagacttcatctcttttttttttttaaaagttctgtaattactactgacctcccaaggtgatatttcaaccgttgccttcacccttattccagaaatactaaaactttagaattatttttgaggcaatcatcttgattttcctctcctacaaggtaaatatttttaagtgtaaagttttggagcttatatttatgaatatttgcaaggcttttttcccctccgcctcctttcatgcaaacaattgaagtggctagcttttctcctctcctggaataaaggaagtgaattagcaattgaatatataacctaggacttctctaaattaggcacctgtgggtacccttagggtccatatgcttacaatatgagtttctatcaccattatta

SEQ ID NO: 217106 - DNA, 277 bp, Homo sapiens
cgacactcttcccatacttcttcccatcaactcctcccagatccttggagcttactcaatatcacttccttggggcagctgcctgctccaccttgtatggccccatgaggctgtgcaccccaactttacagcacttaccatagcaggtgtcagacatagctctgtgggttactgatgaacaccggcctccctctgtggattgtcatcaccatgagggtatagagcagcttgtccccagaactgagcagcagagggcagagcacatagtaggccctca

SEQ ID NO: 217107 - DNA, 324 bp, Homo sapiens
tgaaatttcatttccaccagttcattttcttcacatctaatattttatttttggctttctggcctagagctgatgggaattctgcagcgctatccattttcgaaagaaacagttttaaaaagtttccgtgactgagaagacacagctaagaatggtaagaggtatttccaggggttctgcctttagcagacagtaacctgcctctggtatgcatgtgtgtatgtgacaaacaaatgggaaaaatgagaaccttagttaagttgagggacaaagaagcccgagtttctcacagccagaccaaacaggagttggctagaggccctg

SEQ ID NO: 217108 - DNA, 433 bp, Homo sapiens
cttcctgggacaccatctctttcccctttcaatagctctcttttgcagtcgtatttctcaccctcttctaattcacgttaccctctctgggtgggacgttacccaccacctctctctaatgaccttccaatctctgtttctaggcctctttttctgaactccagagtcctgtttaccactgcctcttgagctccttcaagtccacatgtcccacagtggactcattgcctctgactctgctcggtcccagcaagggccctgaagccgctggacccatagcatggagcttgctgggtaccttgtacaggggggctctgggctactcactccctcactccccaggtagcatttggtccagtctctagatttttccagccatttatcttgcttttcttctgttttagctctgcccggccctgagatttggtgccca

SEQ ID NO: 217109 - DNA, 519 bp, Homo sapiens
cggtggctcacgtctgtaatcccagcactttgggaggctgagggaggcagatcatgaggtcaggagatggagaccatcctggctaacatggtgaaaccctgtctctactaaaaatacaaaaaaaaaaaaaaaattagccaggcacagtggcgggcgcctgtagtcccagctactcgggaggctgaggcaggagaatggcgtgaacctgggaggcagaactgcactccagcctgggcgacaagcaagacttcgtctcaaaaaaaaaaagtaaattataaaatttttctgtaaatatgcctgtcaagttacagaatttacattcctttgaagaatactgtatgaatgaaaatttgatagaggcactgagttttaacattatctattaaaaaattaatgtaactatattgcaatgttttatagtttttacaacatatttatgaattgattcatgtattatactttataacaggtgaaaaacactgttaacaaggacatctgccaataaatttaataataaaa

SEQ ID NO: 217110 - DNA, 261 bp, Homo sapiens
gggccgcaccagaggatcccagctggtccgataaagtctttgaaaagattgaatgtgagctacttccacagtttaatgtccttctaatccagtgatccacaaactaaacacgaaatgaaacaaaacaaaacaaaaaacagtgaccaggtctttcttcgaagaaagtctaatgtggatcttcaatataaaatactaataagtaaatagaacataaaaaatttggttattaacatcattatattttttaagtacttaaaaacc

SEQ ID NO: 217111 - DNA, 680 bp, Homo sapiens
agatatcatacaacagaataaatttataaagggataatgaatggaactggattaaagattttaaaataatttcagcgtgttcagaatattcattttgaacttttagccaaaataagtagtagtgtattttcaaaattcatttaatcgttcattagttgctacttagaataatgtatcctgtaagtttatagttaaatttaaataatcttttaattaactttcagtaaaagattaacaacatgatgactagaaaagctggaaataaaaattgagattttctttacttaaatatggaggttatttgcttatctaattttgaagagattttttgcatggtgggggatatgttggatgtgcgtgtatttctttggtttttatgaagaagaatttgaaacatacacaaaagcagacccggaaattctctccagtacctttattcatttcctttcttgaaatagtaggtctcatatttcatttgtaaatcctaatgttcttatatcagcaaaatatttaatgggtctgcttgaactccaatttcttcaatctaaattttatgctttttttaactagaatgctgtggatgcattaaaagttaaacatgtatctcttagctgggtgcagcggctcatgcctgtaatcccagcactttgggaggccaaggcaggaggattgcttgagct

SEQ ID NO: 217112 - DNA, 335 bp, Homo sapiens
aactagtgctcagaaaggctgaaatattgcccaaggcctgggtttcaggcccagctttagtccagttgagctctgtctgtggcaccctagaaacaggttaagcagccgggcatgctggctcacatctgtaatcccagcaccttgggaggccaaggtgggtggatcacttgagctcaggagttcaagaccagcctggccaacatggtgaaacgctcatctctactaaaaatacaataattagctgggcgtggtggcacacccctgtaatcccagctacttgggaggttgaggtgggaggatctcttgaacccaggaggcgaggctgctgaatctgt

SEQ ID NO: 217113 - DNA, 552 bp, Homo sapiens
gcttatctgatggtacattttctccgcgaggcacatcacagccttcttgtgcttaggaatagtagacagcacttcaacactatgccatttaggggcgattctgaacagcagaatcgccaataaacatcataaaaaagcaaaaactatggcactaaatgaaaaggacagtgtgagagcccaaacaagaaagcaaagcctcaccttgtttgatctcagctctgaacatgaatgtcaggcaactcaaatttttcaccattccatgtatgtctgtgaataatcctgaaaatgccacaagtattgattttagtgttaaaaataaattttattgaataggcaaatttgcaaatacaaaatccatgaatagtgaggattgagtataactagcaggctattggacacgaatctttcaccaattctcaagttcaagaataatgtcccttacagttttaaagagctttaaatcaacaataaatgcctcaatagggagatgacatatatgagttctacacataatcactggacaaaccaatatcccatccaaccaaaaatggg

SEQ ID NO: 217114 - DNA, 378 bp, Homo sapiens
attttatttgtgcctccaaaggtacccacaaatgcctttttcatgtcctcctttttcagatgtttcattgccaaattgccatttcttggcagtcaagaaaaatgtactgagctggtcacgatcctagttgtaataaacaaagcagtgttccttttctccaaggagcttacattctcaagtgacacatacatatataagtgagataatgcaaatactgagaaaaattatgaagatcaacaaaatactaacttagcaaaccaaattcagcaacatattaaaagaattatacaccaggaatgagtgaaatttattcctggaatgtatgaatggtttaacaactgaaagttaatgcgatacaccacattaatagaatgcagg

SEQ ID NO: 217115 - DNA, 432 bp, Homo sapiens
aatatacagaaagttttgtctatatacatatgtacaggcaataattttttacttttaggtcttcagtccatctagggtttttttttctttttctttcagtgtttagtataaaagagggatctgtatttttccaagtattttgctcatgctctttcagcatttcttgactaatatattattttcccactcaaaatcttagttttgttgtatagcacatcctattatatataggtctgtttgtgtactttcaattattttatgttcctaataccaaacttttattatttttactttaatattttccctcttcagtagtctgttagtgttttgaaatatttttggcagttatttctaccctgtttttaaaaaaattttatcagggttttcactataattgcattgcatttgtgtattaatatggggagaattgac

SEQ ID NO: 217116 - DNA, 309 bp, Homo sapiens
atgatttgtttttgttttattgaagttaaatatgcttattccagaaaacttggaaaatatagaaagatttcagaaaaatgtggcttataaaacattcagtcccacattgaggcaaccattcttatgattttgctccctttcttaaggtatatatttttataataggtggggtcatactaaatatagtgttatatcctatttgtttcatatattgttatttttttcccatgtcattaaaaattatctgaaaaccttttagaactgcaccatactccattgatgttccaccagtaaattgtgtctgtatta

SEQ ID NO: 217117 - DNA, 535 bp, Homo sapiens
actggacacacctcaccccccaacctgaacatgcacagacacttagagtggcctctggttgggcagaaccatctaacataatacatatcttataagaaaaagttgaacatctcatgtaaattattggacactcctgaaaatgaaaacacagaatagttgtatgggtacttggagcatggttttcctattaaatgcgtgtgtctttcaaaccatcataaagtcacaaaattgtaagtcaggggccatgtgtggcttatacattcggtcattccccttgtccttcatagttcctgtcagctgatgcttgtccacatcattttatcagcgcttgagagctgtgattttagggttcagtctctggttcttggagtaagaagctgatggattctgtgtagcttcactacagcctgcacagggtgggacagagaggtcatctttgagacctatgaggtcatgttttttgtttttttgaggcagagtctcactctgttgcccaggctggagtgcaccgctgtgaactcggctcactgcaacc

SEQ ID NO: 217118 - DNA, 365 bp, Homo sapiens
cagctgtcatgttagctaggcatcctatatactttttctcattttgcttcatgattcggagggtaaatgttacccatattttatagatgaggggattgatggtaaaactcaagagaggttaaataacttacctagctactaactaaaaataactaacctggaaaaccagatctgtctgcttaccgaaacctgcactgtttcctctttgtgacgctatagtttataatatttgattaagggactgttttcattttatttatttattgtttagacagagtcttgctctgtcgccaggctagagtgcagtgagccgagattgcgccacttcctgggtgacagagcgagactccgtctcaaaaaaaaac

SEQ ID NO: 217119 - DNA, 972 bp, Homo sapiens
gctaggatacgctctgaccacctgtgaccctgaactagaaaaattgggtgaataattatcttacttgtttttattaatctttcttaagtgtatgtgtagctcacattcatttcattgtttaatattagaagtgttttggtattagaagttcggtgatgtttttgtaactagaaatacactgtaggaacttaacacttgtttatgtcgattggaccatggtaaattgggttctgttctactttgtttcacttgaagttgcagcttccaaggacctattgatgatgttaagtgaggacttactgtacattataatcaaattgttgaaagcaaatgataaagagaaaatctgaaaagcagtcagagaaagagatatggtcattttgtgtgtagaggaagaaagataaagatgattatcttaatagatttatcagaaacgatataagcaagcaaactggggaagcatctttaaagtactgaaagatgaaaaatgtcaatctataattctgtatctgacaaaaatatgtttctaaaataaagatgagataaagatgtttacaacacagaagcagaaagaatttattgctaacatttcccctctggaagaaaatttaaaagcaattcttcagacagcaggaaaatgataccagatgcaaatatggagttacatgaaagaaagaacactagaaatggtaactacttgggtaaatacatgagattttttttcttatcagttaaatctccttaaaagataagtgactgcttaaagcaaaaatattaacaagctgttgtggggtttataacttatctaaaagtaaaatgcatgataacaatagctaaaaggcagggagggagaaatggaggtatactgttataagattcttttgctctgtgtgaggtgataatatcactggaagatagactgtggtaagttaaaaatgtatactgtaaactctagcccctaaaatagcaaaa

SEQ ID NO: 217120 - DNA, 450 bp, Homo sapiens
ctaaattcgcggccgcgtcgataaagatgtttacaacacagaagcagaaagaatttattgctaacatttcccctctggaagaaaatttaaaagcaattcttcagacagcaggaaaatgataccagatgcaaatatggagttacatgaaagaaagaacactagaaatggtaactacttgggtaaatacatgagattttttttcttatcagttaaatctccttaaaagataagtgactgcttaaagcaaaaatattaacaagctgttgtggggtttataacttatctaaaagtaaaatgcatgataacaatagctaaaaggcagggagggagaaatggaggtatactgttataagattcttttgctctgtgtgaggtgataatatcactggaagatagactgtggtaagttaaaaatgtatactgtaaactctagcccctaaaatagcaaaa

SEQ ID NO: 217121 - DNA, 584 bp, Homo sapiens
aggtaggaaattactgaatccttatcaagaccttgatgagaatgttgaaaaagtagtgatgaggaaaattgtgtttgaagtcatcccacatactttttatgagttaattataattagtaatacgtgcacgatatatacatctcttgaatattaaaatattttgaagtaggcagtcatatactcattaacagtgttccattgcattgtgtcacatggtcactttaactgaaatcttgttggagtgggaggaggaattcatcatggtggaatagaatcagatgttcaaataaagcaagttgattttggagctgtattagaaaattgaaaatgttacaaaagtgcagagtataaaataaatcagaactgccaacactgtaaccatttcaaagttacagggtgaggcagagattatctggattttcatttcctgtaagatgtaaaggatgaaacagggtcagagaaacaccctgggtttagtgcattggttgcaaaatgttcagaagttaattatgaatatttgctgcctttagtcatatgctcaaataccaacttgtattttaatcaccaataaataattagagtct

SEQ ID NO: 217122 - DNA, 422 bp, Homo sapiens
atatcatccaaaaccaaaggcaaaataaatttcaagaaatataaaagttgagagaattcatcaccaaaagaccctcactgcatgaaatgctacagaaagttatttacacaaaagaaaaatgatacctgacagaaatgtgaatctacacaaaaaaatacagaacactggaaatggtaaatatatgagtaaatatttaaaattatttcatcttgttatttaaatctctttaaaatagagttgattgttaaaacaaaaatgataacaatgtagtctggagtttataataagtataaaagtaaaatgtataaaaacaacagcataaaagctaggtgtgggaaaatggaagtactatgagtgttataaggttctcatactataaataaaatagtactatataacttaaaggtagattgtgataactc

SEQ ID NO: 217123 - DNA, 203 bp, Homo sapiens
acgcaatgttcttcaatcctgtttttttccatcttgatctgctaaattgcactccatctgttagtaatttcagtaaattataaagggattagtgaagcaatgctgttaaaacatgcccaacttttaaacatataaaacatataagtgatttgactagttttctctcctacgttttttttttttttttttttttttttttaaga

SEQ ID NO: 217124 - DNA, 434 bp, Homo sapiens
ctgggcctcaggaagggggctgggggttctagggctatggctggggctgaaagagcagccccggccctgagaggacccacagggacaccaaggctgggggctgcctgtgccacttagcactctcatccccacacctctgcagcttctcactgtgggaccctgggtttctgccctggggtttctctggcctttggagcacacttggccagaagtgccagaaagtttgaggatcagcctttaaccgatgacagctggagttggtgaccaactgctccagtttccttgccttttgggtgggacctccctgtggcaggttctgcgcagtctcccacgggttccccacaggactgacccacagtgatgacctgctcggcagccaccatggctttcttcttttccctggatcacctctgaaataaatgatttgtacttaa

SEQ ID NO: 217125 - DNA, 439 bp, Homo sapiens
caggtgatatttgtgtccttgaggatagaccagaggttttcagggactggtgcagtttgagaaatcccctggtatgcccccgacccaggagaggaggttggcttccgccactccttggaattcacttagaatttccctcttttccagcagttaaactgccatggaaggagctggccaccaccttctcaactatcccactctacctggagccctcccaggaaatactgggcaaagtggagacattactgtgaactccagaaaattccacgagtgtaatctcttcccacgtaacccatctcccttcccccaggatcccagcccaatgcaaggtgttcagaggcgtttctgaagcttgtcaatatgccaaaaggaataaaatatttcagtccctttcaagtgagtcaggttctgtgttagagaaggctccttagggcagcaa

SEQ ID NO: 217126 - DNA, 312 bp, Homo sapiens
acatggcaatcatggagctgtcacctatatcatgctttgttggagtatagcaacaatggttaaaagcatgaatttagagtcaagctatacaaatatttgtaaattttgacaagtaccaaaacacaaaaaagataaggaagcattggtttaatgaaatggaaatatcaaaaatatacatagttggtagaattttaaattagtaaaaccaatctggaagtccatttggttaaaagtattcaaaactccaaaaatatgcatgtaatttgcctcagaaattcaattatgaattgaatttattcaatttcttctgaa

SEQ ID NO: 217127 - DNA, 629 bp, Homo sapiens
gggtttcttggaagtggttgggccttgggcctgaggaatattattaaaaggagagatgcttactaagggcaagtttggacacaaaagtactttgaattctaaatgtggacattttttattttattttattttattttatttatttatttgagacagtctcgctctgttgcctaggctggagtgcatgagtggcacgacctcagctcactgcaccctccacctcccagtttcaagcgattctcttgtctcagcctcccaagtagctgagacaacaggcgcacgtcaccatgcctggctaatttttgtatttttagtagagacgggatttcactatgtttgccaggctggtcttgacctcctgacctcaaataatccacgtgcctcagcttcccaaagtgctgggattacagacgtaagccaccaaacccggccctaaatgtgtatattttaaaataggaaaccccctatgagataaccccctgatatagctgtttggaatttactaaaatgcctttagtgtcaacattgtcctggtttctggctccataggaagtggagactgttcctaatattcgtgctcttgactgcatacgtgccatcttgctttgctgacctgacaccctgtgtta

SEQ ID NO: 217128 - DNA, 123 bp, Homo sapiens
aaccagctacagctactcagaaggatggggcaggaagattgcttgagcccgggaaagcggagtggcagtgatccgtgactgagctactgcattccagtctgcatgacacagagagatccgaat

SEQ ID NO: 217129 - DNA, 225 bp, Homo sapiens
ggagatgaaatgcatggtaaataaaaactaaactagaagccgggcatggtggcgcatgcctttaatcccagcactcaggaggcagaggcaggtggatttctgagttcgaggccagcctggactacaaagtgagtcccaggacagccagggctatacagagaaaccctgtctcaaaaaaccaaaaaaaaaaaaaaaaaactaaactagaaaccaatttatgacacc

SEQ ID NO: 217130 - DNA, 517 bp, Homo sapiens
ggcttcccctggctgctcagtagggtcctttggaagctgctgaaaactgcaaatgcttagcccacccaggctccgtgtgacacagccaggagtgagctccacagctctgtgtggtggacatccagcctccctaccctgggaaagctgaaatgcaaagaaacacgtgttttagtagctaattattggcctttgagcttccaaaaccccacattccggcaatctgtagagctcttcaggccaggcgcattggctcatgcctgtaatcccagcactttgggaggctggggcgggaggatcacttgagcccaggagttcaagaccagcctgggcaacatagggagaccccgtctctacaaaaaataaaaaattagctgggtatggtggcttgtgcctgtcgtcccagctactcaggaggctgaggcgggaggatcgcttgaacccaggaagaggaagctgcagtgagccaacatcacgccactgcactccagtctgggtgacagagggagaccctgactca

SEQ ID NO: 217131 - DNA, 301 bp, Homo sapiens
cggcacgaggggttgttccaaaacactcagaacagtgctttgcccataaaggcagtgttagtttttgctgtctacttgggtatcacctgtgaactttaggtcttttatgcctgaccatcggcctccactgtacacctggatccaccaagtgtcacactagggggtttggattaagtaggtgttgttgcaattgctgacaatgtttggttcattcaagttttaattctgctaaaattattttgtgaaacagatggattgtgaagggtgttaacagaaataaaacaactattaaaaaaataca

SEQ ID NO: 217132 - DNA, 587 bp, Homo sapiens
aggactttgtcataacctgtagaaaacattttcccaatgtctctttaccacattggattataaattttctacattcttcttcttcttttactgggcatttatacaacttgaatacaaaatatgggaaaataattttaaaatttaattttcaccatccttgtcagacaaataacattcattatgaatcctctgaaaattccactgttggtacctctatttttccaggctttttccctcaccccttttgtctccatttttattcctcacttattactatctcaataacatcatttctacattttagttattatatcaaaaagaagcaaaaatattaagaagaaactgaaggaagagcaaaactcagtaacagaaaacaaaacaaagaatgcgtcacataatggaaaaatggaagacttgtgaacgcagacgacagaggtgccggctgaggcagaggagaaactatgggggtgctgggagactgagcctgtgggcgtggcttgctcccagagaaccttatggaagaggacatcaaagaaagaaatgccagacctgtatcccagaaaataaagccacatgatatagcaact

SEQ ID NO: 217133 - DNA, 922 bp, Homo sapiens
aagggagtagaacttcttgattcctcagataaatagaggacagatgctggactgtagctaagtatttcctttcatctacgggataaaatactgataatttgagagtgatggacaaggttcagagtggtttcctcattttgtttttgtttttaatggaatgccaacttcatttatgcttgccgtatgcagatggactccatcccactggaaacataacaggcttaccaggcagtaaacggtcacaaccacccagaaacatcaccaaagagcccaaagtgttctttcataaaacccagttgcctgggattcaaggggctgcctcgagatccacggctgcatcccctacgaaccccatgaaattcctgaggaataaagcaataattcggcatagacctgctcttgttaaagtaattttaatttcgagcgtagccttcagcattgccctgatatgtgggatggcaatctcctatatgatatatcgactggcacaggctgaggaaagacaacagctcgagtcactttataagaacctcaggataccgttattaggagatgaagaagagggctcagaggacgagggtgagtccacgcacctacttccagagaacgaaaatgagctggaaaagttcatccactcagttattatatcaaaaagaagcaaaaatattaagaagaaactgaaggaagagcaaaactcagtaacagaaaacaaaacaaagaatgcgtcacataatggaaaaatggaagacttgtgaacgcagacgacagaggtgccggctgaggcagaggagaaactatgggggtgctgggagactgagcctgtgggcgtggcttgctcccagagaaccttatggaagaggacatcaaagaaagaaatgccagacctgtatcccagaaaataaagccacatgatatagcaact

SEQ ID NO: 217134 - DNA, 186 bp, Homo sapiens
cagtgtcaaaaaagaaaacaaaacaaaaaaaaacaaaacaagctatttttgaaagtgtttctggttttgacttccattcccctctgtaaggacaaatatattaactgaaagacatagctaaaatgaacatttttgagcacttcttttcttttctttctttttagcaataattcggcatagacctgc

SEQ ID NO: 217135 - DNA, 442 bp, Homo sapiens
agatacctaatttcccccatctgtgaggagggctggataagggatggggagagaagctaggaatatcactctagggaattccccagaagcaggagttccagataataggagttttccacttgtgtcttacctagtaagtctaaataacctgatacaaatagcttattgcaaatactaaatgtatagttaaaagattagctttggaggtagtcacaaacatgtgcttctaaaaagatagaaaagcctggaaagaaggtgaaagggaaaagaataaaggaagagaaaatacaccaagacagtccctaaatcttgtacaacataaataatttggttggggtgaaaacgaagaaattcaagcatggatttaaaggaagctgatgaaagtaatctttttcactttgagactgttcctagcactactcggatccactcttatgacttt

SEQ ID NO: 217136 - DNA, 477 bp, Homo sapiens
gccaggctgctcccgaactcctgacctcaggtgatccgtccacctcagcttcccaaagtgctgggattacaggcgtgagcgactgcaccaagactgaatttggaaatgatgctcatttcattctctttccctccttccatctttctttctttctttctttctttctttctttctttctttctttctttctttctttctttctttttctttcttccctccttccatctttctctttttctttctttctttcttttctttctttctctctctttctttccttccttccttctttctttcttttctttttcttttctttcctttctttctttctctttctttcgtttctgtttctttcctttctctctctctctcttattattgagacagggtcttgctctctcacccaggctggagtatagtagtgcgatcatagctcacagcagcctccaactcctgggctcaagtgatcctcctgcc

SEQ ID NO: 217137 - DNA, 611 bp, Homo sapiens
cttagtcaactgtacccaagctacttgccggacgctctctcctgagatcccgactgggggcggaaagagcaagcagctcagaagccatccagaattttcaactcatttttggggtgacctggggagaaatgttggcatgcttcatcccttaatcttcttttccagatgttgctcatctgcacagcgtgggactgagcactgtgggatattcaatctgcaccagtgttctctccctaaacatcaaatgtctcttctagccatgctccacccctgctcctatcccccttgccttccatccttcagctcattttgcctgcacagaacacgacagccatgaattctgctgcatctctctcaaataggagaacagaagtgttttcaccagctcaaccctcctcactgcaaccctgtgcaaaacaccacatcccccactcccactttcaggctctgctcacaccgacctctgtgcccaggtagagagcaccagcaaaaggctcacaacaacacaggtaggaggcactagacaaccaggcctcccaaaaaagttgaaaaaaaaaatagtttgtttatcattttaaaaaaactaacctcatacaggaagtatgagaagc

SEQ ID NO: 217138 - DNA, 453 bp, Homo sapiens
tcacagccacaccctgccgaggaatgcgaggccacccttgacttacctgtcagaaaaggatcagacaggaagagattttccagaccctacaccgggttccaaggctttacaacaataatatccagatgttctcttgagaataacatggcaaactatttcttccacattaagataagattgattccctagtgtgtgggcaaaaggtctcccactctggcggctttttgatccctgactctactaacttaggcctccctttgtggggtccatctttgcagctttctctatgccctgccccgctttactccagtgacttcctttcctgcttggttcccacttcacgtatcactcagagagcccttggaactgctagattgagccatatgagagagccatgtttgtaggtcaaaaagccaaatattgggacatttgtatgctttaacttaaaaaaac

SEQ ID NO: 217139 - DNA, 343 bp, Homo sapiens
gtttcgccatgttggccaggctggtctcgaactcctgacctcaggtgatctgcccgcctcggcctcccaaagtgctgggattacaggcatgagccaccgtgctcggccctagtatgtaccatattttctttatccagtcatccattgatgggcactgaggtagatttcatgactttcctattatgaatagtgctgcaataaacatagcagtgcaggtgtctttttataaaaatgattccttttccttggtgtagatatacagcagtgggtcaatcccattttaaaatgcaacctgctttgacctcaaacactcttgatctttctaattgttgtgatctactta

SEQ ID NO: 217140 - DNA, 407 bp, Homo sapiens
atgtgcctgtagtaaataatttggaaactacattaatgtataatatagtaatcacattttatctcattatccagataatcactgttttgcttctttttttatttattctttctatgcagacataggtatacatttttattaaagtaaaattataatgctagtctctttatttccctacacaataccttgacaaattatgacaatataataggtaccagacttgttaaattattgatcaattgattgtttaacaatggaattttgagaaatatttgggtagaaaaaaaactagttttaaaagaagagaatccaaccattaaaacatcaaaaaatgaaattatttgtaaatattatgtggcaatccattcaattttaaacaacttacagtgtcaataaaactataactc

SEQ ID NO: 217141 - DNA, 519 bp, Homo sapiens
ccctctgtctaacaccagtgagcagacgctgccctgtaaccaataccagtgagcagatgctgccctgtaaccaataccagtgagcagacgctgccctgtaaccaataccagtgagcagacgctgccctgtaaccaataccagtgagcagacgctgccctctaaccaataccagtgagcagacgctgccctgtaaccaataccagtgagcagacgctgccttctaaccaataccaggagcagacgctaccctctatctaacaccagtgagcagacgctgccctctaaccaataccagtgagcagacactgccctctaaccagtaccagtgagcagatgctacactcacagaccctgccttgaaccttttcctattttagtacccttatttatttatcttgcctgattgccctggccagaagttccaatactgtgttgaacaggagtggtaagaaatggcatccttgtcttgtgccagttttcaaagggaatgtttccagcttttgcccattcagtgtgat

SEQ ID NO: 217142 - DNA, 124 bp, Homo sapiens
ggggctgagaggatgagggactgtggagttagtgtttaaagggcacagaggttcaatttggcaatattgaaaatagttcagtggggaagatggatggccgtgatgcatcgtccatcacattgca

SEQ ID NO: 217143 - DNA, 396 bp, Homo sapiens
ttgtgttttctggtaccaagacctcatagtttgacttttatgaatttctagtatatattgtacttgataaacttagatgcctttttttttcattaaaatatatcccattgaaacttgggtttgcttcaattatgcaggtcaatttgaaaatagcttctatctttatagaactattttatttgttcttaaatatgcgtctctgcctattagcttcttgaatgtcctttaatgaaattttgcagatgtctctttcttactctgtctctctgtcttaaatgcttttcattatgtttgttcaaaatattatgttcttttgtttctgttatgaattatatcattttttgccattatgtttctaagtgactctttgttgtattaaagaatttgtcacttgtc

SEQ ID NO: 217144 - DNA, 691 bp, Homo sapiens
ccaccatgcccggctaatttttgtattttttaggagagatggagtttcaccatgctggctaggctggtctcgaactcctgacctcgtgatccgcccgccttggcatcccaaagtgctaggattacaggcatgagccactgcacccagccagatataaatatttttagaccaacttgccctcttacgaggtcacaacagtttaccttccaacagcagtgcctcagaatgaaacctccatggacatttctaaaattatatttaagggtctcccatacaaggcattatagtatgaagccagttggcacccatggcggtgatttatttcaatgtagttaaaatattatcagtgttacctatatggtaccagtagtctcagccattcctttcattgcttacattttctcacttcatgctctgggaagcccatgggaaccacaaaaagtgctcagccttatgaagtttatttcaaggtatagtattttggtgaatataagtgcaatgcttttcaaactttatcatgcaaacgaatcacctgggagttctgtgaaaaaaacagattctgatatattaggtctggggcagagcttgagattcagcagttctaactcccagtaatactaatgtgactggtctgcacgccacatgttgattagcaagggcttaggaagccataaccccttaaaagggtacc

SEQ ID NO: 217145 - DNA, 515 bp, Homo sapiens
ctgggaactagaggaaagggtttgtgtctaataggaaccaattgaattttagaaaggatgttaacatatagctgttttactgtctataatgttaaatgaatacacttttggcctctgtctagaaaaaaataacatcttaatctagtgtgtgattcttatacataagactttttagggatgacagtaatatttacaaataggtaaaaaaatatagagttgtctggtttagactcctgttgtcatggcatgtttaaagaagaaagcttccagccgagaaaggcttgtgatgaagtagcatcacctttcagttagttctctgtagtatagattatgtgtatgtgtctgcctggtcatagatgctggtagctaggtgtccttgcctgatgccaatatgattctgggctgaatgcatatgaatccattctaatataagtgtaaatagcacatgggaagataaacctaccaagagaaccacatacagatcatatggtttattccagaggcaagaatgataa

SEQ ID NO: 217146 - DNA, 527 bp, Homo sapiens
gatccatggctgggacattggaatctctctataaaggagaaatcatattaaggtattttcatcttaggcctctaaccccaagggtatctttacaaagactttattttagtgaagccttcaataaacagtgacctcatgtcaagaattctaaagagagggttatggaatattggtttgatattaaagtcattgttatcttggagctggcctgaatggactaataagtggcctgtcaccagttgtaacttacttttacaattttaatgtgatttaagggaagacactcttggaaatgcttagttatggttcatacccataatcgtgtttcttttaggtctttaaattttatataatacaggggagtagattgcatcagtacagtctttttctttttttcttttttttttttatgatgcaaacaaagcagtatcttaaattaaatcaaggtttcttaaggttccagattcttattcctaaattttccactgagtaacctccaaattcttctcctgcctttgtccctagtt

SEQ ID NO: 217147 - DNA, 555 bp, Homo sapiens
ttaatcattctattagaagaaactacactgtcccatctcagcatttgcaaaaaataatgttggtaaggtcagcagccattatcaacagggccttgcatggctaactttgaccaccattgttctctcaacctgataggcaacacctcaatcctttgttctccaactaatcagtaaaataagtaatgcatctctgcttctgtaatgatatcttagaatttttagtatgtttcttttgaagtgcccaaagcccaattctttgggatatcttttgggtatctggtatcatgtgggagtgaagaaagaaagtttttggagaaaccaacaaatgaaagctgtgatagcacagaagctaatggcattgacagtggagtaggtagtatttaatctgtagtgtttacaacatagtagatagaagtacaaaaatttttttaactataactctttaatagcttgttttatctagtaatatttaaataatgaagtttccttgatcctttgcttttgcaacctaacaactttaataataagttcacacaataaacaaattagtagaaa

SEQ ID NO: 217148 - DNA, 407 bp, Homo sapiens
atctatgactgattagtgtacgtgaaagagatgaggagaatggaaccaacttggaaaacatacttcagaatatcattcatgagaatatccccaacctatccagacaggccaacattccaattcaggaaatccagagaacctcagtaagataagccacgagaagatcatccccaagacatataatcatcagattctccaaggtcaaaatgaaagaaacaatgttaaaggcagccagggagaaaggcaacgtcacctgcaaagggaattccatcagacttagcagacttctcagctgaaaccctacaagccagaaaagatattcaacttcttaaagaaaagaaatttcacgtagtatggcagagacagatataccatataataacatggtgttattataaatggttaaa

SEQ ID NO: 217149 - DNA, 620 bp, Homo sapiens
  misc_feature (500)..(500): n is a, c, g, or t
  misc_feature (575)..(575): n is a, c, g, or t
  misc_feature (608)..(608): n is a, c, g, or t
gtatgccttgaccaacataacacctacattatcacatccatatgcttatacagttgtgtattaaagatatggatatgttctgagatatcaaacaattttatcattatgtgcatgccatagaatatagttacacaaatcgagatggtacagcttactacatacctaagttacatgccaaagtctattgctcccaggatacaaacctgtacagcatgttactgtactgtatactgtaagctattgtgatctgtgtatctaaacatagaaaatatacaataaaaataaggtattacaggccaggcgcagtggctcatgcttgtaatcctagcactttgggaggctgaggtgggtggattactttttgaaatgagcctgaccaacatggcaaaaccccatctcccaggttcaagcaattgtcctacctcagcctccccagtaactgggactacaggcatgcattaccatgcccagctaatttttggatttttagtagagatggngtttcaccatgttagtgaagctgatctggaactcctaacgcctgtaatcccagcactttgggaggccgaggcggntggatcaccttgaggtcggagtttgagaccagnctgatcaacatg

SEQ ID NO: 217150 - DNA, 581 bp, Homo sapiens
tcactgcttgcacactcctgccttgcatatgccttgccatcgtgtgggcctcttggctggaagtgttcttgtcctcccgttaggtatcttttatgacgtgaatccttacctctaattattatctgtgtgtacatctcatcacctgcatctgactgtgtgccttgtgtatgtctcttagccctcacaattgcctgacatgccttacaaacgggtagaccaagtgttaaatgaacaaatatttaataagaacttaaaagctttttgactttatatatttttaaagccattgtgattaaacactatgtttgatgtggtgctaattctgtgctttatcaactgtgtgaattgtagtatttttaaagtaggaataattgagaaatattttgaagttaggttaagcatagcagtaaagtttccactttttaaaatagccaaatccaggccaggcgcagtggctcgtgtctccaaagtgctgggattacaggcgtgagccactgcacccggctgaaattgtatactttaaagggatgaattttatggtatgtgaattatgtctcattaaaaaaaacaaactgttaaga

SEQ ID NO: 217151 - DNA, 592 bp, Homo sapiens
tatatcaggtgcccccatcccatccaaatataactcttcctggaacacaaaggtcagggaaggagctgcaaagcgagtagcccttagctttgttctacatttctcctttctgggtagaggagagtagtagtagagagagaaaattggggaagagtaaatggattacccttcggtagttgttcttggacagggaggactccttggggatgcttgatcccatctcatctgggaccagctcaccagagtctcagtcacacttagaagcagttcaggttaaataaagattcctgctgggaaaatgtgaaagaaaatgagttttgttcactttgacagagaatacaagttaaacaagttgttgtaaactgacacaatgtttattgttgcttacaatgttgtgtagttgttgtgtacaatgcaatatagttgtcatagttgtctttatttccaatgtggaaggacataggcagttatacagtgttcttggttctgatgacaacactcaagattatcgaatgtcatgggttgtgttttgcaaatattataagaaggtttattttatttttaataaatggcattgtggcttaaaaaagct

SEQ ID NO: 217152 - DNA, 337 bp, Homo sapiens
ttacttgtgaggattcagtgagatgattgatgatgtttcttagctcagtttccagaagagtgggcactcaaaaaattgtctcttgaagtatttacatgaacagctattctataaagactcaaaatttactattgaatgtaaatctgggatgcagaattggttttttaggtgatttatttttcatttatgaaggcgtgcaccatagaattcctgcagagaatggggatagaaacctccctgttaatgcatttaaaaatatttgatttgcaaaaaattcagtatactttaaaataattttattaataataatttgtattgtaacaactatattgtataa

SEQ ID NO: 217153 - DNA, 2057 bp, Homo sapiens
tagaaacagacccacactggccaccgcaccagattcaaggcatttgttactgttagggactatgatggccacatcagtttaagtgttaagtgctccaaggaggttactactgccatccaagggaccatcaccctggccaagctttccattgtccctatgcggagaggttactgggggaacaagatcggcaagtcctacaccaccccctgtatggttacaggctgctgtagctctgggctagtacaccttatccctgcccccaggaacaatggcatcatctcgactcctgtgcccaagatgctgctgctgatggccggtattgacaactgctacacctcagccaggggctgcactgccgccctggacaacttcaccaaggccaccttcaatgccatctccaggacctatagctgcctgacccccagcctctggaaagagactattcaccaagcctccctgtggaatgcactgaccatcacatcaagacccacaccagagcctccatgcagaggacccaggctccagctgtggttacagcataagctttcatacaagaataatagtgaattacacctgttaaaaataataagcagaagaaaatgaaattgaacaaaccagccaccgtagtcccttctaaagcgacgtggtctgcgggcatcagtgcccttcctctctggctatagctcttcggcatctgaagaaagttatcctaactattgggtgatccagatttgggcactgtctgctatgatgatgccagctggtcgggaaggaatataaagtataggctcaacccttccacagtcactgtactgggaattcaggcttttcctctctgttgatgtcaagaattaacctgtagataacattcttttttttttcttttttttttttttcaatttttccttgttcttgtcaaaggctgtgtcgcttaaaaccaaatcttgatagattcttcatctttatcactctctatgagaagtaaatatgatttaagtgaaccacagtgagaggcctgtcctcactacagcaaataagatgtgtcccaggtgacaagtccagtctccttttaacatggtgcccagaattccacatacctgagctttgggggctgatacaaagccactgcctctgatcccacggaatgacctgaatttactatcagttttgccacaatcagtgcagtttgaggatacgtagacccctgagatgaggcctgagatagatgttctgggaaaccccaaggaagctaaagtacctgccatggtttctttcatggcaggttgagtaagccaagctcctgagaatgattggtcacattgtctttgctgttaaggtttcttggtttacagatggtgaagttgcagacaagttagcaaaccaactgaattttaataaaggaagctttaggaaaatggatgaagatgcagttggaaaattaaagtcatgcttccttgatacatacctcaattctggcaacttctcacttggaattttccaaagtcagtttttggtaatcttgccatttgtattatctttatttatatagttctggttatgcttggtgtgtgccagctgttttgggagtgatgtttttccttatttctcttggctcctgttaagtgttaagttgctgaaactgacctttaatgcttccaaagcaatcagcatctttctctctggatggcttttagaagtggacacagtttactgatttagccagtgaagagaaagctttccatagtgtggtttactcagagcaggtgacaaaaggatgaatttctggctgggcccagtggctcacgcctataatcccagcactttaggaggccaaggtgggcaatcatttgaggtcaggagtttgagaccagcctggccaacatggcaaaaccctatctctactaaaaatacaaaaattaaccaggtgtggtgacaggcacatgtagctactcaggaggctgagacaagaatcacttgaacccgggaggcaaaggttgcggtaagctgcgagcatgccactgtactccagcctgagctacagagcaagactctgcctc

SEQ ID NO: 217154 - DNA, 247 bp, Homo sapiens
ttcgattggcgggaacttagtgtggtaagacttctggtcctctactcgtcgaatgttttggtggaactcttttttttgtgtgttgtttaaagacagagactattatgttgaaacctgtatcctgagtgcctagaacagcatgtgtcagtcagtgcccaattaataccttttttttttttttgggaggcagagtctctctctgtggcccaggctggagtacagtggctccatgtcgcctcactgcaac

SEQ ID NO: 217155 - DNA, 597 bp, Homo sapiens
agaaaaatgacttaatgtctaaggagaaggctaatttggaagggagtcatactggtacaaggaggcaaccatttcaggcttctgacatgggcagatttgcaaaggtggtgctactcaccaggaaagagaaaagagccacatgggagctgcaagtttggcaggcagaatatgtaggattggtttattgtttctgctttccagtatagaaagatgcataccctcaagagaatctgcttgttgtggtttctgatttacatagatgatgagattggccccatgtctgaaaaacagtatgtggggaaggcctggagaagcaattgaactgaaacaaagtcaaaagtgggaagtccccctctggcaagcagctctaagatgacagagccggtgccagaatctaaaccttgggactctggttgctgtataaaaaaataaatattaggaacaaaaataaatacccacatctccatgctggacagcagaagagcaataagttgccaaattttttttttgttttgttttgatagttttttactctctaaatgtaagctcctatatttcctgtcttccatatgttagaagctcagtacaaacaggaga

SEQ ID NO: 217156 - DNA, 374 bp, Homo sapiens
tgctattacatctaacatatgcatggctggggacgtgtcattttaaaggtctattgcccatagtacgtccttttaagcaggtgattcagatatgttatcacagcctcttcacagctaaaacaagaaactatttttctaagatcatcatattccatttgaaaaataacatgtggaatgatctacgagggtatgatcatgtatcatctaaaataaattgtttgcatgtagaacatagaggatattcaatcattttctcactttccaattaacacattatttcatttaaagcaccacaatttggccaggacattctctactaacatggatctgtttattttttaaaatatcaactggctataaaagctatgggttat

SEQ ID NO: 217157 - DNA, 321 bp, Homo sapiens
tcattcactattggttccctcgttttacttaagacaaaatggttaatgccttttgtttttgttttgacacttgttgaagttagagaggattaattgctgcattatcgcccaagctattaagggagatgaatgacaaattttagtggatcaactatgattacaaaagttaatttactttgtcttcctcagaagtctttctgcaatgtattccatggtgaggctgctcagcctctcgcatccattcttcaacaaggtcataatggggaagaatgaagtgcaaatccattgttgcatgctctttccccatgaccttaagtgcta

SEQ ID NO: 217158 - DNA, 261 bp, Homo sapiens
ctttggctgaatgaataaataaatgaaataacgtgaataaatcattccgtcaaaattgagctgaaagagaaagttaagcaataatagcaaggtctgtcattgactgagcaactacaatgtgtcaagtgttttacacaaaaatgaaagcatcaggaggctgaggcaggagaatcatttgaacccaggaggcagaggttgcagtgagctgagatcataccactgcactccagcctgggtgacaagagcgagactgtctcagaa

SEQ ID NO: 217159 - DNA, 382 bp, Homo sapiens
ggttagggtaatacacagggtagagaagtgactaggaagataagggttagtttacaaggtttgtttgcacagatttctctctgcttcaacgtcacatacttgatgataagaatgttactctacttttagtatgtggagaacatctttcacatgggaacctcatctcctgcttttaaaaaacggaatgaagttcagagaaggtttctacaccttctggtttctctgtttttatttaggtgcatttaactcaaggcacctaaataaattctgtgatatatgtatcacagaaatatatatatttgtttccctcatatatatgaaatgtgtgtgtgtgttctgaattgtattgctttcatattttggattttgtgactgtttttat

SEQ ID NO: 217160 - DNA, 349 bp, Homo sapiens
cgcggtggctcacgcttgtaatcccagcactttgggaggccgaggcaggcggagcacgaggtcaggagatcgagaccacggtgaaacgctgtctctactaaaaatacaaaaaattagccaggcgtggtggcgcgtgcctgtagtcccagctactccggagaggctgaggcaggagaatggcgtgaacccgggaggcggagcttgcagtgagccgagatcgtgccacggcactccagcctgggcgacagagtgagactctgtctccaaaaaaagcaattactttctagctagcagaaaatgttgtaagacaacacaactttttaactattttcttcacttatttctagat

SEQ ID NO: 217161 - DNA, 395 bp, Homo sapiens
ttccttccaattatgtgttttctggcgcttcttttccttttcgttgttgatctcggagtatgcagatcttgtcattttccagtcatggcctctgtattcttatactagtgtctagtgaaagaaatgaaaatatggtaccacttcttaggaagtagtcacttctcaggcctggtccattggccctgtctttaagctcctgagctgggtcaggtgacctgaaaccagagaggtccgaatcatcaaatacctgtttatcattctcagctttctcaggagattgctcaatttattttttttattttggagacagggtctcatctcgctctgtcacccaggctggagtgcagtggcgtgaacatggctcattgcaacctcaacctcccaggctccagcag

SEQ ID NO: 217162 - DNA, 380 bp, Homo sapiens
gcatttacagcctttctctactcctggagtcactgcagggcccccaggggactctgaaaacagccagttgttaagcaagggtattctccactagggctaccatgaagtttatattatagagctggatctttcaccccttttgtgctgtaaaccatttgtgcacagcctttgaactatttctcataataatactttttaaatatatataaaatatatgtcattacaaataaaatcaactatgatgaaatatggcacatgtatacatatgtaactaacctgcacaaagtgcacatgtaccctaaaacttaaagtataataaaaaaatatatatatatatttataaatattgatatactgttagaaaaacattttttaaaata

SEQ ID NO: 217163 - DNA, 497 bp, Homo sapiens
aaagtgctaggattacaggcgtgagctactgcacccggccatcattttatttcttagctctttgcctgtcccatttgtgaaatggaggtgggcacccaccctgttgtcatatacttgaaaaatgcaagttttagcaatgttaaggttctactttaaacttactaaacttaagaagttaaaagttggagagacctaggtagccttgcagatgacgctaaacattggttatacaagttgatgtgatggtaacgtagggaaaaccaactgcacagtgcttcctttaaacacatacttatttcataaagttctgttttctcgagagcttattttgtttatctcaccttatagtccatatccagctgtaattgtcttactgtatctgttttctaacagatttattcttgtcttaaatatgatacttaaattttcccacaacctgttccttttttctcagggtctctgtgtataagacataaatattaaaccaaatttcaaat

SEQ ID NO: 217164 - DNA, 517 bp, Homo sapiens
aactgaggctgaaaatagagctacacacacaggctcattgatcatgcctgcttagttctatacagcaaaatgtcccttaagatatattgaagattgggatctaaaaactgacaaattcaattctcagaatgtaagcaggttgggtcacaagaactgaatgtcttcaagctgactgtcagatctttccaagggcaaaaatgaaagatgatataagctattacaggccatgaacctgttttcacccacctgatgcttttactaattagcttcttggctgggtggcaatttggggcaagtgcatgcaagctggattcacaggggagcccgcattccactctgccatttcgcaagccactgggatactacactgcttctcttggcttctttccctcccaggagccctgctctgccctggtggaaaaatgagagcgggagaatttttcattaaatgagggagggatttcatgggactctggtgttttgctaattttattttttagtgggttgtctaaaaaca

SEQ ID NO: 217165 - DNA, 327 bp, Homo sapiens
aggggacatttctcgcaccccaggcttacagggatgtgggagtggaaccaacgcctgtatcaacaagaacatccattccacttccaactcccagtctgttgggttatagaaacgtggctcttacgtggcttgccactgagtaacaaccatgataaatttacaaaccctagacaatgagggcaaacatggagctgactttccttgccattttttcattcagagaatgtttttctccagatctgtgcatccatctccagtaatgggtacaagtttagagatttcttctaagtacaaaatagacaacattaaaaagaaatttatatcatc

SEQ ID NO: 217166 - DNA, 507 bp, Homo sapiens
aattttagatgattgcagtatctatagatgagcctaacaatacttcagcctctcagtttcttgacctctcttccagtaagttttcctccatgctccttccagtctttgtttctttacttgctgtatttcttgtttgtctttggcatattaaacttctgagataaatttatacttctattggtcacaacagagtcatttttttagttttaaaaaatattattaaaaaataaaggccgggcgcggtggcccacgcctgtaatcccagcactttgggaagctgaggtgggtggatcacctgaggtcaggagttcaagaccagcctagccaacatggtgaaaccctgtctctactaaaaatacaaaaattagctggatgtggtggcatgcgcctgtaatcccagctgcttgggaggctgaggtgggagaattgcttgaacctgggaggtggaagttgcagtgagctgacatagcactattacactccagcctgggcaacagagtgagaccc

SEQ ID NO: 217167 - DNA, 472 bp, Homo sapiens
agctgccatcaaaaaacacacttgctgttagtctcttagtctcacagttagtgtgacatttggactcaacatgaactgtttttattaaatttgagatggtacatacacaaagtctcagggttgtgatacactttaaatcctttgggggctcccttcaattggcttaagcattaacaccttctgaattcaagtttgaaacatagcagtttttgaattggcggtgaagtgttctcataacactatacttttttaatattatggtttagttccaaaaaaattcacaaggaggaaatgttagatatctctcaagttgtttactgctgtgaagaaaggctcatatgggggcttagtaattttctgattctttgctcctgcagccacagttacagatatataaaatgtatattgagtttttgccatgaaaataatacatgctcactatgtgaaatagtaaaaatatagaaaatttata

SEQ ID NO: 217168 - DNA, 401 bp, Homo sapiens
tgctctctacttcattcttttaataactatacagtttgctaatgttacgctggagtatcccagtgcttaaaaatataatacacttggctgggtgcagtggctcacgcccgtaatcccagcactttggtaggccaaggctggtctcgaattcctgacctgaagtgatccacccaccttggcctcccaaagtgctggaattacaggcgttagctgccacaccaggccccaaaaatgtaaaaattagctgggcattatggcatgcacctgtagtcccaggtacccaggcacttgggggcacaggtggaggattgcttgagccagggaggtcaaggctgcagggggctatgagtgtgcgactgcattccagcctgggcaacaaagtgagaccctgtctcaaggca

SEQ ID NO: 217169 - DNA, 484 bp, Homo sapiens
tgcggtggctcacgcctgtaatcccagcactttgggaggctgaggtgggtggatcacctgaggtcaggagttcgagaccagcctggccaacatggtgaaaccagtctccactaaaaatacaaaaattagccaggcctggtgttgggcacctgtaatcctagctactcaggaggctgaagcagggagaattgcctgaacctgggaggcagaggttgcagtgagctgagatcaggccactgcactccagcctgggtgacagagcgagattgcctcaaaaaaaaaaaaaaaaaaagttgggtatatatcatttaggttggtaatgattttttcctcagaattttgaaggcattactttattttttaatttttaaattgtttttattttttttgagactgagtctcactctgtcacccagtttgactagatccgcctttcccagttgctgagtactcaacagcacggacaggtcgattttctaacata

SEQ ID NO: 217170 - DNA, 296 bp, Homo sapiens
aatacacttaaaccttatctataacatatgtataggtataaacaacagcaataaaacaccttattgccaccatgagcctaacagcagagccaccagggccttggaatgctgtccctcaccatggcctcttcctaattcggtttctctccctcccacctgtgccccagcaccactctcctgatttgtttgctgattattcctttagaattgcaggtcacgtacttgattccttcatgtgttgtctggggtgcatttttaaactttcttataaatagaaccataaagatgcattttct

SEQ ID NO: 217171 - DNA, 211 bp, Homo sapiens
aatcagtaccatttattccttaaatatttggtagaactcaccagtgaaataatctgagcctggcgctttctgttttggaaggttattattaattcaatttctttaacaaatataggcctattcagattatttatttctccttctgtgagttttggtagattgtttttttcaagaaattggtccatctaattatctaagttatcaaattggt

SEQ ID NO: 217172 - DNA, 207 bp, Homo sapiens
actgtactcaggtggtgtacccattaaaattcccacttgtgggttccgctcgctatgcaaatggggtcattacccggagaatttaattggttatgacactgggagtaggacttttcctttcaaaataaacctacttacacacatttttgctagaaatttgattgttatatgtagtttgcattgttttgctctataaatatttacaac

SEQ ID NO: 217173 - DNA, 414 bp, Homo sapiens
caggtgcattacctttttcccatattcatgccaaatgtagcattactctcttcctaatttttgccaacataatgggtataaagtgtataaagtgttatagtttaatgttagtctgagattttttattacttgtattttaggcatcttatatgcttggtggtgttttaggtttcattgtctgtgaattgcttatttgtttcctttacccattttttcaacttagcttacgaggttttaaagtacatttgcaagaattccttgaatatttttgacattaacactatggtttttttttaaacataatatatttatcacactcaggaaatttgacattggtgttatgttgttacatgcatttcatattcacgtttcttataacaataagaataacaaaataataaaaatagtgtcctt

SEQ ID NO: 217174 - DNA, 338 bp, Homo sapiens
tttttgctttttaacttgtatttttgttttgtaggtcctatgtgatctatgctttaaaaatgttctgttttgatgtgtttttgggatttgtttcaagatttagagctccttttaccagttcttggtaaaagagctgagactttccagagcattttgcatttctaaaagtgtgtccaaagtttcctgaatttttgttttttctttaaactatctattttcttgaatatttctaccttaacttcttgtatcatattttggatttcattgcattggggttcgccttcctctggtccctccctgattagcttattgactaacgtcctgaattctttttgagg

SEQ ID NO: 217175 - DNA, 432 bp, Homo sapiens
tttgacttgttcttaatggaactcttaggagttatttatatattctgtatactagctctttgtcagttatttgtattacatagttattctcatgctgctataaataactgcctgagactgggtaatttataaaggaaagaggtttaattgactcacagttcagcacggcttgggaagcctcaggaaacttacagtcagggcagaaggtgaaggagaagcaaggcaccttcttcacaaggcagcaggacggagaagtgctgagcaaagtggggaagagccccttataaaaccatcagatcttgagagaactcacttactatcacgagaacagcatggggaaaaccaccccccatgattcagttacctccacctggtctgacaagtggggatgatggggataatgaggattacaattaaagatgagatttaggt

SEQ ID NO: 217176 - DNA, 166 bp, Homo sapiens
ttaaataataaatataaggaattatttttcctttgatgcatatgaatatattttgatttttatgaaaaaaatttattcttaaaattatatttaaatggaaatattttgttaataccccgtatataatagaatcattgtgtgaagaaataaattatatatctatgta

SEQ ID NO: 217177 - DNA, 582 bp, Homo sapiens
tcttgtggatcaatgttctaattatcagagcccaatatgtgtatagccgaagagctagataatgtgatttctgcctcagccatatctctccttggggttgccaagaactgtctgtcataaggaggacaggtcaacagctttcaagtctgtgtacattgtgagaaagtgtttccccactaccttaccattctggcaatttatagatgttgggaaaattaaaaattaatctgtactagaaaaaggtggagaggtccatcctatatgtaaatactatttacacacctgcctttttgcaattcctttgggcaagaatgatcatagtctccctatagcctttagtgttccactgatccgctgtttttccaggttgtttgaaattggacgtaaaaatagttgtctgggtactatgttaggtctatgttgaaggaattaaaaaaaattccctgaggtttcttatggctaaaattattccatatgttcaaagatgaaatagatcaaaatggcttagtgagttccctgtcactagatgctctgaagaggaagaaataattgacagaggtgttgtaaagaaaattcaagaac

SEQ ID NO: 217178 - DNA, 584 bp, Homo sapiens
gagccatgatcctaccatggcactccagcctgagtgacagagtaagaccctgtatcaaaaaaaaaaaaaaaaaattctaaaaacacaatcaggagaaagtctcccttctactcttgctcagtatttccttgtgtgtctgcatcttattaacagacatttagcctgtttctagtctcctgctactatagacaaggctggagtcaacatcccacacaccacacgcagcaggtatctggatggacccggcttcctgaagacagatgaggcttattgtggtccctgagtagttggccaccacctgtctctggggatccaggaaaaccaagagctcctgaagtcaccaagcttcatgccagagaacactgtgcagggctggggaccagtgacatggaatcaacagccagcctggctcacagctgggccagcacacctctaaagatacatttctagaagtgggatattctggattaaaagatgtgtgcattctaaatttgggttcatttcaccaaattgcccttcaaaagaggttctacccatgcagatgcccaccaataatgactgagaggacatgtttcacaccctct

SEQ ID NO: 217179 - DNA, 1039 bp, Homo sapiens
  misc_feature (629)..(630): n is a, c, g, or t
  misc_feature (637)..(637): n is a, c, g, or t
  misc_feature (674)..(674): n is a, c, g, or t
  misc_feature (686)..(686): n is a, c, g, or t
  misc_feature (695)..(695): n is a, c, g, or t
gttgaaagcgggcttcccgccccgcccagaccgccgaggctgccgccggagtcgccaccgccgcgccctcgcccacccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggcccaccaatgccatctttaaggctttcgctatgatcatcgacaagctggaggaagatatcaacagctccatgaccaacagtaccgcggcagcaggcccccggtcaccctgaggctggtggtgccggcacccagtgcggctccctgattgggaaaggcgggtgtaagatcaaagagatccgcgagagtacgggggcgcaggtccaggtggcgggggatatgctnnccaactncaccgagcgggccatcaccatcgctggcgtgccgcantctgtcaccgantgtgtcaancagatttgcctggtcatgctggagacgctctcccagtctccgcaagggagagtcatgaccattccgtaccagcccatgccggcagctccccagtcatctgcgcgggcggcaagatcggtgcagcgacgctgcgggctacccccatgccacccatgacctggagggaccacctctagatgcctactcgatttcaggacaacacaccatttctccgtcgatctggcaagctgaaccagtgggagacaacagcttcacttgcatgatgccggggaccgattcccggaattatcagtctccagggaagcctgggagtggtgtttctaacccctgatcctcccatatgg

SEQ ID NO: 217180 - DNA, 1014 bp, Homo sapiens
  misc_feature (604)..(605): n is a, c, g, or t
  misc_feature (612)..(612): n is a, c, g, or t
  misc_feature (649)..(649): n is a, c, g, or t
  misc_feature (661)..(661): n is a, c, g, or t
  misc_feature (670)..(670): n is a, c, g, or t
gctcgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggcccaccaatgccatctttaaggctttcgctatgatcatcgacaagctggaggaagatatcaacagctccatgaccaacagtaccgcggcagcaggcccccggtcaccctgaggctggtggtgccggcacccagtgcggctccctgattgggaaaggcgggtgtaagatcaaagagatccgcgagagtacgggggcgcaggtccaggtggcgggggatatgctnnccaactncaccgagcgggccatcaccatcgctggcgtgccgcantctgtcaccgantgtgtcaancagatttgcctggtcatgctggagacgctctcccagtctccgcaagggagagtcatgaccattccgtaccagcccatgccggcagctccccagtcatctgcgcgggcggcaagatcggtgcagcgacgctgcgggctacccccatgccacccatgacctggagggaccacctctagatgcctactcgatttcaggacaacacaccatttctccgtcgatctggcaagctgaaccagtgggagacaacagcttcacttgcatgatgccggggaccgattcccggaattatcagtctccagggaagcctgggagtggtgtttctaacccctgatcctcccatatgg

SEQ ID NO: 217181 - DNA, 222 bp, Homo sapiens
gcttagggatggtggaattgcctcctggggggcaactgggatttcaagggtgtttttggtggtcacaggggttgaaggcaccataagcatttagtgggcaggggccaggtttttaaactgtcataaacgtgtcctagaaactgcctttttctttttcttttcttttctttttttgagatacagtctcgctctgtcgtccaggccggagtgcagtggcgtgat

SEQ ID NO: 217182 - DNA, 645 bp, Homo sapiens
cacccgaagagccagtgcataggcagccagagagagagacaaatgcctgtgcatcgctcaggcaggaggtctgcaggaacctcctccaagtattctgtgtgatgtttgggagtcaggaactgaaatggacttatgtacacaaggttaaacagtgtttccaggcttgggaaagacaaggcaggagggtggtggatggctagacaagtgaaggagagcaaatgtcagaaaccaaggagggatctcatctgaccttcagggaaggtcaggggaagacccacagccaggggaccatagggacattggtgtgataaacaacaattatgcaagctgtggtccatcagcagagggcgggatgcagcaaaagccaaaatataaacaagcctgatactgagatttggagagtctcacctaacaagctgaaaggaggagtgaccctagaaggtcatgttgagagtaaacatggtaaaacctggattgcgaagcaagtgtcacaaacatccttgttctccctggcctggcttcagtgagcctctccagtggtttgcctctcactttctggctgcttgcattctctcttccagtggctgctcaaggttccattactttgatatgagtatgaggaatagtgatgccatttctcagatt

SEQ ID NO: 217183 - DNA, 443 bp, Homo sapiens
gtaaaggagaaaaatgaaataaagctcttctatgaattgcaggaaagctgaatttttaaagttcttgaaaacagagcagttttttcctaatgctaatgaacaaagcaaatcataaagacgtgttgtcgactcacattctttagtgtgggagttatccagtgtaccattcctgatcaccctctttcaggttcaactatgttatctgacagatactatgagagcatctagcttttctgcaggagacctgcttcaaattcttgttctgccactaacttctgtgtgccttcagtgagtacgaacatttctgaactttgatgccttttgtgtgcaaaatggagttactattttccatatagagcagtcatgaagataacagttaaaacatgtaaaagcacttggcacaaaaataggtattcaataaatgggaagacttctttatagta

SEQ ID NO: 217184 - DNA, 583 bp, Homo sapiens
aaaattccgatgctcagaaagcattttgcgtgacagaccattatacatttcacatgatttggtcctggtgacagaggggttgaggaagtttcccaaatgctcttctgttctcgggcctcttcctgattgtcctggatggctgactgcagatgggtttggtggagtctggcgcataagtcactaacagcccgtagcaagcaggaggctatttcagctgatctcagcaaggcttgtcataactagctcctctctcagtcataccttcaaggtggcacagggattcaagaattggccttgaccggggtgcagtagttcatgcctggaatcccagcactttgggaagccgaggcaggcgaatcacttgagtccaggagtttgagaccagcctgggcaacatggcaaaactccatctctacaaaaactacacaaattagctatgcgtagtggtacacgcctgtagtcccagctactccggaggccgaggtgggaggagtgccagagcctgggaggtgaaggctgcagtgagctgagatcatgccactgcattccagcctgggtgacacagtgagactttgtctcacag

SEQ ID NO: 217185 - DNA, 415 bp, Homo sapiens
agggggcaggtacctgtaccacagtttagccacaacagaaatatcgttgggctaccaaaagatgtcagtccttaaaaatgttggcaagcaaagaaatttttctctaagcacatcttagagatactttagtctaaaggcacagttgatcagattaaagaagctaagattacattttggggctggtctaatcgataaatatctatcagtggccataaagttttatttcagtgttttctggtgtaaagggattaattttatgtactcaagtctatggagtttgttttcttccacctttaatcacctcactcggcttgctggtgtgcagtgctcatgcaaaacttcctaagggagtgccccacttgttttaatttacttcctctagcaaaaacacagctagaggaaacacaaatcgttt

SEQ ID NO: 217186 - DNA, 474 bp, Homo sapiens
tgaagaggagcattcacatgaagtgaactgcaaaggggattttagagattaaaaaatttctcagagataagcaatttgatttttcaagaagggctcaaaattacaccaactgcttactttcagtataactaggatggtattctccagtagattctggtctgtagagaaaaaaagtcttcctggaaaaaaaatttaggcttttgatcaatttgtttttattcagaaaagctgaagtggaattaattttaaatgtggagaactggtcattgcttctactgctgacaatactacaataggaaaaaatggaacatttccttctgaacggaattgtagtgaattgagaactaaagagcttatggaaaatagccttcaaatgattatttttgtttgcttaaatgcttgattatgatgattgtaatttcagctatacatagagtatagggaaaaaaaagctaagcctgggctccagttatt

SEQ ID NO: 217187 - DNA, 409 bp, Homo sapiens
agaagactggagggaccaaaagaggtgatgcatacacaaggttctaaagcccaagtctggactccatatgcacattcaaatttgaggaacactgagcagtaacatgcaaatcacctgagaatcttgcttaatcagcttctcattcagcaggtctgggggagaggctgagagtcagcatttcttgcaagttcccaggtgatgccagtctgcggcccacatgttcatctagaccccaaactagtagcaatgtgtgtggacaaggctgggtaacaggcatgaacaatcctccagtcatgagtaatttccttgagagcagttgttttctgtggaagacccagcgctcagcctccatgaacatggtcgagcctccctggaaaacactgccctcctatgctagcacctgtgaaaa

SEQ ID NO: 217188 - DNA, 513 bp, Homo sapiens
aggtgcacttctggggctgataggaaagtgaatttgcttctcctgatcgtgcacctgcagggagccgggttcgagagctgacgtctggctgagcattgtcacagttgagccactgctgggcctcgaagaagggcctcagccttgtggggtgcctggaaggtgctcactggggtgcaggtgcttcctgggcagtccccgagttgatgggccaaggtggggccctctccagcacctgccaggacagcctcagatgctggacacttcaggtctccccagggagaaaggggctctctggtccaggctgtggccagccacatgtgtcagggccgtggaagagaagtcggccatccttccaggccacagacacagaatcaactccaccagctctgttcctacccggacagtagctagaatagggttaacaaagctctggaaaaatctatcaaaatagctccacagactgtttcttcttttctgctcatgttctcggcctagacaccaggccttcccgtg

SEQ ID NO: 217189 - DNA, 494 bp, Homo sapiens
gaccccaagtgatgcccccagagcctccaagtagaccccaaggaacaaggcccgggggtgctgggcccagttaattacggagtggcatcctgaccctcactccttctgagtcgcaaaggtgagcgaaacggcctcagcacccactccctttcccaagggctctggactccctttcctgtgatgctggcacacaggatcccctccagacacatagcaggggcctccccagcctcattcctcaatagaccttgtggtcctggcaggcactgccctaccagcttccatccacgggctgtgtgaccttgagcaaatcgcttcacttctctgagtctccactgacccaaatgggggtcgatcagagaacaggaggaaggatcttgtattcaatagaagatgtacactcagggtcacagtgatgaacaattgaccactatgctgccctatgaggggtcatccaggccaccatgggcaggggtgctctgggccacccacgc

SEQ ID NO: 217190 - DNA, 402 bp, Homo sapiens
caagtcttttctttctcaattttttgagcttatattaggtttatgtccaaaaagtcattgaaaaacttccttgctcgactgatattttctcccctttgctaagaggatgcatttgtgccagaagcaggtgcttttatatatcaggtagattttttatccttgttcagtaagagtgcatgatgaacgccatcagcacttggccaagggagagggacatgaacggtgagagctgaggaatgggacctggctgctcgcacgcctgtgctgggacaggcaggggctccgggcgcggccatgcctgtgagcagttctgctgaactctgcttgctctcagttggctctgagaccaaaaattgcctaaaataggtcacctgtttgtatcctaaattgtaaaaaaaaaaa

SEQ ID NO: 217191 - DNA, 438 bp, Homo sapiens
tttcgagcggccgcccgggcaggtacgcgggaggaatttttattttgttttatttttgcttttgctttatgctgaaatatcccatgaaaccaaggaaaatcatattaaaaaaacaagaattttcaataaaattgagcgtctcaggtctttgtgtattacttatttatatttgtttacaaattatatttgtatgcatattttaggcttttgtaaaaacctatctgaaaataaatctaccatgttttagggttgatttcctatagattcattatcctatgaaatgaattatctctctgaataatgccatgagttatagatttttcgctccaaatttttcctatttctctacttgttattcaaagggatatcagccaaattggcaaatttgaagtcttctctttcagacatgccaaattttagactgaagtgaactattat

SEQ ID NO: 217192 - DNA, 345 bp, Homo sapiens
gtaaatgaggctgacatctgatacacatgttcacgtgggcacatgcacacacacatgcacgacatggggagtgtacacttactgacctacacgagcatcaggagtatcattaactctaaatgaatattaggttgaaccacatgaaattgctgacatttgcccactttaggtgatttcatatgattcacctacctcatgcatctgcactggccactcaggagcacactggaaagctccctgtaggagaagcatcccagttgcaaatctctgcctgctcttcacagtggctgtctgtgtggcttttgatttgagtcccttatctgtaacctcaatgagtccttcagt

SEQ ID NO: 217193 - DNA, 664 bp, Homo sapiens
ccaaagaaaaaaatttcagtttgtgggagtagtgcaaaggttgctctgactgctaaaagtgaattgcacaatgagaagaagattaaaagcgccaacaagagctttttgtttccctttgatttatgtgtacttacctgctatttccttcctctctgtaaggtatttataagtattatatgtagttttactcctttatcccatgtttaagagtatacctaaacatatatgccattatgattgttgcatcctcttgggacagaacttataatgtcaatcccaacatcttgtatacaacttttaaaaaatccagtgtattttatgttctgatgttgtgctgcatccagatacaaagccctttaccatgtgaatgtgatgctttcaatttaagaccattaattcattcttcagttcaggtaccacaaagcagaataattcatgctttaaaaagaaccttgactggctctctgaatgcagctcaccagggcctgcttctctgggctttctagagactagaaagtcttttcagaggccaaaaagtccctgggcatacatctctgagttccctttcacaagcaagtttcaagttccagtcaaagagctctaggtaaccacatatgcctcaaacctaggaccatagaatcctgaacaaaggcccaggagagct

SEQ ID NO: 217194 - DNA, 225 bp, Homo sapiens
ttacatttttttgagtgttgtagaaaaaaaaatatgcgacagtactatgtggtcccataaaacctaaaatatttactatctggccctttaaagaaaaaaatttaccaactgatgccttaagtctcaaagtatacaatccttgtttcaagttgaaggtcttccttagttctgcatcatcctttagtcattctccaggcccttctgtcgtcttctctgaggggtaca

SEQ ID NO: 217195 - DNA, 175 bp, Homo sapiens
tgttagccaggatggtcttgatcaaaacttaaattagaaaattctaagtacaaattcagtatggggaaatgtatgatttaatttggggtcaaataaaattaaaatcactaactcaaagagccaaggggaattagaattgaggatacagcaatggaactatatggcaggatccgtc

SEQ ID NO: 217196 - DNA, 503 bp, Homo sapiens
cctaagttccctgttattttttgtctttttgataacagacattctagctagggaaatataatattttgctgtggttctgatttacagttccctgatgattagtcctgttgagcattttttcatatacttcttggccctgtgtatgtctttttttgagaaatgtcctttcagatcatttgcccattttcttaaatgggatttttttctttctgttgaatcatttgaattccttatatattttagatcccttgttggaggaatagtttacaaatatttttccccattcttcaggttatctcttcactctgttgattgcttccttaggtatgcagaaacttttgacttgatatgaacccattagttgaaatagacttttgttgcctgtgctttggaagtcttattcataaaatattttcccagaccaatgtcctgaagcatttcccctatgttttcctctagtaattttatagtttcagggatcacatttaaatctttagtccatt

SEQ ID NO: 217197 - DNA, 484 bp, Homo sapiens
ggtgctgaataaatgactcttgacttgtagcggttgacttgcatgactgtcgtgtggcctgaaacctcagtttcctcatctgtaataggataaaaatgactgctagcctgggagccctcctgagtagtttgctatctgggacgattttcatgcatccttcttgggagagatttttccctccacaaatctcaagctgccttcagtcctgttgccacattgcttaactgagaaagtacagggaacagagaagtagatatctcagacctgattggctccatttggtgactagatacagacagtgtccttcccaccaccacggccaatgactctcctgtcaagagggcgctctgtggagaagcagaaatgctgtgtccgtgagggctgtctggatggcatgaggtttcaaataccatattgcagtcaggagttttgggtactgaatcatgtatttactcatatatatatatgagtatattaaaaaaga

SEQ ID NO: 217198 - DNA, 426 bp, Homo sapiens
ggagaaaacataaaggaatcaaataagcacacaaatgtatctaattttcacttatgtcctgtggagtaatgcagaagtgtaagggagacatgagaaagcatggaggacctgatctaatttgggggttagtggtcggtgaatatttttcaagaagaagaagtgatatttgatctgaaatctacaggatatgatgaaaagaatgggaaggccaataaagggttggtggaagaaggtagaggacaggataaacattccaaacagaagagaaggcatgtgccaaggaagccctgatgtggacatgagtatggctttttggaggaaaactgaatccacaatgaaatatcactccacacccacaataaaaggctaaaattataaagactgattttaccaagtgtaggtgaggctatgatgcaattggaactg

SEQ ID NO: 217199 - DNA, 515 bp, Homo sapiens
gtactggtgcttttgtgcagtctaagtcattatacttttatgactttggttaacattgggctataaaaaccagtaaataactgttaaaagcagagtcatttgctcaaaactattttatgagcttcatttttggaatggttgaactttccgctagatttttccccttcatacacacagaatctttgtgttttttacaactcagcttgtgaacaatattccaccttctgactgaggtaaggctgtgggcctcgtgggctggagattgttcttctgggcctggatgatgcaaccggatatgctattttctccactgttttcttgggagaaaccgtgtttgtattctaggctcagcgtgctttcagttggtggttacacctaaatataaatattgcagccatttcagaggcacccccagccaagcggcacctgccatgattttcattcttggggtcctggctgctcatggcgaatttgaccccctaaacacacgtgctcctggagcactgccggttctc

SEQ ID NO: 217200 - DNA, 341 bp, Homo sapiens
ccaccgcactccagcctgggtgacagagcaagaccctgtctcaaaaaagaaaagaaattgagaacagaaaaagaataaagaaaatcagtgaaactaaaagcaagttctttggaacgataaagattaataaacctgtagctagcgaccaagggaaaaaagagagaaggaaaaaaaaaaaaacccacagtttaaaagtttaaagacttttggggcagggccatgcattccagcagtttccaggatgcgcagccaagctgaggctgactcacctgcccagggcatggtgtaaaacaaaaccaaagaggccggaagctccagcctggaaaagcagccctggcctt

SEQ ID NO: 217201 - DNA, 522 bp, Homo sapiens
aacagtccaaagaagcaatgataatgtaggatgttcccattttggcaacattggcaaagataggcaaggccagcaaagcaagagacaatgtccagccccaacactcatggtggcagcagggtgcttagtggacagtgccatggcatgattttggctctggtctggctatccagtctcatgctgttcctgcccacttttaaagtcttcccaacaggtgtgtcggccacacaatgtatatccagaatccaaccatttctcttcacctcttctgcagacatcatctcatgtttagatcttattgcaatagcctcctgactggtctcttgattcttaacttccccacccttggtccattcttaagaaagcagccagagatccaataaaatatgagtcagatcaaataatttctctgctcaacaccctttggaggcttcccatctcattctgagtcaaagccaaactcagtacagccaaacctttcaaagcccacagaatctgaatgccattgcatctcaaaccttg

SEQ ID NO: 217202 - DNA, 319 bp, Homo sapiens
ctctgctccatcttcaatggccctttgtcaccagctcttggtgttttttttggtcccgtccctactacccatgtccctgtacttctccctctctccaccatcatgtctctcatcaagaccaccaaaatcacagaccttcgtctcttagcgaccttcatttctactcctcagaacttactgaaccttgttcttcccacttcagagactgcacaatcaggtattttcttctccaactttaactaaacttgcttctcatcatcatgctgattttgaaaatctgatctctttcctgttctccaattctgtcagcctcacccaa

SEQ ID NO: 217203 - DNA, 480 bp, Homo sapiens
agatgggtttgacactgacttcccatctcctcagttacagcatgtgattaaagccttcttccttggcaatacttgttgtctcagtgactggctttctatgaaacaaatggaaggacctagactgaacccctggtgtttcagtaaccatgtaatattttctattatattgtttctctgaaaataattgtatagttatatgctgagccaatcctgagtgtgtacaaagatttggacttggagtcacttctagcatccatctgcctgaccaacagttactgagtccccagttggcacaaggttgtattacttatactcaaggaaatgaggctcagaccaattttaaaggagcaaattcaggactcaactaataatacaagagtctctagactttactttatatgaggatgtttaaacaatccaaaacagtcagtaagttccacctgaattgcagtacttgggttgagtgtctcacttttaaaa

SEQ ID NO: 217204 - DNA, 429 bp, Homo sapiens
ctcacttgagcacaatccaagatgaaagtttctgggttgtgtccccttcgcttcctctcaccctcgctcccccgcggagccaaggagccagcaattgtgcaagaggagaccggcgcacagggcgcgtatcacggagcgcatgagccagcaagccgaacgcctccagcgcggccgggacggaggagcggctctggggaagacgccgaggctgcgcccgagtctgaacgaagctgcctccagccacatgaagtcagtagggctgttctgaggggccccgagatttgatgactgttttttaggttgcggaacctactccgagagagcaaacactttggacgaagtgattcatattgatagatacatttgttgggaggtggcttttttcattctcaacagaaaacaaagaaataaattaagtcttcccctgac

SEQ ID NO: 217205 - DNA, 396 bp, Homo sapiens
tttttagcaaaaaacatgaacaattcttaaggccaagggttagataaagagcttgtagacatgacatcaaaagtacaactataaaagaaaaataaataataaattggatctcattaaaattgaaaatttttactttgtaaaagaacctgctaagatgatgaaaagacaagctatagactaccacaaaatatttgcaaaccacatatctgatgaacgactaatatctagaatgtatgaagaattttcaagattcaacaataaataaaaaataagcggctgggcacggtggctcatgcttgtaatcccagcactttgagaggccatggcgggtggatcgcctgaggtcaggagttaaggccagcctggccaacatggcaaaaccccatttctactaaa

SEQ ID NO: 217206 - DNA, 656 bp, Homo sapiens
tgagtatggcagaagagttaagtgctgctgtgttatcgtttctgtatcagagcagtgactctcccaagttttccagccttttggcaggtaatattttgtggctaaaacagaatacgcagatcttaatatttctatatttaagtgtcataggatatgagcccctggcatgataagaggcagtgtgtgtggtggtttagcatgtaggagctcaagcccaactgcctgatgtttgaattctgattccactactttccaggccgtgtggtcttgggcaattgtcttaaccttctggtgcctcgatttccccatctataaaatggagatcaaaataggacctcagccatttgaatgacagaataattgaatgaaataatacatacagagggtccagcaaagaggcaataaatgttagttgtgacaacagagtgccagttgtgggccatgacaggtgaccacttgtgctaattttaaagtagaataactcaagaaaagcaccagacttttaggtccctatgtagctaaatcatctggcctggaactataatgacaatttcctgaatttgctaatgactttcaagccaattaaacacatctctatatgtctcaaagcatttaatgaaaaagtccatctaattctgttgcattctgtatttcat

SEQ ID NO: 217207 - DNA, 695 bp, Homo sapiens
agatttgtcatcagattttaaaatcaaagcagtaagattttcctaaaaataaatgaaaaagaaaaagaattctatttacctcaatattgctattttcacaatttcctagaacaagttgtacggagtaatacaaatgctaagaaggtgggtccaaatgaaatacagaattcataataagaggatgttgttactcagaagaaggacaacccagtgtgctttgagatggtattgcagcaatgaaaacaagctcaatgttcatgtcagataaacaattgtcatcacagctctggaagtttgggaagtgactcatcttcaggaatgggcagtgagtgaagacaactgtttacctcagccctttggtggttgacacaaacattcttttcttcccctgtgacttggccaccgggagatgctgttgcagccacgtgcatcgtcaccccagcttccaccacatagacgctcacctctcctgccccgtgatgccttacactctctgccctcaggctcttactgtccttaggggtggaaaatctctaaaatcagtggatttcctggtaaatgggggagaaaataattcaggaagcctctccttgcaaggagggaccattgttaggaacttttggtctgagatgctatggctgagtccaggggggcaacaaagaacagaccagttccaaactcgatcagctagcaaa

SEQ ID NO: 217208 - DNA, 451 bp, Homo sapiens
tctatatcttatatttaagttgtattacttataaacagttaaatccagtctcataatctctgtcttttaaatggcctgttgattctgtttgcttttgtttttgaaatggagttttgcactgttgcccaggctggagtgcaatggtacgatctcggctcactgcaacctccgcctcctgggttcaagtgattctcctgcctcagcttcctgagtagctgggattacaggcatgcgccaccatgccctaattttgtatttttagtagagacagggtttcaccatgttgggtcaggctggtcttgaactcttgacctcagatgattcgcctcccttgggcctcccaaagtgctgggattacaggcatgagccaccgtgcctggcctctatttgcttttaatatacctttaatatgatgtatagactggttcttgaacatgagtagaatttcgca

SEQ ID NO: 217209 - DNA, 470 bp, Homo sapiens
aaatcatcccttgacctctcgatctttggtttctatctgcaaaatgggtataatctgtgacagtgacctaatactttttttgggatccattttgaagagcatttggagaggacttaaaacagtttgtatatccccgagcatagataaatccccatgttaaaacacagtgcatctaaagcaacaccactgagctgtcaatttttatcactagttctataaaacttactgagagacactgaagttcttgtagaaatgaaaaatgagcaactgatgttaattccactggttaagtaggaaaagccagggcctgagagtaagacaactggccaagaaccccaggactggctgccagggctgctggctccctcccattctctagtctctgtgcttgaagctgtaacttaatggttttaagtaggaaatagatttattgatatgtggttttcttctgcggaaaatcaaaataaacc

SEQ ID NO: 217210 - DNA, 435 bp, Homo sapiens
gctcactgcagcctccggggaggcaggacatttctgaggtccacagtgcagggcttggtactcagtaggtgcccaataaatacctgttgcacgaatgaatgaatgaatgaatgaatgaatgaatgtttttggttgagaggcgggactttggtcttcccgagcctccatttctccgccaacataaaataaaaaacataatggcactttcctcagagacatcgatgtaccttagtccgacacctggtatacagtaggtgccaaataagtgctgctgtgcttatggttgttgctaaactagtaattgcattgaacaccccagaggcattttccagtttccctcccttccctctgtgtgtatttgcgcagcgtaagcccagctttgggctgggtgacaaggacagtggtgacctggaaaggcccaggctcagacccctc

SEQ ID NO: 217211 - DNA, 247 bp, Homo sapiens
aattaactattcctttaatggtctgcgttcatttccagtatttcaaatttatacatactgctttgaaacgtttatgtaattttttacatgaattttttaaggagatatcaaatggccttctgccagttttcgttatttgctctaagatttctgctttaggttgtttagaacaatcatggatgcagcgtcaagaatgggtgggggaggggggtggagaccaggtgggaggcccctggagtcgtcctgc

SEQ ID NO: 217212 - DNA, 475 bp, Homo sapiens
cagccattgttctccaccctctctcttcacagggaatgagccttgagttatgctgtgagaagcagccagcgttagcaagagaaatctgaatttccttccaagaacaatgctttgaagcagagccaaacagatagatgaggtggagtgcaggggtggacacatgaaatgagatttacagcctagaggacttgggacaagacaaagctgagaagctcgggggagactagaaatgcaagaaataataaaggtggagggagagaagttttggaggaacccacagagaagaatgcaatctgaggatgtagtagagagagatggggccataaaccacggaatgctgacagctcccagaaactggaacagacgaaagataaattctcccttagagcttttttgggggagcatagccctggtggcacagcgatactgacttctgacctccaacacttgagataataaatttctgttgttttaa

SEQ ID NO: 217213 - DNA, 250 bp, Homo sapiens
aatataaaatttctctttaatttattataagcaatgtattctatttcctgagtaaatatgtttataagatcaataatgtactggtacttctttatgagattaaagaaatactctgataaaaattttagtgatggaaacctgtaaacagcaactgacgtttgttttcttattagtataatttaacttactaagaagaaaaattaaatttgtaataaaatattgtgattaaagagcttgacagaaataagaa

SEQ ID NO: 217214 - DNA, 248 bp, Homo sapiens
gcaatcaattgtcacaaataaaaggcatcaagatggtttccttttccctagaaaaaagattgagttgcatctaacaagtgtggacaaagaaggggaggaagagactgaacatgtacgaatagaacctgccgactgcatttcttgtcattccccattttccaccccagagtggcatcttcctgaagacatttcaaagcacaaattttatgtataaggagaataaatgaatacaatgtattccccaccct

SEQ ID NO: 217215 - DNA, 479 bp, Homo sapiens
tagtgcatccttaaattgcagtgactcatagcaacaattgtttactgagccctcctgactggccatgggatgacagtagttaacaacaggtcagacatggtctctgttgtcatggagcttatgccaaagtggcgaatgacagtcactaagcatgtctattacaagtataattaatttaacaaggaagacaaattagtccttcatgtgttccagaaggcaaggcccctagtgtggttggtctggtggagctgaactgcaaaactgtgtggagatgcttatgtgctagacaccaattgttttatccctccagtatatccccttttttcctcttaagtccgtgatttctgaaggagttgctgtgtcttacatcagtgcttttcaaactacttaaaaatttaaatttctaatctgtcacaaattgacatcctgacaaaatacaaaatcacctgcttgagtgtcacaggcatgtcaaattgtta

SEQ ID NO: 217216 - DNA, 578 bp, Homo sapiens
aattcaaagcactttgtaattattatgtaattagtctgcataatagcctaattgataaggacatgagggcagcctcattgttacagatagagacatacaaatgtctatgtcgtagtgttgtaggaaaacccgggttcttgtcacacgaccaagataatttaggcatgcggatacattgtagggtgagaagggcagcatttattgtgtgaaaagaaataaaagggaaacagggactctcagcaaaggtgagagtcctgctagcaggctttgcgcttcacagattgaatccccttttaccacccaggaacaggagagggcaggctcctccttcctgcaatgggtgctaactccccaaggctccaccacatcctcccaatgcacaggcaggttggagattctccagggagccctttttacttcactgtctcaatagcttacataacattatgttattattagacatttgtcttatttacttttatgacttttaatacactcaataataatgactaacatctattgagttgttatttcttgcagccactgtgctaagcccttaacattcaggatctttcttt

SEQ ID NO: 217217 - DNA, 740 bp, Homo sapiens
cccttctcactcataggctcagggaactttccaacaaggtccaatacaggactaggagttctcaaagtaaaaccccaaagtattcaacatcaagcttcctgcaatatcctacctttgtcagtgaaaagcatagctgttagttttcattattattaccaaagaccatactgccatttaagtgtcaagtcactgaacatagggggcacctgtgtcttcacagcacaaaagaacagggcaggagctggcaccaccctatggagccaggcccatgagcctttgccaagcgggaaagcgctttctgctcatccatattttggttcacttccaggtggaccacaggtctgtttccagtaaccaactgcttacttacaagaaaaaaaccttgctctagagctgaaaggcaaaaccatgaccattaacccaggatcatgaagaagaattttaatgaaagtagaatggcattatgaggaggctgagactcattttaccagaggacatcccaacactactctctcaaccttaaaatggaatgaactgcacccaagaccagcttaagactcttagagacattaagtactgaaaaggttataggcccctctggatctataatgaaaatatttaaatactaaattataaagtaagtgcaaagatgttaaacaagtttctaatctttcccatgactacttgggtgttttttcagaccaataacaaatattaaagtgtctcaattttttcctgga

SEQ ID NO: 217218 - DNA, 487 bp, Homo sapiens
atccaaacttgtactgatgatggttgatgaatctccagatgtttagttggtcaaaatgaattatctccttcttgccccggtagcttgaggaccatatgaaggccttcacttgcccccatctgtaactgggcgtagatgagggtactcagtgaagagtgtaagggataattagaagtttttgtggtatgctaaactaccttttgaaattgtacttgctgtgattctttgactagaattttgtgtctcaaggttaagtccatttttcaaggcttcactagtattaaaatggtccttatagatggaatctcttactctgttaatggttagggtgggctggttattgtctcctaagttgtatgttggccaggtgaggtgggtcaggcctgctatcctagtactttgggaggtagaggcagaagtggaaggatcgtttgagcccgggagtttgaaaccagcctaggcaacatttaagagaccccatctctta

SEQ ID NO: 217219 - DNA, 1181 bp, Homo sapiens
cagggggctggcgccaggccctgcccctcccttgccagccgtgtgtggcaacatcagagtgacagccagtaccatctccgacaggggctgagttgctggagctgggctggggcaggggagaaagacagcagactcatccttgcacccctccatgggcctggccaagcccccaagaggatggcagcctgggcgtcggagccacctcctgggcagccaatgaggtgaggggccggaggagcaagggacaagaggagcagaggacaggtgatggaaatcctgcagctttaggctccattctgccatctacatcccagcgcagggtgaagcctgagagcccaaatggccaactccacagggctgaacgcctcagaagtcgcaggctcgttggggttgatcctggcagctgtcgtggaggtgggggcactgctgggcaacggcgcgctgctggtcgtggtgctgcgcacgccgggactgcgcgacgcgctctacctggcgcacctgtgcgtcgtggacctgctggcggccgcctccatcatgccgctgggcctgctggccgcaccgccgcccgggctgggccgcgtgcgcctgggccccgcgccatgccgcgccgctcgcttcctctccgccgctctgctgccggcctgcacgctcggggtggccgcacttggcctggcacgctaccgcctcatcgtgcacccgctgcggccaggctcgcggccgccgctgtgctcgtgctcaccgccgtgtgggccgcggcgggactgctgggcgcgctctccctgctcggcccgccgcccgcaccgccccctgctcctgctcgctgctcggtcctggctgggggcctcgggcccttccggccgctctgggccctgctggccttcgcgctgcccgccctcctgctgctcggcgcctacggcggcatcttcgtggtggcgcgtcgcgctgccctgaggcccccacggccggcgcgcgggtcccgactccgctcggactctctggatagccgcctttccatcttgccgccgctccggcctcgcctgcccgggggcaaggcggccctggccccagcgctggccgtgggccaatttgcagcctgctggctgccttatggctgcgcgtgcctggcgcccgcagcgcgggccgcggaagccgaagcggctgtcacctgggtcgcctactcg

SEQ ID NO: 217220 - DNA, 207 bp, Homo sapiens
tcttcaaaagattctaattatacccctgaaactctgagaggtttagggtgtctgctgagacagagaagagagaaaacccttaagcaactcctctcaactgtctttgggggttgatgtcttggtcaataactgtctattgaactcctacttctccaaaactataaatgatgtataaaaataaagtccaaatggcacacacccagcaaa

SEQ ID NO: 217221 - DNA, 508 bp, Homo sapiens
caatggtaatctgggtgtacaataactgtaatagacaccccaaaacttgcaggggagaagcaagcattcaatcaccagtccttcacattctgaaacagttgggcatgtgttcccagtttcttgattagggccccatccctaaaaatgattgtccttagctcttaatttcttatctattggtttatatttcattccattagacagaatctacacccacaattatcttgaagataagccttcttcttttcgacccttgtaaagaaatggtgcaactatgcttttaagaagttagaagcgttgttgtctagccaagagagtcaatggggcatgcacttagattcttagagaattttttgctgaacttagaaggcatttgaaaaaatgctttatatctttctgaggtcttaacaaaggcctttctgccacaccctggattcccagaggccatgttttactggcaatattccggatttctttgatctttgtcctgagaccatctattactttg

SEQ ID NO: 217222 - DNA, 497 bp, Homo sapiens
ccagcttccactaagaaaatgctccccaaacgctgccttcagcctaccctaagagtgataatgaaatatgacagaaatttccttctgctggatcagtggcaagagaggtcctacaccgcctatattaattcatctgacttatgttccaggtcttgatttaccttatgattaaaaacttctgcaggtttgctcaccaattgaaatcagatctcatctgcagcccagcggtattgatccctatttaacatcaaggctcagaattgattggcattgattaacaataaaaatgttccctgcatgtccagccaccaagccaatattctgaaggcagtgcactctggtgttcccctcattgaccaatctgaaaggagaaatgaccccacccgcaaataaacaatatattttaatgttattgtaactggatgccggaccggccttgcaaattgattttattcttgttgtataagataaatatctttaataaaattctcatttta

SEQ ID NO: 217223 - DNA, 557 bp, Homo sapiens
cagctctgtcagggccagactaacccacagacccctcttgtcacctgcatctgctgagccctgggagaaggggtcccaccctcttgtcacccgcatctgctgagccccgggagaaggggtcccaagcaccagttccacaaggaccacacctccagccagtctgttaaaatgaaatatagcaggtcactggcttataaagaaagatgctgccagcctggctaacatggtgaaaccccgtctctaccaaaaaatacgaaaatttgccgggtggggtggcgggcgtctgtagtcccagctacttgggaggctaaggcaggataattgcttgaacctgggaggtggaggccgcagtgagccgagattgcgccactgccctccagcccgggcgacaagagtgagactctgtctcaaaaaaacaaaagaaagatgctgtgaagtttaaaccctgcaaacagatcagagttttgaactcatggtctcaatctgtaatgtggggaggggaaatctcaccaccaaaagaccctggccacaagaccccctggccacgagagcggccg

SEQ ID NO: 217224 - DNA, 334 bp, Homo sapiens
tgagatggagtctcactctatcgcccatgctggagtacagcaacctccacctcttgggttcaagcgattcttgtgtctcagcttccccagcaggataattgcttgaacctgggaggtggaggccgcagtgagccgagattgcgccactgccctccagcccgggcgacaagagtgagactctgtctcaaaaaaacaaaagaaagatgctgtgaagtttaaaccctgcaaacagatcagagttttgaactcatggtctcaatctgtaatgtggggaggggaaatctcaccaccaaaagaccctggccacaagaccccctggccacgagagcggccg

SEQ ID NO: 217225 - DNA, 464 bp, Homo sapiens
tctccactaatcagatgttcaggtttatgttattatcattgaatctggttttctttccccttctgagtagggtggccatatattgtattatctaaacttggatactttggagagtaaaaggggcaatattagtaattagaccaggactgtctcaggcatgtggccttcctgcctctgggtgattggttcagcaattgttaccctcttccttggttttagtcattttatttttattttttattttttttttaagacagaggctcgctctgtcacccaggctggagtgcagtggtgcaatctcagctcactgcaacttctgccctcccgggttcaagcaattctcgtgcctcagccacagagtagctgagattacaggaatgcatcaccaggcccagctaatttttgtatttttagtagagatggggtttcaccacgttggccaggttggtcttgaacttctggcc

SEQ ID NO: 217226 - DNA, 515 bp, Homo sapiens
cacaccgatgtgtctggctagtcaatatttggaaaggggtcatagggcaaaatgtcttctctgtgtaatatttaaagttaagaattctgaccttggccgtctaaggcctttgcttgtgcacgcaagggcaaatgtgtccttaagcttgcagaaacatttcttaaatatttcacttaaacctaatttaagtggacctctggagaaaagactgcactcaactctgttccatcatcaacataacaaaaattagttacacaaaacacactgaaaattcaaggcagcccaaagcaaaagccagtgttggtcacagttttcattagataagtcacattgctatttaaaaaaaaaaaaaaaagtttaactaatgaaaatttatgttttaaaatgctgatttcatgagattagccagcctgtaccctatacaaattaaatccaactatctcaaagtggcacctgcaatagtagcaaactttttttttaccaggaaagtctatcgtcaggatggcatctaccta

SEQ ID NO: 217227 - DNA, 627 bp, Homo sapiens
aaaggtccagaataccacagcatggcccggaagccgtggctgggccaaagggtctggctgaggtagcagaaagtggacccagggagctgtaaaggtcgtggccgatggtgggggactttgaatccaaagctgaggagcttggactctggccactctccctggggggattcctccacatgggggattccgagtagaagtcaggcaggagggtgcaggatgatggggtgggggggtaggctggaattgggaggtcagggaggaggaggacgctggaggacacactgctgggaacggcatgtcagggaggggagcgacagctacccagtgcagaggcctgctcacattgcttcttgacttccaaaactctgctcacttttgttttaaagctccttttctctatatttatgcaccaaaatataacaatataattacacatatttctatatgcttagctatttttcttcctgggaagaaacatgataaaatttgggggttctgaaggctttatcccagggtcctttcatcccatcctctgttttcacgcagaattatgtataatccattcccaataaaaaagaatctggaccagatttgaagaggtcctgcgcacaaggagatctgtcacct

SEQ ID NO: 217228 - DNA, 293 bp, Homo sapiens
ttttttggtatttgtcatgttttcttagtgtatggtaaaggattttaccactatgtggtcattaaaaagaatgtcatcatcctataagcatcaacactgagttactgccaagtgaaggaaattgtagaacaacatgcataaaacggtcctatttgtataaaagaatacatgccctcccacaggtatctatgtgcaagaaacaggagcaaagcaagatacagaactctacatcctatatgaaaaaatttacatgatccaaccccgtatttgtaagtatctgcatgcgtcgacgc

SEQ ID NO: 217229 - DNA, 540 bp, Homo sapiens
ctcagtatataacacatactgtccccaagcctggatctgcaatacataacaatactagccttttttattaaagtgattttaaaagataaggcaggatgggaccatttattttacagaggtttcactctattccagtaacttctcaagcaataaaatatatctatgtctcattactacaaacgccagactatcaagtttcaattattcagccaaatctgtaacatttccattttatttgaattaaatgttaattatcttttcgatgtcagtaatctaactagcatgaagatttttcttaagaataaggtgaaacataaagcaaagatcttataaacacaatttgtctgcacagcatattcagtatccttttccctgaggcatagaaaaattatttcaatagcaattagtatcatataaggaaacaaagagccccagaaacacagtgtagtttctaaaatctgaaaggcacttcaagtgcagttaatactgatgcatgtctgtccactccaaaacatatcaagctcttattttctgcgccag

SEQ ID NO: 217230 - DNA, 683 bp, Homo sapiens
cacattatttatcacattatttattaagtttcttcagtcacagtccatctcacagaaagaaatcccccatgagaaacttttaggacatagcttttatgttaattacttaatttctgcactagccatccttgcctgccttctaattttctgcactagctatccttaccttccttctaattttctaacctgccaaggattctgctgcctcaaggtatttgtttctttctgcctggattgctctttcgcagatacttacatgtctcattctttttcacccaggtgaaataaacagcgttgttgctcacacaaagcctgtttggtagtctcttcacatggacgcgtgtgacatttggtgctgaagacccgggacaggaggactccttcaggagacgggtcccctgtccttgccctcactccgtgaggagatccacctacgacctcgggtcctcagaccaaccagcccaaggaacatctcatgaatttcaaatcggattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgttccagaataaagctgtgcccatcggaaaaaaagc

SEQ ID NO: 217231 - DNA, 499 bp, Homo sapiens
tgctgcttattgagtgatgaagagcaacatattagctactgagatattttgcagaaaaaggaagagatgtcttcagctcaaatgctatcaaacttgtgaaataaacagcgttgttgctcacacaaagcctgtttggtagtctcttcacatggacgcgtgtgacatttggtgctgaagacccgggacaggaggactccttcaggagacgggtcccctgtccttgccctcactccgtgaggagatccacctacgacctcgggtcctcagaccaaccagcccaaggaacatctcatgaatttcaaatcggattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgttccagaataaagctgtgcccatcggaaaaaaagc

SEQ ID NO: 217232 - DNA, 693 bp, Homo sapiens
tgctgcttattgagtgatgaagagcaacatattagctactgagatattttgcagaaaaaggaagagatgtcttcagctcaaatgctatcaaacttgtgaaataaacagcgttgttgctcacacaaagcctgtttggtagtctcttcacatggacgcgtgtgacatttggtgctgaagacccgggacaggaggactccttcaggagacgggtcccctgtccttgccctcactccgtgaggagatccacctacgacctcgggtcctcagaccaaccagcccaaggaacatctcatgaatttcaaatcgggaccccactggaaatcggactgtccaacccggcagccactcccagggcccctagaactctggccaaaggctctctgactgactccttcccagatcttctcagcttagcagctgaagactgatgctgcctgatcgccttggaagccccctggaccattacggatgctgagctttggataactcttacagtagaggattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgttccagaataaagctgtgcccatcggaaaaaaagc

SEQ ID NO: 217233 - DNA, 785 bp, Homo sapiens
cacattatttatcacattatttattaagtttcttcagtcacagtccatctcacagaaagaaatcccccatgagaaacttttaggacatagcttttatgttaattacttaatttctgcactagccatccttgcctgccttctaattttctgcactagctatccttaccttccttctaattttctaacctgccaaggattctgctgcctcaaggtatttgtttctttctgcctggattgctctttcgcagatacttacatgtctcattctttttcacccaggtgaaataaacagcgttgttgctcacacaaagcctgtttggtagtctcttcacatggacgcgtgtgacatttggtgctgaagacccgggacaggaggactccttcaggagacgggtcccctgtccttgccctcactccgtgaggagatccacctacgacctcgggtcctcagaccaaccagcccaaggaacatctcatgaatttcaaatcggatcttctcagcttagcagctgaagactgatgctgcctgatcgccttggaagccccctggaccattacggatgctgagctttggataactcttacagtagaggattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgttccagaataaagctgtgcccatcggaaaaaaagc

SEQ ID NO: 217234 - DNA, 547 bp, Homo sapiens
agaaagatacttgtgatctcattctcacaagccacaaacttcatgggacgatgagtatctgtttatcaggggaaatataaacaataagtgtgagttttagcagtgcatgtattaatattatgttgaaaattgtattgttaaggagtaaaagagaaaatagtgtaactaattttaaagaaaccttcaagaatttgaggatgcttttataaatgcaagttcctgaatatggccaaaacacaacacctcagtgaatttaaaagagtagatgttttaaaagaccggattttaaaagaatgactgaacatagccaagtaaatattcaaagaattataaaaagaatatcaaagtagactagaaaataacaaatggaacaatttgtaaaaatgaaagccataaataatgaaatgtagaacaagacacagtgcaaatgatatataaagccaaaagttcatttttaaatggcaaaaagaaagagcagaagagagagagagataaacttctggtaaggcatttaaaggaaatagaagagaaagagaaaaaagaaaaa

SEQ ID NO: 217235 - DNA, 681 bp, Homo sapiens
attttctaaaattagcaagtctttgggagccattccaggacataggtgagcttaatcttcttcaggggtcaacactgttcagagatgaccactgagcctggtggttgaattgattcccatcagagcatttagggactggaaaggagggactcaacatttcttgggggtttattatggataaggtagcctgccagtgtcttcacatggattattttatttagtcctcacagaatgctacaagataggtataattatactttccatttatactcagagaaattaaggcatggagagcatcccccaacctcccccactacccattagcctcatactacacctgagcctccccacctgtggtccaataaagatgctgccattggtcagaagggagggatgggtggctgcctgctggaattcctggcacttcagctatcacccaacattaaagccaactggacaacccagggtcatagagggcactgtgtagacccaggtagcttgtgaggtcatgaaaaagcatatgtggttaagagagtactggaattggagccagaagaactagattcaagtccctcctgcacttcacactagtcgtggatcctgagtaatttgttttgtcactctgagcttcattttttaaatctgtaaaatggggatggcaagtcatacctcacaggattg

SEQ ID NO: 217236 - DNA, 533 bp, Homo sapiens
cgcccccagcgacaggaaagagggtcggacggaggcgccggcctttccccgggtgacatgggctgagcgccggagcccggcggcggagcggccctgggcgagggtttcaggactggagacaatagtcaaaggggccgaatcgaggagctgccctcgctgacagtttcgccaaagtctgcctgactatatggcctgggttatatcactagagtgaccagagggaaaggaagaagacatcaggcccctgctgaccccacctcctcagaacggaacccgcagtcaagccagagatatcccataaaagagcaacttacgacgtctggagtagcagcgggcgtgagagggcagaaccaaattacagcttccagctgccatttaatgataatgtcccttactcggacataactttgccttttacaaagcccttttccatgttatgatctcgtgggaaccttccaataaccatgtgcaccctaccttgtgtgggttttatcccattttatagacgggaaaataaaattgaaacacagaat

SEQ ID NO: 217237 - DNA, 619 bp, Homo sapiens
ggactcttggggctagctgcctcatgcccctgcagaggtcccagcagcagccatgctcgaagcgtgagctccagttctgtggggcttctcctctgatctgggtcttgaaacgccacggcttctcttttgttccttaaatctcaggggtggggtaattacatcctgtcacggaaccaattctatgaattaaattttctttgcttgaaaaaagtggggaaaagtcttgaacaggcatttttctaaagaatatatacaaatggcaaatgaaaagatgctcaagatcactgatatttagggaaatgcaaatccaaaccacaatgagataccacttcccacccattaggatggccattatcaaaaaagcagaaaacaacaagcattgtcaaggatgtggagaaattggaaccctttacattgctgttggtaattttaaatggtgcagcgggccgggcacagtggctcacgcctgtaatcccagcactttgggaggctgaggcgggcagatcacctaaggtcaggagtttaagaccagcctggccaacatggtgaaaccccatctctactaaaacaaaaattagccggacacggtggtggcacatgcctgtaatcccagcttctt

SEQ ID NO: 217238 - DNA, 359 bp, Homo sapiens
catccttgtccatgtagacacactaagactaggaggtccctgagaaccaaacagacaaaggccttgaacatcattagcacgagatgatccaaaccaaagaaaccttgagacaaagcaaaatttggggtgggaatttatctatctgcaggattcttagtgcaataattttttaagagataaagtagagcagtttggtttctaaacttgtttttgttctcctgctgtaataacaacctcagtttctgccaaaaacttatgtggcttctcttctgagtaaacacctgctggtctgttttctgcagagcagaccacggggcaccttcactaattttattgtctccttcagaggaaatttgcgt

SEQ ID NO: 217239 - DNA, 684 bp, Homo sapiens
tgcatgttctgcacatgtatcccagaacttgaagtctaataaaataataaaatgtgtatatatatacatatatatgtattcaagactggaagaaatgtagaggaaagagatatgtgaggcaagactggatgcagagggcggcagcagtaacagagtgtatgtgtattgaatacttacagcatgccaggcaaaagacagagtggctagacatattatctgatttcatctctactacaatcccataaggtaggtacaattttccccattacacaaagaggatgttggagcttcaagagattaactaagagatatttataagttattatgacaagacttatgtgcatttgatatgggaaggggaaagaaaaagtgaggagtcaatattaacatccagtttcacagcttagttcagtgagcagatagtaatacctatcactaagatgggcaaaacaggaataccaaaaggttttgatggagaaagagatggagttgatgagttttgtttgagacaggtttagacctgttgagttggggaaaagaaaagagttagacatcaattgtcagctgggtgcgcaaggctgaatctcaagagagaaatctgaagtaagccaactcatgtagaaagcatctacagatagataatcacagccatatgagtccttgaagatatacagaaagagtgtg

SEQ ID NO: 217240 - DNA, 329 bp, Homo sapiens
tgtgcccagtgggaaccttggaaaatagctgactatagagctggaaagttgggatagttgagcaagtaaccttgtggatcctgtagctaagagctgcagggcccaccagaccttactggggacctatagctcttcctagaaacaaagtggaggcaaatcaccaaggaagagacactggcccccagcccaaccaaaaaaacagatgatttgttgccgcaggtttggtgagcaagcaccacagaagaccagctgcccagaatagaaaccagagaagatgcaggaataaagtaattttatatacaagctttgattaaaacttggaacaaaga

SEQ ID NO: 217241 - DNA, 286 bp, Homo sapiens
catcacatagaagttcaggctctgcttctgatctgctggcagtaataatttatactcagcaatgtttctagaaaaaataaataatagtgaaagcctttctgggagctttcaatgagactgttcatcccagccctgaacttgcagctggccagtcctaggtccctgctgcccatctcctagcaattccggaaaggactgagagggagtcaggcagaaaagactggccacagtggcccaccaaagaggacagtgtggccacagattaggatgtgcctgatagttttaa

SEQ ID NO: 217242 - DNA, 424 bp, Homo sapiens
tagctgagcatggtggcacatgcctgtaatcccagctactcgggaggctgaggcaagagaattgcttgaacccgggaggcagagtttgcagtgagctgagatcatgccactgaactccaacctgggcaacagagcaagactccatctcaaaaaaaaaaaaaaaaaaaggagtgggcagataagcaggctacatcaccagaggtcacagcacagggagagggacagagggaggaagcaacaccaagtaaattaggcgagggaacctgtgtgaagcacatagcagatctctggtgaaggctagtcaaaggttgcacactggcagcctacaatcatgctttgactcaaacaatcgtttagtttctttaatttagttgccaacatttaaggagtcagaagtcttcattgaaaaaaaaaatccatattg

SEQ ID NO: 217243 - DNA, 604 bp, Homo sapiens
tgtatagactctgtatcatgagctgtgatattatttttgtttttgtcttttaaattaagcctcagttgagcccttgtgatgtatattaaataaatacattttggtcattaaaaaaaaagtatatctcaagctacaatgaacttagaaccagacttttagaatatcacctacacctaagctgaagactgtttatattctagccattcctgtttcttcttacttcttcacatgtttaattcctggcatctttcagggctgtatttggatatccaggtgggtagcaccagtaatgctgcattataatcatctatggttggtatatgtcactacagtaaaaactccttgagactgcttgttcattattgtatgtatagtgccctgcaagataactggaattctccaaaactcaattgctttgtataatataacaaaatagctggttaatttattttcagttattcaggtgtgcattttgttgcaattcataccggtgggtttgccactatatgcatggatttgtcaatgtgaaaaattatgttacaaaaaatcaagatgaaccataaaattgtatttaaaggtgttctatgatacaagtgactgaaaa

SEQ ID NO: 217244 - DNA, 398 bp, Homo sapiens
actctctatctgggtctccccctgaatgcgacaaagctggactgtactgctgccatctcggctcactgcaacctccacctcccaggtaccagtgattctcctgcctcagccacccgagcaggtgggactaacaggcgcgccactaacacctcctctacctttcttcctgcccactgttctcctcctcctccttctttcttcttcttttaaatttaagctttctttattctgcaaaactacaaaactagtaagtcaaaggatatggattagaatttagatatcttagactggaaaacctatatattactttttaaaattttacttcagattctttttatgtctaacctactgcctcatgttctcactcactaaaggaaaccaggaaattcatacctaca

SEQ ID NO: 217245 - DNA, 456 bp, Homo sapiens
tggctccaatcactgcatcccgccaggcttcgctcctctgcggtttccggcctcgggtcccaggcctgtccccgaggctccccgcctgacctccgtttctgtttctccgtctccctgccatctccactggggtctcgcccactcccactcgggtctctgcaggaagccgtgccctcctcccaccctctttgatctcccgtttcaaagccgctctccaagggaggggaggtcgctccttccgcccgttttacagctcaggatggtgacacctgagaccctgctccgccttctcccccggcacccatcctcccgcctatctaggtggtggcgcagctcgccagggctccgcgcctctgtccccgcctccctcccttccccctactgagaccccctcggggtctcgggagtgaagcgacagagaaagcgttttaataaagaccttgcgtcaagtgattg

SEQ ID NO: 217246 - DNA, 499 bp, Homo sapiens
tcttttgagacttaataggccgggacttctgggaagccaatttctgtaagttcgtggtgtagagagttatatataattaatgtgctattattattattttttattgcaagggtgtagtattttaggaacctttgaattaaataagctggtgggcttacctgggaatctacagttttattataataatgaagacagtgcaatatgagctgcaaacttgtttttgtccattaacttatggagcacaatctgcttttttttttggtctttctttttgagacagggtctcactctgtctcccaggctggagtgaagtgctgtgaattcggctcactgcaacctctgcctcctgggctgcagtgatcctcctgcctcagctacttgagaggctgaggtgggaggatcacttgagcctaggaggttgaggctgcagtgagctgagatcacaccccttgtactccaggctgggctacagagtgaaaccctatctaaaaaaaaaaaa

SEQ ID NO: 217247 - DNA, 390 bp, Homo sapiens
gaatcttattcctgttttcatttcatgatgtcataatatttgttgaagttttatgtcaagcatcatttaatttgaatgattcttctttaaagaatacagaaaaatgtggtagtaatattcttcaagaaaattagctattgaacattttccctatattctattatttaaaaaaaaaacacattcttcatcattatcaaatttcatgtatttattcaaaatgctttgttaagtacaggaagagagaaagatgatgacaaagacctgcttcggtctaaatatggaagatgttttaaaagttcagcccaaaacatgtcttactcaaccttgtattatcatcatttagcaaacaggaggggcttattaaaggtttttgaagccagccatggtggc

SEQ ID NO: 217248 - DNA, 789 bp, Homo sapiens
actgactcaaagccctgtggcctccttgaatgacacaaatgtgaggcaagattttcctgaaaatagcctgctcccagaggaaaagtgaattgcaccatcaaagaacaaagacagactggaaagtatgtgatggacctcagatgtccagagactgatcttgaatatgatcctttcctcaattattctgcggaggtacttggggcatctaaagcaaagcaggatgaggctgatcaacagcacttctgccacttgaaaacacctgtgagtgaaggtcgccacacatccctggagagccaaaggccttctgtttcaccaataagaagtaaaacagatctttaagaatctgaagatgatcttataatagatgtacctccagtcatgcctacttctaagaaatctaaactatgtagaggcttcaaacatcattataaggataaatggacacatatcacgcccccggaggagaaaaatcttaaaattagtggcacagaagaagaaaaaaacagataaaacccaactaaccacacaaatagatgatgacagtaacaaattacaactacctacattgctcatgaaaacatccccaggtattaaaactaatgtaaatttatatcattttaaaacagtacctaagaaggaaaaatttggggatgaaaaaagccatgactgtattttagaaggaggttcatcttctgcacctctcaatggcaatgaaataatgaaagaaagttgtaataagaaagttacctaaagaacaaaaaacaggtaaaaacaaaattatgatacaca

SEQ ID NO: 217249 - DNA, 429 bp, Homo sapiens
gggcatggtggtgcacacctgtaatcccagctattcgggaggctgaggcacaagaatcgtttgaacctaggaggcggaggttgcagtgagcgaagatcgtgccactgcactccagcctgggtgacagagcaagactttgtctcaaaacaaaacaaaacaaacaaaacaaaacaaaacaaaaaacacgttaaatgaaagaaaccagacagccagctagtgttgccaggggctgtgtatagagtgtatgaacagtgactgcttaatggtgatgagtttcctttggggtgatgaaaatgtcttaaattagacaaagttgatggttgtacacattgtgaatgtagtaaataccactgaattatgtggttaaaatggttaattttatctcaatttttaaaaaagtccttgccagcagagaaaccctgggaggca

SEQ ID NO: 217250 - DNA, 300 bp, Homo sapiens
cttctgctcttttagatcaatttctaagtgccaagaagagctattactcctttctcctagcagagaattccctaagatagaaaatgacacatgtagtcattgtataaattcttttattttcctgtaagcatcttgaccctctactatttgcagctgtttctggggaggagtagtttggataaccaacaaaccttgccacttcttcagtgggactcaaggcagcagaagaagactactgtctaaggatctgttagcttttacccagggtcctatgtctcttcatatgctgtgctttaaaaa

SEQ ID NO: 217251 - DNA, 310 bp, Homo sapiens
tcagcttgcagcctcgctgcccatggtgaaaggtgattttttttcaatctctatcactctgtgtaggtggctgccttttccactcagcagaagtggttctcactagttgcccaatgtatttaaaagtgtggatttgtatactgatgctgtatttttgttgcattaattttttttaaatcaaagcaactcaggttcatggaaacaaatcaactagtacagagagcttatgttgaaaaggggcttggaccagcacctggcacatagaaagccctctatttgttgaatgaatgaataaatgaatgaatacaaa

SEQ ID NO: 217252 - DNA, 515 bp, Homo sapiens
tacggttctcagcccctggatgagggttcctcgatctgggcactgtgggcatctgaagctggataatggtttgttgtggaggcctgccgtgtgcatcatagcatgttgaacagcacacttggcatctatccattagttgccagtaatgcccctccatatagttgtgacaaccaaaaatgtctcctggtattgccagtgtcttctaggggcagaatcactcccaatagaaatccattcgcttggactaatttgtgtttcctgtcttcaattccccatacctccctataattaccctcctataataatactcactgctcttcaacagtcatttttttccctcttttccttctttccttccttcctctctcttttctttcttctttctttctttctttttctttctttctctttcttcctttctttctccttccttccttcctttctttctccttccttcctttctttctccttccttcctccctttctctctccttcctcccttctgtcgtcttctc

SEQ ID NO: 217253 - DNA, 310 bp, Homo sapiens
atacatacagggctcatttttccttgcttttcagttttcacttacactactttcattagccttcttgcagcccattcagacccaagctcacttaccctttgaggctcatctgaaatcctaacttctccatgaaaccttctctaattattctaaccttaagagtacttgtttgacacatctcctaaatgtcaaagactatttgaacccagatctacctgacttcaaagcttgtgtagctttgaaaactactcccgagtaggagtgattttaaagtttcagtccaattcaaatattcagcttcctcaaattt

SEQ ID NO: 217254 - DNA, 607 bp, Homo sapiens
cctttccagtcccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaacaaaaaaaaaa

SEQ ID NO: 217255 - DNA, 799 bp, Homo sapiens
cctttccagtcccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaacaaaaaaaaaacacaagacaacaccacggaggagaagagagaaggcaggcaagccggggggccaaattaggaagggcataacaaaaaccggctatagagggtgacaagttggcaatgacgtatttggcacacaattttgggaaaaggggtgtaaatgggggaacccaaggagaggaatataagtaaaacagggattaccggta

SEQ ID NO: 217256 - DNA, 474 bp, Homo sapiens
acttcttgcaaataataatatccacacaggaaacctaaatattaataatgaagagttaaccgctccctgatgtttgaatggggctttaaaaattcctatttcacgtcatgaagtgggagaaggcctaatggtaatgtttactttctcaagaaaatatctagttaaaaggggccaggtatgtagcaaagagacagcaagaggagccttccgcagtactttaagtaactaaggggactgctccaccacccatgagcccatctgtgcatatctctgcacacatacacatgcatgcatgcattcctccctgtatgcccatggatgctagagctgacccttttctacagaagtcctggctaccttgacatcctactcaggtgagtgctgaaagctgatcctctgcattgtccaaaacttggattttcatccatttgcccgtgattttttatgaaagaaataaacagaattgtagcctga

SEQ ID NO: 217257 - DNA, 173 bp, Homo sapiens
actatggttgcctgtttgctgttgcttcttgtggatgtacatctatgtctttgcactaaaggattacttattccagtcttctttggtgtgttttggtttttattggatatatttgcttagaggttctttactgcttgtttactgcctcctttttggctccgggtggtgcctta

SEQ ID NO: 217258 - DNA, 282 bp, Homo sapiens
agaccacagtgaagctgttagcaggatgtgaacagagttcacaaaatcaagggtttgtttacataccagccacagcacgaagaaacaaataaggtctaaatgcctgttgtctcatctgtttttgtgttttccttgcgtatttcttcccaagctcttaacaaacgggtaatgggtagttaaacatttgcgaccagttactcatcttgctttgcagtcatagagctggtctaagtggagcagccagtaacttcaaaggacaccctagtttggatctgtttccca

SEQ ID NO: 217259 - DNA, 235 bp, Homo sapiens
aactaaagttaaataatacatgtaaagcagttagaacagtggctggcccagagtgacctctcagtaaatgttagtggtcctcctctcccacttaaaaatgtttgcacagctctgggcatcatggggactttttaaacaaatcaagccctctcccggggctagtttctagttaatgaggctttgctgttttcacagtgagtaaatacacattttccaccccttcttttatattgtt

SEQ ID NO: 217260 - DNA, 326 bp, Homo sapiens
gaggaacggatcaagctaggaagcacagaactgcaggccagagacaactctggaagcagaaacaggtgtgtgcttccaggcgcacagacaccaactgtgtgacacccacaccttctactcacaaactcactattgacagtgcaccaccacctgctttgtgcaacacaggaaacaccaataaacactggagacagtgtcaggccaggcatggtggctcacacctgtgctcccagcactttgggaggctgaggtaggaggatcgcttgaggccagaagttcaagaccatcctcagcaatacagagagaccctatctctacaaaaagtt

SEQ ID NO: 217261 - DNA, 251 bp, Homo sapiens
tctggacagtcatgtaaaccaaaaatcacggtgtgacgattgctacctagtggtctgcagaggatgctcagagagcacatagggagagagatctaatctagagcagggctgatggccacagtcccccttggaggtgcctgcctaacgtctgctttctgtatagtttcacatgctgcatctttttaacatgtcttttgctgttttctgatccacattttgttagatcactgaccctaatagatacaattata

SEQ ID NO: 217262 - DNA, 518 bp, Homo sapiens
caaaggttgttaaaaggtgcagatgaaatgttggggtggaaagttggatctggggcatatggataaatagcctgctcccatgaatattcattatgatgagacaagctaagaaggtctgagagaccttctgataggagattgagatgcaatctcttagcatagctagttggagctttttgtagctagagagactgaggtgctaattaaagaataaagcagtatccagtttattgagtttctgcagtggaatgtttaaggataaattgttttgacatcatgctctgagcttgttggtcaaacttcatacctctgagaggactggatggaatgattagctgagcctcagtttattcagtttattatttttatcactgttttaaccttatgcagaatattgatctgtctgcaattttagcatatgcttattttagtgtagttgtctttagaaattctaaaacaagattgctagatttctcattctccttagcatagatatttgaaagtattaataattactg

SEQ ID NO: 217263 - DNA, 354 bp, Homo sapiens
tgtcctgctttgttttctccatggacgtgatgcatcttagggacaccctcttgtgtgatgcctcggcccaaacacagctttagaaactcacctacatgagctgcttaggaatgaaagcattccagtggttaatttactatgacatctgtatcctaagttaactgtcgggtagaaaaatcttaaaataagaactaaataaaaacctcctcctgccagtgtggagatgacatcaagaaggcatcacattctgaaactagacactacttagccacacggaactcctacctggacaggatgcctttgtcaacaccactcgtttatggctcgcattttcacacaggctgtttgttggtc

SEQ ID NO: 217264 - DNA, 466 bp, Homo sapiens
gttaaataattcatgatatattcatataataaacactatagagcaatgagaacaattgacctacagctaaaccccaaaatatctaccaatcttacatgtttattattgagtaaaagacactggatactaagaaatatgtactctaagattccatttgcctaaagtaccaaagcaggatagtagtcttgatgggtgtaggaggaggtggtagagcatgaagagggcttcatggaaactgttgtattctgaattttctttgggtgctggcattctgaatatatttagtttgctcaaatccacagagctgtatatttatgatgtgtccacttttctatatgtgtatttatgcttcaaagtaatttacttatctaacaaaatatggaaataaatataacaaaatatgccaaggactatacactgaaaactatgcaatatgccaagggctaataaatggtggaacatatca

SEQ ID NO: 217265 - DNA, 239 bp, Homo sapiens
aatgagacttatttattaccctgagaatagtatgggagaaactgcccctatgattcaattatttctgcctggccccacccttgacatgtggggattattacaattcaatttgagatttgggtggggacacagctaaaccatatcaacactgaataatgaaaatacctcatatcaaaatgtaggaaattcggctaaaacagcattcaaagaaaaatttgtagctttaagtatttgtagta

SEQ ID NO: 217266 - DNA, 621 bp, Homo sapiens
gctcactgagatagatgcatgtctgatcacctcagttgggaaaggctaatcagaaactccaaagaatgcatctgttcatctctcacccatctgtgacctggaagccccctccccacttcgagtcttcctgcctttgcttcaagttttcccgcctttccaaatggaaccaaagtacttcttacatatagtgactcatgtctcaagtctccctaaaacgtataaaactaagctgtgccccaaccacgctgaccatgtcatcaggacctcctgaggctgtgtcacggcctgtgtcctcaaccttggcaaaataaactttctaaattaactggacccgtctcaaattttcggggttcacagactcatgtgcaacaaggggtctaagcaggacaggttcgggggggtttcctattgttagcagatgtccccttctggaaaggggtgcaaacacccactttcagccaggagatggtaagcggttccctgatcccacctgcttctcctgagcagggtttatcagtacaggagagtcagggtatctgagagcacttccttccttacctggcctcagattctccacactccaaagtatgatgcatgatctgagttactcaagacaaaatt

SEQ ID NO: 217267 - DNA, 251 bp, Homo sapiens
agttctgaaaaatgaaggcagaatttttttaaagtttctgaaattaatgaaaataagaacgcagcttaccaaaatttccgggatgcagctaaagcagtgttaagcactgctttataacactaaaaaccttcatcaagaagttagaaagatctcagattaactgtctaactttgcacctaaaggaaccagaaaaaaagaacaaaccagttaattaaaccttggagtgaccagaagatcagagtttcctaaag

SEQ ID NO: 217268 - DNA, 346 bp, Homo sapiens
agtgctgcaccgcctcatcccgctgcaccttcgcgggcgggggagccaggatgattacattgctgggaggaagatgtttgttttgaaagcacccttccacagtcatttcaaagagaactcaatacaaagccaaagttaaaagtggaaaaaataataatcttgcctagccaaataataccacgccattaattagccccgcgcctgagagagggaggtggaaaggtaaacagagaccgtacgccaagagcggccagcgcatcccctgcgccattcccggccgccgcttacggcaaggcccccttacggcagcgtaagcagcgctgcgagctaatcacaacactgggac

SEQ ID NO: 217269 - DNA, 354 bp, Homo sapiens
cgtttatagtagtgaaaaaaagtctaggtgattaaaaatagtgattgactaaagagtgtcacacacacactcatatagcagatcgctcttcaggaatttaaatgacactccaagaataaatttaataacccaggcaagtagtggcatatgcagtagaaacccacttttaaaaggtgtgggtatatatatgtatatgaatttttatgtgtgtgcacaggaaaaaaacctagaataaacctagaataaataaataaatcggggtgaagaattacaaatgctagtaattttattgtttttggtttttatctattaaataatttttccaaaatgaatatgcattagctgcatgtttta

SEQ ID NO: 217270 - DNA, 160 bp, Homo sapiens
catttgagttttgtatttctccctttggataatctctttctaatttttagaggggtagaaaaccacagtgaatttcttagaaatgcagcttaagctacaaaagcagagaggtctttctttatagttgggtgcacacacctttgatatcatctgttttgtc

SEQ ID NO: 217271 - DNA, 272 bp, Homo sapiens
cctaatttttatggcatgacaaaagaattcataaaaaatgggaaaggacaaaacatgttggaaaaatatctgtaacataatttgcattaatacttataaaaatatatacacaacacatatattctcttttttttttttttttttttttgagacggagtctcgctctgtcacccaggctggagtgcaggggcgccatctcggctcactgcaagctccgcctcccgggttcacgccattctcctgcctcagcctcccgagtagctgggactaca

SEQ ID NO: 217272 - DNA, 278 bp, Homo sapiens
aacaaaagcctcacagcatagtctgagttgactattgtggatagagatgatgtatgatgtagtggaggtgacttactttcctcttcctaaattcgttaagacaagtttcttttttaaaggcgcttattggtgaccatttgctctgaatggcattttaaacagaattagattagtagaaataccttcctctaatatcttccaattttttttttttttgagacagagttccgaggttatatttgccgaaggctatagttcgaggtctattgttgcggttc

SEQ ID NO: 217273 - DNA, 605 bp, Homo sapiens
aacaaaagcctcacagcatagtctgagttgactattgtggatagagatgatgtatgatgtagtggaggtgacttactttcctcttcctaaattcgttaagacaagtttcttttttaaaggcgcttattggtgaccatttgctctgaatggcattttaaacagaattagattagtagaaataccttcctctaatatcttccaattttttttttttttgagacagagtctcgctctgtcactcagactggagtgcagtggcgtgatctcggctcactgcaagctctgccttccaggttcacgccattctcctgcctcagcctcccgagtagctgggactacgtgcacccgccaccacgcccagctaattttttgtatttttttagtagagacggggtttcaccatgttagccaggatggtctcaatctcctgaccttgtgatctgcacgtcctggcctcccatagtgctgggattacaggtgtgagccactgcgcctggccgttatcttccaattttcaagaatgtggctgccatatttcaatttggggaagtagcttatggattagccccaggtagtcactactgttactgagagttagcacaata

SEQ ID NO: 217274 - DNA, 301 bp, Homo sapiens
aagacggagttttgctcttgtcacccaggctggagtgtaatggcacgatcttggctgactgcagcctccacctcccgggttcaagcagtttttctgcctcagcctcccgagtagctgggatgacaggcaggtgccaccactcccagctaagttttgtatttttaagagagatggtgtttcaccatgatggccataatttcttttggcttctgaaattagaaatttttggccattaatatcttccaacaggcttttctattcctttcttcctctcactgtcttctgggacttctggtacttt

SEQ ID NO: 217275 - DNA, 361 bp, Homo sapiens
aagagagagagagagaaagatgggatcttgcgctgtcacccaggctggagtgcagtggtgtgattgtaggtcactgcagccttgaactcctaggctcatgtgatcgtcccgcctcagcctcccaagtagctgggactacaggcatacaccaccacacccagctaattttagttttttgtagagatagggtcttgctatgttgcccaggctggtcttgaacttttggactaaactgatcctcctgcctcagcctctcacagtgctgggattataggcatgaaccaccaaaaactgcagtttaaaagtgtttatatcctggatacactaacagcattttgtccaacttgtggagtggagggag

SEQ ID NO: 217276 - DNA, 297 bp, Homo sapiens
catgagactaatagattaaaatagagtctacttaaaagtgcttgtattcttttttctcctacatgaccaaaaatattgtatactaaatgtaaaagatcaaaattccttttatacaatataaaatattttataatacttcattacctcataatattccattaaaaggaacatagctttgcagtttgccttaagagagaaaataagtacagaccaagagatgtgttaccatgcaagactgatttttgttaaacttgaaagttcttagtataaacaaactaacttcaaaaaaactattaa

SEQ ID NO: 217277 - DNA, 438 bp, Homo sapiens
agaactctctacattataactttggattagcaagcattcggctaactaaacattttcatttatctcctacccctgattatataaagaagcagatgagacaaccaaagaaatacccctccaagacaaagtgaatattttgaaatacttcctctcagtcttttaaaaaatgtgatttaaaaatcgtaggtgggatcatactatacatgcacttgttttctgtttattttacatctctctatactagaaacactttcctatatatgccacaaaaactgtgaaagtactaatgattatccctcctgtcccttaatatgcttagctattgccccaatgaactcagactgtttccaaagttccgctgttggccgggcactgtggctcatgcctgaaatcccaacactttgagaggctgaggcaggtggatcacttgaggccagg

SEQ ID NO: 217278 - DNA, 352 bp, Homo sapiens
acagtgcctaccctgttggggtttaaaacccacaagggaggaccacctcctgcagcaccttctctcaaaagctccaggcccactctgcagaccaccaggacccccaagagctgtgcagcctcaccagcagctgatgggcatcactgggagggagtagagaaggctcattatgatggtcaattcaggacaaatcctttggaatagggagagatgcctggaagcttctggagaatggagaggtccccatttcctaacccaccattggtcctttgtcaccatattccccaccctctatgcctgagtggaactccgttaaccctctcattcctggagaactgcacaaaccacatct

SEQ ID NO: 217279 - DNA, 671 bp, Homo sapiens
caggcaggtcccaaaagagcgagccaaggtcaggccaggctcctctcatcacacgtgcctgaatccccatctctccaaacagataagtgagttagggtaaggagaagggaaataggggagtagaggcattctcccccatgacttctgcaggagaagttttgattttataaactcaagcagcaactggccaaacggtttcaaaaacaaaggttgtaaaaattctttagaaaattttatgttaaaaaagttctatttgatgttgtctgtgagtgcctggtctatggagaggccttcaaaagccaaggcacttctcaaaatgctcaaattgtggcccatgggccagctgctatttgtcagcagtgaacaacaaaattgggagctcatgcgaggatgaaaatcagttgcattgcgaagaatgctgttagttgagctgacatttgtgttttgtagcaagactttctcaatgaatgaagccaagtgctgatatacgtacattctggcacacatctcttacctagccatgcgctggcactttgagtagcactggcctcatgcctctggacatctcactccccgcctcccctggcagggcggtgatgggtagtagacagctggtgtgctggacatggtgaacatgacccttggcctcttcctgcccaggtgatcgccat

SEQ ID NO: 217280 - DNA, 602 bp, Homo sapiens
tgtttttaaaatgccaggattttaggggttaaagatcatatggggtagtttaggaagtttgtgactatgagatgaatttgtgaggtttcttgcctaccttttttcccccccagagaagggtggaactagattttaaaggcatctctactctgcttttgctgagtagtttcactgtcccttgagataccattggctatttatacctgagtctagtctaattcacatatatatatattttaaaagttgagagaacatacctattgatgtggttcaataattcatttgtcagggaatatttgatcttaattcctttctaataggtagtgattggatgtattttcctacttcctgtatgtaatctctttatgccatgctagttctaaccagtcccttcttttgaaagcttttctttctctgctttttaaaggaatgatggtgatcagcaggcattatgcagataccacgtgcctgaggttatggaggggaaatgtcacatgactgtatgaaatcattatatgccctattttgtatttattgatgtttctttttgtgggccaaaaatatgtttgtaatatatttagtttttttaaaatcatggtaat

SEQ ID NO: 217281 - DNA, 459 bp, Homo sapiens
gagaaaactgagttcgaaaaagtttaatttaatatataatcctatcatcactgtgctattcttcttcacatttaccatatctaaggtatgttgatcatttactacataccagtaactatgtgttcttttcatatttcaccttatcgaatattcattgttttacaggtggaaaggaacatttcagtggggcctgtggttaccagtttcatttgctatgaaatccttactgtttgaaataaaactttgtgcatttaaccactattctacataatgaatatagttgttcgtaaataaaattttaacaaatggaaaagatgcacttaaaaataatatttgattggccaggcatggtggctcacgcctgtaatcccagcactttggaaggccgaggtgggtggatcacctgaggtcaggagtttgagaccagcctggccaatatggtgaaaccccgtctctact

SEQ ID NO: 217282 - DNA, 1742 bp, Homo sapiens
  misc_feature (1)..(1): n is a, c, g, or t
ntttaatcactctgtgcctcaagttctttatttgtaaatcaagataataatagtagttacaaagtaaaggctaaagttaataaagacccaaaagaaaattaaaactctacatattatgatattataattaccaccatcatcatcgtcctcctcgtcaccattattgttttgttgttggtagcagtggtgtcctgctaggtgttagaagctaggaacctatagaaaaagtgctcttccctgtacaggactatacctggccttacttgaaaactaagaactcttagcaacattagcaacatacttctcagctctagaacttcccgatgaagtggaatgttttgcatcggactttttgcaagaagatcaagcttgaacccggtaacctgtttttccatcgagcacttgattctacattaagatcaggccatagctctgcaaggtgggggcccggactgaagggtcaggctgggtttctgtttcgtaactgggaaaggcatgtactgcatgcggcaggctgacctcctgaatcttcaggacaatctcaatttcagatggcccaccctgctgatcaaacctgtggtttggaaagcatggttactgctaaataggaagcaagggctccaaatgccagtgtcctaatcgtttaaaaagtaaatataatttgaatatgtgggatagcctcagagaaaaatcaaagaacacaattaagcatagtttctatttagttttcagttgatgaaggaataatttgaagttgctctagtcactgagagtacagtagcaatagtcctccattctctgggattcagggcaagagcggacattatgtgcatattacaggttttctagcacacagattctatcaagatagcctctaactgcaattgtggacactggtggaatattcctagcaggagctcaaaggattgtaaagctgaataacatctttgtctcaagaacttatatgagaaacttttttccctttttctcctacaagcatttagtggttcaccattgcagacactgcatatctttgtatcccacacagtccccatgttaatagttgtttgctagttgtggtcatttaattgaaaaaagctggcacagagatattacaggtcccaataggtcatttctgtatcaagtatggtgttattgcctttaaccaagccctgtccaaggccaaatttattacatgcattaataacatataagaggatagacagagagctgaagaaaagatgtgtgtggcctttaaatatgccaatcatctacagttcggagggttgcttaccgtgacatattgccagctgtgcattatagaattccagatggcatggtactgttggtacttgttttggatttgccctgggaatgaggttaaagaggacaccaaactatggctgggatccttttgcttgcctcttccagggtagatcctggaaggctctatctcctccaaccaatcagaaagctgccctgacctctcttggggattatgaactcagcacaaattgctctttccccgtgaattcccatgcacctagtaaccctgcactaagagagcagtgagtgcattccctcatgtaatctgtgttcgccctccctcagaccccagagctggggcaagtttggacatgaactcaaaaactctatagataagggttgtgttttcattagcttgcctgtcttgcttgctttatattctgtgagatttccttcccccatcccccctttttttg

SEQ ID NO: 217283 - DNA, 1276 bp, Homo sapiens
  misc_feature (1)..(1): n is a, c, g, or t
ntttaatcactctgtgcctcaagttctttatttgtaaatcaagataataatagtagttacaaagtaaaggctaaagttaataaagacccaaaagaaaattaaaactctacatattatgatattataattaccaccatcatcatcgtcctcctcgtcaccattattgttttgttgttggtagcagtggtgtcctgctaggtgttagaagctaggaacctatagaaaaagtgctcttccctgtacaggactatacctggccttacttgaaaactaagaactcttagcaacattagcaacatacttctcagctctagaacttcccgatgaagtggaatgttttgcatcggactttttgcaagaagatcaagcttgaacccggtaacctgtttttccatcgagcacttgattctacattaagatcaggccatagctctgcaaggtgggggcccggactgaagggtcaggctgggtttctgtttcgtaactgggaaaggcatgtactgcatgcggcaggctgacctcctgaatcttcaggacaatctcaatttcagatggcccaccctgctgatcaaacctgtggtttggaaagcatggttactgctaaataggaagcaagggctccaaatgccagtgtcctaatcgtttaaaaagtaaatataatttgaatatgtgggatagcctcagagaaaaatcaaagaacacaattaagcatagtttctatttagttttcagttgatgaaggaataatttgaagttgctctagtcactgagagtacagtagcaatagtcctccattctctgggattcagggcaagagcggacattatgtgcatattacaggttttctagcacacagattctatcaagatagcctctaactgcaattgtggacactggtggaatattcctagcaggagctcaaaggattgtaaagctgaataacatctttgtctcaagaacttatatgagaaacttttttccctttttctcctacaagcatttagtggttcaccattgcagacactgcatatctttgtatcccacacagtccccatgttaatagttgtttgctagttgtggtcatttaattgaaaaaagctggcacagagatattacaggtcccaataggtcatttctgtatcaagtatggtgttattgcctttaaccaagccctgtccaaggccaaatttattacatgcattaataacatataagaggatagcagtggctagtagtctcttggaatatgctaccccatacccataaatcgggtaga

SEQ ID NO: 217284 - DNA, 438 bp, Homo sapiens
agcatctatatgcttacagggcatgtttgaatttctgatcatgtgaacattttttacattgtacacatatttttaatttgcatcaatttatagcatacaagtgcagtcctgctacatgcatagtgcaatggccaagtcagggcttctagggtacccatcacctgaataatgtacattgcatctattaagtaacttctcaccatccacccacctcccatctctcacccttccaagtcttcattgtctatcattccattttctgtgtccaagtgtacacatttttttagacaggattttactctgttactcaggctggagtgcagtggcatgatcacagctctttgcactctggacctattgggctcaagcaatcctcttacctcagcctcccaagtaactgggactacagatacacaccaccatgcccagctaattaga

SEQ ID NO: 217285 - DNA, 578 bp, Homo sapiens
ggaggtataatcatactgtcatttttttatgtgtgtgtttaatggtatctattcagttgacttcagaaattttctaaccttcctcactaaaacttgcaagctaattaacacaggtctcttaaagaaggaaaataaaacatcttttaggaaacggtaatagacccatataaacatacttcaaatgtgcagtgattttctccaaactattgaaagtaatgggacctgttaataagggttagtatttaagaaagactatattctatgaaattacatgctttattattataggatgtaatggaattttctaatctattaatagaagttaatcttctgataaaaattttaaatcaagaactgaatttacccacaaaaatttaaaaaatttgaaagaaaattgaccaatttatcattttttaagtgaattggacactgatatttgaaggtgagctcttttaggggaaaaaataagtgggttgtgtttttaagtcatggtttagtggtaggtagttattgtaaataggccatctggttttacttttgagtgtctttaattttggtggtagtatttcctttctcta

SEQ ID NO: 217286 - DNA, 680 bp, Homo sapiens
ccacccagctgccagtacagggcagtgatcctcaatactccttcactttcattgcctatatcctattgattaccaaattctgccaatttaatcttccaaacatctctcaaatctactcatgccaccctctcccacttctgccacctagactgagctaacatcctctgctacatggaacaagcctctccttcatgccccagggccttcacttatgtacactcctccttctggaggagctccactgcttgaacttcctcctcctttatccttcaggcctgcacttataatttgcctcctcaggaaagcctcttagatccccaggctaggtcgagtcctgtttgatgcttttgttgaatgctgtacttctcctctgtagttccaattgtaatagtacttaattagcacaggattattggcatcagaacactgcagggattaagaggagtattcaataagagttattgaacaaatatataccaagatttttaatgaccagaaacatcaaaatagagtctccaagattcactgaaggctggaaaaggtttgcgtatttgcaaagcatccctgaacatcagagtggcttcttggcactgcaaatagcattgtgaatcccctctatccccaaagctttttgtgacctggacagatgctcatgtttctctgtgcactggtcttctcct

SEQ ID NO: 217287 - DNA, 405 bp, Homo sapiens
attcatgtaacaaaacggtacttgcacgcctaaatctatgggaaaacatatttttaaggaatttattcacacatgatttcctctgatctaggcccacagcactgagttcaactcttttgagttaaatatttgatttagcacatacatgtaagcattccacaaaaatgtattaagacattactaagtgccaaccactggttctaggcactgggagatatatcagtgatatatgaggtgaagcaaaacaaacctgactagagaatacagatttttttcagatgcacataaaacatttaccaagacaatcatattctgggccataaagcaaatttaagagagtttaaatcatgagataaattttctaaccacaatggaattaagttagaaatcaagaagagaaagaca

SEQ ID NO: 217288 - DNA, 126 bp, Homo sapiens
ggcagagatcctgcagccccccgccccccgtcacccccggagaggagaggagatctgctttcttggttttgcttctctttccccccacccccaccccgggggctggggcgaggggagtcgggttac

SEQ ID NO: 217289 - DNA, 959 bp, Homo sapiens
attttttgtatttttagtagagacagggtttctccatgttggtcaggctggtctcaaactcccaacctcaggtgatccgcctgcctcggcctcccaaagtgttgggattacaggcatgagccactgcgcccagccgacaacttcttaggttgtgttgggaactgtaaaaagtaaagtcggaaactttcactgcttatgcttatgtgattgtaaccatacattttctattagtacaagagagttgcttattaaagccccgtaacagctgcatggatcacccattcctagtgagtgaggcattagtttgctggacccaagtagaaactcatggtgttctgacccctgtgttgtatttcctgccatgtgcctggcattctgggcacctgttgccataactaggttgactgcctgcaggatttgccatcaactcactgtatggtctgtgatggacccaccctatttctgatcaatctgcattggtgacagtgactgcacactctgtagatactatatgtgtatatttttacttcttttaatttgttaattgacagataataattgtgcatattcatgggatacatagtgatgtttttaatacatataatgtatggtgatcagatcaaggaaattagcatatccatcatctcaaacatgtagcatgtttttgtgttgggaacattcagtatcctcctcctggttatttgaaactctgtatatattatgggtccctagagtcaccctaccgggctgtagaacacaagcaagatccctcttctctagctataattttgtatccttgaaaaaatccctactccttccttcccagcctttactatcctccgttatactttttacttctatgagatcagtgttttttagcttccatgtatgggtgaaaacatggtattcaactttctgttcttacttcacttaatttcctgggaatactatccagccag

SEQ ID NO: 217290 - DNA, 244 bp, Homo sapiens
tgagccacatgcccagcctattatttttcaataaatctacttattgtctcttctttgattggaaacctattaaataaaatccaaaacttttaccacttcattctagaccttctattgcctgaccttcatttgacctttcagcttcacattctataactttacctcaggtaccttaagtatctgtcatttgtagtctctaaacagatcataaatgttcttgccctggttcatgctgtcttcttat

SEQ ID NO: 217291 - DNA, 622 bp, Homo sapiens
caggctcagatgatccccccacctgagccatccaagtagctgggactacagtcacgcgccaccatgcccagctaatttttgtatttttttgtagacacagggttttgccatgttgcccaggctggtctcaaactcctgagctcaagcagtcctcccgcctcagcctcccaaagtgctgggattaccacatctggccctcttttcgttttggaaattagagctcgcccccctgcctctccctccccccacaaggttttcttttcgaatgcaattctgttttctggtgggtggggactttgcctgggttcattgatcaggttcgctcgtcaactagaactatggtccccaaagaaggctgtgcaggatctgtgggagagcagataccagagccctgctttatattcatttttaacctcatcacttttgatttccatgtacatgtgtagttataagcatgtgctatcattaaggtatagtagtaccatgctgtgaactaaatatattggagatacaagctcaaactgtcctggtggaggcaggcagtcaaaaatcccagagaggctggaccagacaccagagaatgtgggttttcaacacgggggagaggaatgaggagagccaa

SEQ ID NO: 217292 - DNA, 474 bp, Homo sapiens
atagtcgttatttatagattcccagcatgaattataggctacttttactttttgttgtataatgagtctttgacattgtcagttatttagatcaactactggttataatttgagcagaattaccaacataaaatgtattacttataatttgttaacatagcaatctcttacaatgtgttaatagtccatactaaaattaagaattctgagttgttacttaactcccataaaagggactttggaactgtgaattttattccaaataaatgtagtcttaatatgtttttcagttaaaaggatcaacaagatattgagcatcattaaaaaaaaaccaaaagggataatgttactctttttcatataaagccagtgcctgttacaggaagactatgtgatgttgccagaaatgtaactggtaaggagaagaacgctaaaaatcatcagagatcgggagatattgctgtttgacagcct

SEQ ID NO: 217293 - DNA, 412 bp, Homo sapiens
catcattgcctttttaaatttaaaggtatattaaccttatttttgtatttagttattttaaaattaatgtttttgttccacgaaatagattggctggaatcaacttgtgaatgaaaatgaagattttgcaaaatgttaaactgacaagtagttcatttaagaatgaatactatgtacatttcccagaaccgtcttaaggcgtgttatatagcactttcaaaataaattagaattgcagaaaaggccaagatactaccaatatgatttcagttttcatatattttgtaattatttttgtcaaagattcttcagctgacctttaaaaagttacctacttgcataacatctgcatgtttgaagtgtgtaaaaagtagctaacatttgtcaaaacagtagtggaatactaggtttg

SEQ ID NO: 217294 - DNA, 177 bp, Homo sapiens
tcccaccgggtccaggtcaggcccaaggggaccagctctgctcccaccatcatcccactccccacacagccaagctggacatctgagagcactgcatggcaatcctcatctgcctgtgtgtctccctccactggggacacatgtcatgtgtcagtcctgcagcacatgtgtccttct

SEQ ID NO: 217295 - DNA, 405 bp, Homo sapiens
aattgtgtgcattcttgagattcctcctcctacaggtgtggacaatctgtgtttaaaatataatttgctgttttaacaacaattaattatcaaattctttaccatttttttcctcaaactagaaatagcagcactgcttccatacagagagatccttgcttccttaacagagaaaaaagactaatagaacaagttccacaacatgctactctgtgttagaaaattgacttgattggcctgcgcacctgctatctaactcagttgctcagtctttaagtctcagggtggaggcagtttcctgtctgctgctgtccattaaagagctgatgatggtagtttgctttacaatgcaaattttttttatgttgtactaacacaaaaataataggtgcattcttcatttcc

SEQ ID NO: 217296 - DNA, 443 bp, Homo sapiens
cctgcacttcctagacacatgggctgcttcccccatcaagatgggaatctaattccatctggaaatctgagctatccttggcgcctagctggacaacaaatatggcagaaatggggctgcataacttttgaggctagttactagggctgtgcagtttcccccggatctgttggaatactcactgttaggatggacccagcatctcactgtgagaagctcaaaactcatgagaagccacacataggcactctggtcaacagcctcatctgggctgtcaaccatcggccatcaggagctgctgaccatgccagtcagccatattggttgtgcagccccagccaacacctgcctgcaacttcatgaaagatgccaagcaagaattgtccagctgaggcccattaattcacagaaccacgagacataataaatttgtgcatatatat

SEQ ID NO: 217297 - DNA, 446 bp, Homo sapiens
ctgcttgggaggctgaagtgagaggatcacttgagtccaggagcttgaggctgcagtcagctgtgaattgtgccactgcactctagcctgggcaacagagtgagaccccacatctctttaaaattttttcaaaatatttaaaatgatcaaaacgggcgaggcgctgtggatcatgcctgtaatcccagcactttgggaggccgaggcaggtggatcacgacgtcaggagatcgagaccatcctggctaacacggtgaaatcctgtctctactaaaaatacaaaaaaattagctgggcatggtggcaggcgcctgtagtcccagctactccagaggctgaggcaggagaatggcgtgaacccgggaggcggagcttgcagtgagccgagattgcagccactgcattccagcctgggcgacagagtgagactccatctcagaaaaaaa

SEQ ID NO: 217298 - DNA, 413 bp, Homo sapiens
atgaagatgatgactgaaaattcttttgtctaacttttgcttaatcttatgttcacaaagctgatttactgtcatctttcttaatcattatcccctcatcatcatcaatcattagttaaaattaattacaggccagccgccacggttcatgcctgtaatcctagcactttggaaggccgaggcgggcagatcacgaggtcaagagatcgagaccatcctggctaacacagtgaaaccctgtctctacgaaaactacaaaaaattagccgggcgtggtggcgggtgcctgtagtcccagctactaaggaggccaaggcaggagaatgatgtgaacccaggaggcggagcttccagtgagctgagatcacaccactgcattccagcctgggcgacagagggacactccgtctaaa

SEQ ID NO: 217299 - DNA, 204 bp, Homo sapiens
tcgagccggtccaacagtggtattctgtgtcaggctatacaatgttacagcacattataatagctctaatcctgacaaattccaaaagatttaactcaggtatcttctcatctgtaaagagagtctttattcatgtttccaaagaactttggatcacttcctgcactagtacacatcatactgtgttgtaagtgcttgttcata

SEQ ID NO: 217300 - DNA, 332 bp, Homo sapiens
cagaaaaaagaaagaatgcaagccccattgcgtgtaggatgtttaccagagaataatatatatgggagattgtccagaaggacagggtggtttcaaatgctaaaaagtccaggcaatgggaactgaatgagcatggaaattaggccactggacttggtgaccagcttctagactggcatggccagccacagtgctacaaaagcaggtaaaagccacctcttggcagatggagaagtgggtggaaaatgaagacataatggaaggtgctggtaaaagtaaaccactttccagagtgttggtggtgatgtgaggagagactgagagtagtttgc

SEQ ID NO: 217301 - DNA, 218 bp, Homo sapiens
ggggaccagagaggatgacacacccaagctcaccagcaagttagaggccaaaacaaactcaatttcattaattatggagttatttccatctgcaatagacatatctgtttgttttgttcgtttgggctttggcgggtaaaggggctacccacagggatactgattttcttttcttttcttttctttttttttttttgagaggagtctggctctgtcgc

SEQ ID NO: 217302 - DNA, 109 bp, Homo sapiens
gctgggacatttctttctctcttcccttcccatcccgtcccatccagtcccgtcccgtcccatcccttcctgtcccttcccatcccttcccgtcccttcccatcttcgg

SEQ ID NO: 217303 - DNA, 372 bp, Homo sapiens
ccacgcgtccgtccatgcgtccgacggctgcgagaagacgactgaagggggagcaatatctgccagagttcttccttccttttttgcttgcctgacacccttcccttcagagttcagttcttgctagtagaaaaaggctatgcagcatgataatacagtgattttaaaagttgattatcttgaagtattttgggacagttttggggaatgggttatgtggtatatatttatttggctctttgctgaatatggctgtataaatccagcctcctggatgttacaagtcatccccttgatttcttcttttgaataaaaaaggagcattgcttcatttttcttgcagaaacccttatttaaacaatgaaaacttca

SEQ ID NO: 217304 - DNA, 314 bp, Homo sapiens
tatgctttctccagtgcatgttcttggtacccttgtcaaaaatgaattgactgtaaatgcgtgaatttatttttgagttctctattttgttccgttggacactgtgtgtatttatgcccgtactgtctgaacatggtacatatttaaccccagatattaggtagccatgatagaggtatagatggcttataaaataaaactaattgtctttttttttagatttaaaaaaagactaacaagagtaaaaatttacagcaggggaatggttaatgtttttaaaactatttggtaaaattcaggagtgtggatatgaa

SEQ ID NO: 217305 - DNA, 522 bp, Homo sapiens
gtatagtaatgactaccattctgcatggttttgtggactaggcaaacctatttatgtcacattttatagagaattgtagattccatgatagtggagttatatacaaaaagttgtgttgcttttaagtatgataagaataagtaaagtttatgtaaatgatcattaacaaaaatgagttgtgtttttgtaagtttacctctttaaaattcaattttgaaaggatttttaggttctcctgggtattcactagtttattgtcacagcttttcctgttatttcatacaggatgttttccttcatagtgatagaatactagacattttgtgagttccagaattctaaagcatgtgctcatgctgtgtagtattctgaagaatatagtccctcaccctctaaaaccgggcttctgacatacacggtactatttgataacataacaatcaaacatttgaattttgatatagttataggcataaccaataatcagaggtgtttaagttacaatttctttgtttcaagttt

SEQ ID NO: 217306 - DNA, 350 bp, Homo sapiens
ttcacgtaccatgggattagccatttttttttacttgtttatgtgacgaccagcggattttaaagcgcacgggttagcgaccttcgtgttgttgaaccatcacctctgcctagttctggaatgtttccctcactccagaaggaaaccgcatccccatcagccctcgctgcccagccctggcggtctctaccccgctttgtctctgggtttgcctgtgcgggactttccgtgtgacatgtggtccttctgtgcccagttcttcccagcatcatgttcccgggttcacctgtgttgtggcgtgtggagctttcttccttttcatggctgagtaatattccagcgtgtgacca

SEQ ID NO: 217307 - DNA, 437 bp, Homo sapiens
tagtagtatctttatgagtttatctcagttatgctaggcagaaaggagctcttgtcagttggcaggaccgaaaggagagaataggcagggggaagaggggacagtaatcgaagtaggagcaccttgagcgaagtgaaatgtgggatggaaatggaagctcctgtttgtgatctcccagagaggctcagtccagcgccaggtgccgtgtgcttgtggaataaagagaccgaattccttctgtactgggggttcatgctgaaccccacctttgttgaaggggaggaaccagctgcccaaggcaaactagaagcatgcttgcaggagggaaggttaagacacacagtttatgtgcatagcagtgaaaaccatagtgtctgttctgaagtttgggaaaatagtgtgagactgtctagctgggtctgtcattggctgatgtg

SEQ ID NO: 217308 - DNA, 435 bp, Homo sapiens
actttctgtaagatagaccatatgatagccaacaaaatgagcctcaataaattttaagaaaattaaaattatatcaagcactttctcagaccacagtggaataaaactggaaatcaactccaaaaggaaccttcaaaaccatgcagatacatggaataacctgctcctggatgatctttgggtcaaagatgaaatcaagatggaaatgtaaaaattcctcaaactgaatgacaatagtgacacaacctatcaacctctgggatacagcaaaggtggtgctaagaggaaagttcatagccctaaatgcctacatcaaaaagttggaaagagcacagacaatctaaggtcacatctcaaagaactagagaaacaagaacaaacccagcagaagaaagaagatcagagcggaattaaatgaaattgaaacaaaacaac

SEQ ID NO: 217309 - DNA, 463 bp, Homo sapiens
caaggtttacatgaacagggaacttgtctgttttgtttattactgtatcccctatgctggcacatactatgtaataagtgtttgttgagtgcatgagtgaataaccattctaaaaaactctgatgtttaaagccctttgctttatataagaattttacttggaaccctggtatttttgtttgtatttgtttgttaataaatgtcaagagttcagtagtaagataggtttcagaaatgctaagttaaacagaataaagaaagaatatgtattacaggtcctggcagagccttgaatatgctaacatttgacagtgggagtctttgagaattatcacatgaagctgctgtacattacaacacattctaggaaatgctgtcttagacaaaaacctgtcatattagaattggggtaaggggcacgatactgaccgtgaggcagcagattcctatggactacattaaa

SEQ ID NO: 217310 - DNA, 344 bp, Homo sapiens
ggtgtgcagacactggagaatgaacaaggcagagaagaattttattgagtgacagaagagctctcgaaaatgagagggaacccaaactgggtagccctctgtgtgagagagggcccgaaagcaggtaaccatctgtgaggctgggttcagggcttttatgagctcaaagtgggagagtacatgctgattggtccatgagcagacctggtaaaagcactatttgactaaaaggcatagaggaagttctcactctagttgtgggctccaccttgaactggcagctcagttttcaggcttcatgctgtctttggctttaagttcaggttttactggcaacccatccc

SEQ ID NO: 217311 - DNA, 217 bp, Homo sapiens
aaactgatgttttttcagttctgtcttagggctagttagcagtgttatgagacacaaacaggaaggagtgaggtggaaaggtatggaaggtactgggcatggcagctgaagcttgcaaccccagcactgtgggaggccagggtgggacaactgcttgaggtcaggagtttgagaacagcccgggcaacatagcaagaccccatctccacagcaaatt

SEQ ID NO: 217312 - DNA, 391 bp, Homo sapiens
gcgtcgactttttttttattagtagtaatcgcatagggctctaaataatcttcaagaaaaaaataaaggaaagcactttgcttatatctaagaggctttataaaacctttaataaaatactgcagagataaaagatgttgctccaagaggcattctgtagttcacatactgcatttgtctgccagtgtttctggaaatcactgagtaaacactaagtgtatgtaataactagaaagaacttacatagcgaatcctcatatgaaggaaattaccaaatcttcagttatctctatttatgatttcatcttagatataggtgtctacaaactaacggaaagtgaatcacaattgacggctttggctggtcgacgcggccgcgaatttagtagta

SEQ ID NO: 217313 - DNA, 597 bp, Homo sapiens
tgaaaactctgaaccacatcggcgtctgataaaggcaaacatctggagatgccagtggcagatgcccaattatgctgagtctgatgaatggacacggagctatttggggctcagcagcaatcctcagctggacctgccgctaccgagggcgacaggcttccctctttccaggcaccatcctggccttcagagggctggacacttctgctcatccaccactagccccagccatcccaaccagccactgccacaagatctgctgccccatccccaaggaagaggagggccaggttaaattgattttctcattcacttttttatttcacagaaatatcatattttctataagaaagtgttaattataccacagacaccatcaaatggtactaagtgataactaaatgttcagaaggttgacgtgtatattatttcaagtagcttcgtgatttattgtctaatttagataaatggcaaatagtgatatcatgatagcccccttttattctggtttacgcctcattgtttctgggtatagaataaaatgaatcatcaaacagccccacgggaaagactggcagactggttaagggcataggc

SEQ ID NO: 217314 - DNA, 789 bp, Homo sapiens
ggctcccaagtagctgggactacaggcacccgccaccacgcctggctaattttttgtatttttagtagaggtggggtttcaccgtgttagccaggatggtctggatctcctgacctcgtgatctgcctgccttagcctcccaaagtgctgggattacaggtgtgagccaccgtgcccagccatctcatttaatttttacaaaaactcccttgaggagaacattattattttcccattttgactgagaattttgatgtttaaagggtatagttaacttgactaattttatatactaaagctgccattcaaccatttgaacaaatgtaatatgtaagcagagtccaccaaatgacttcacagttcgtgtttttcctagtagaaagcctcttggtatttaacacccaaatgtcctagaattcattatctctcaattcagtgtgttttggcagatcattataaaatacatatttacatttatgtcccagaaatacagccaaatactgcattttaaacaaaataatgtgtgagaagtctgtgttaaattccagatataattggtagactgtcagaatcacatgtcaacaatttgaaaggtgcaccaaatatcaacaaagaggatatgtagcatgttactacttgtagccactgttaaccttaggaatggtttttgctcaggaagtgatgttttcagcattttatatcctaacattggagtttgttacttttgtataggtgctttactgtgttttagttacactttaggaacttggttagttttttggggttgac

SEQ ID NO: 217315 - DNA, 492 bp, Homo sapiens
tgctcccttaacatataccaaaatatttgataaatgacacagtattttgaatttgtaggtggctggcttttcttttgcagaccacacctgttaatatcacctggccctgtcttgggatctacatgtagtcttgtcaccactggtcaattggcacatggttttccgaacatcagtcgcctgggacagctctgtaattacttgttaattacttgagtcgaatgattccgaactcatggtagttgcttcgccttcattgatcattcaccatttggttctgtgccagcaggatgcccggctgcttggtcacaggcattgcgcaagctggcaccgggatcgtggcctctttaagtcaacttctggctgagggaatccggcgacactagcccgcggagaagaagggctgaaggtggagcagggggacacgccgcgtcccaccagacgtacgccgcgacgcctgctggtggatattacccgggacctcaaagcggccgc

SEQ ID NO: 217316 - DNA, 611 bp, Homo sapiens
cacgtggcgcacgcctataatcccagcagggaggccaaggcaggtggatcacctgaggtcaggagttcgagaccagcctgactaacgtggtgaaaccctgtctctactaaatacaaaaaattagccaggtgtggtggcatatgccgataatcccagctacttgggaggttgaggcaggaaaattgcttgaacccaggaggtggaggttgcagttagccaagatcacaccattgcactccaccctgggcaacaagagcgaaactcagtctcaaaattccatctctaaaaagaaataattaataaattaaaatttaaaactaaaaactttataaagatcaacttgtcccaattttgtgattttaaaaagccatgttcagtaaaaacgaatctaagccattacttttctcagattctattcattcatagtcataaatcacctcctatgtttcagatactatgctagaacagtatcattgagtaatggcctctgtataatatgttttaaatattatattatgtgcaatgcaaaaaaagtttaaaaaggatttgtttactacattacctgttttaatatgaagtgggggaagaacattcacatgatgagggggcaa

SEQ ID NO: 217317 - DNA, 467 bp, Homo sapiens
atgttgagaagaaatttacccaatatcacagccatccagtgtcagagctgcctgacaagtttttgattccaaacactacaatcatacaggtagaagtcgtaattattatgtaactgagtattggggcctaaactcaatcccagtatctgaagttagggtctatcgggggaatgtcctgaaatgctacttctacatatttacatacagtatgttttgttgtttaggtgagatactaaaaaattcagaagtcagatttttacagggttttgtgcctctttaatttcagtttaagaaaggaggactaaattcagagactgtcagagttcatcctctcttctatttgatctgcacatacatcataatgccacatacatataaatatggcatacagtctacccaggggttctgcaactggggtccagactcccaaagggctggtggataaaaattttgggaatcccttttag

SEQ ID NO: 217318 - DNA, 601 bp, Homo sapiens
aaatctcttccaaaaaggagcctgagaatcatacatcaagagccgtgaaaactagccaggcatggtgaagcattcacgtagtctcagctactcaggaggctgaggcaggaggatctcttgtgcccaggagtttgaggctgcagtgcactatgattgggcctgtgagtagccactgagctccagcctgggcaacaaaatgagactgggtctctaaaaaacaaacaaacgtaaaggagcacgaaacctcactcatcctacactttcctttatgggaaagctcattggaaattttatgccccatctaaggggttccctgtagctgaaactcatgaattacctggttatgagatataagcttaatatgaaccatgaattcaataatgtcacaaatgaggcagttgtccctgggaaggctggttaatgtagagctgaactgggctttgaaaacataatttcttacaaacccctgacttctaggctttccacacctgcctgtatgtgctggtcagttaagaaacacaaaaggagatcagacataataggcacaacattaaaaacataataggaaaattacattggacttctataattttcattaaaa

SEQ ID NO: 217319 - DNA, 574 bp, Homo sapiens
gcgcagtgatggcttcgatcccacgtgatggggctttgcacacagttgtggatgtttaatgcgtgtagaataggttaacctgcttatctcaggcagctgtcagtaagtattgatgctgagccctgacaaagaggccgtttttattcctaggaagaaaaagagggagtaaactttgatcagaagcttataaacagtcattctttaaccagactaattttattcactaattgcagaaatgcccaaacaaacaagcaaaataaaaataaagacagaaagtgatggcctggtgcggtggctcacacttgtaattccagcactttgggaggctgagatgggcgggtcacttgaggtcaggagtttgagaccattctggataacatgatgaaaccccatctctactaaaaatataaaagttagctgggtgtggtggcatgtacctgtaatcccagctactcaggaggctgaggcaggagaatcgcttgaacccgggaggtggaggttacagtgagctgagattgcgccactgcactctagcctgggcaacagagtgagactctgtctcaaaaacaaaaaa

SEQ ID NO: 217320 - DNA, 354 bp, Homo sapiens
caatagagcatgtccatgagccacgctgctgcctacatcggcttctgggtgagttgttccctctgcaaggaacgttcctccccctcccatctggctaactcccatttattcttctcatttccacttaaaaacactaccttctctgaacagccttccataaaacataatgcagggtccccttgttagatactctccctgtagtctgccatcacagccatcattatatcccgatgagaccggggggactgactccctgccatggagcagagactaggtctgttctcctcacttctgtatccccagtgcctgggaaagagcctggaaccgagcagacgctcaataaatatttgtagg

SEQ ID NO: 217321 - DNA, 419 bp, Homo sapiens
aatgacctcagtttgtagacaacattttaagtaacactgatttaaaatattctctggggtaaataaatgtaagatctttctggcatttcagagttggagcttaccctcacacttctcagaaaagtaatgtaaataatactaatagtactgcagtgtaatgggccatcattcctgacctttaaatttgtattactctaggaggacattatcttatgaaaaaaatttgttgggtcactttctgtaagacactgctaggtgctagggacactaataaaaagatgtatatggaaaaatagtgactagtggtaaataagagtgcttgtaaagggatgtggtcatttagctcttgattgattgggtttagggtctttgtagaagagggagagagtattttgctggatactttattattttctgca

SEQ ID NO: 217322 - DNA, 425 bp, Homo sapiens
ccagcactttgggaggcccaggagggcagatcacgaagtcaggagatcgagaccatcctggccaacgtggtgaggccctgtctctattaaaaatacaaaaaattagacgggagtggtggcactagcctgtggtcccagctactcgggaggctgaggcagtagaaacgctggaacccgggaggtggaggttgcagtgagccgagatcgtgccactgcattccagcctgggcgacagagagagacttcatctcaaagaaacacaagatcctaagtggccattctgtctcttgccatggtctgctaaatcctcttcttactcctattggaacagccccaaccccacacttcttttcttctctatactcattcctttgaggatttcaactcagttcatggcctacagatgggtcctttttatgtcttca

SEQ ID NO: 217323 - DNA, 505 bp, Homo sapiens
aaggttaagttgtaggtaatgagttttcagataagtattatattatttcagtgaagagtagaaagaaaaaacattaaagtagcttataccagtagcttattcattccagcaatcttatcagagaggctctaaagggacattttgttcacaaacttagaaatttgcccatcatgatgacatttatgggtctagctttgtacttatcctcaaactagcaataattacaataatttttgagtgcttactatataccaggctttgtttaaagcacttttaatcatcagaataaacctatgaggtaggaattattttacagctgaggagactgagggttagagaagttaagcagctttctatggtcacacacgcacttcctaacagtattagtcagctaccaggtaacagtaaggattcaacccaggcagacaggctctcaaaccaatgccgtctccctgacttccttagatgtatgtttaggtatgaataaagaagaaatgtctatata

SEQ ID NO: 217324 - DNA, 261 bp, Homo sapiens
gctagtgcagagactgagttgggagtatgttcactgttcaaggaaaagcaagaaggccaatgtggccaagtcagagtcaacagggctgtgactaggacagtgcatgcagactgtgatcacataacgcctcgcagagcatggaaggagttggggtttttactctcactgtgatgggaagccactgggtcattctgagcagagacttgatgtgtctgatttacatttaaaaatatgcactctcatcacttagcatgttgggaa

SEQ ID NO: 217325 - DNA, 351 bp, Homo sapiens
ggaataatttattccattcctttcttgctactattttggaagccatgttcatttaaatctcctttatttaggctattgttcctctgaaagccttttacataagttgattacaatagagagtctcctagggtctgcctaagagacttgtgaatgttctagattttgagagcttggacatggtgaacatatcacggcattaatcttgcattaaggaaatgtagagaaaatttgcatatacctttgctgacaacccactgtgcaaatttgtattgtaatttaaaaggtgaaatagttgggtaggttttatttacattattatgagttactttacctacaaaaaataactgaatg

SEQ ID NO: 217326 - DNA, 387 bp, Homo sapiens
cgccattctcctgcctcagcctccagagtagctgggactacaggcactcgccaccacacccgactgattttttgtatttttagtagagatggggtttctccgcgttagccaggatggtctcgatctcctgacctcatgatccacccacctcggcctcccaaagtgctgggattacaggcgtgagccaccatgcccggtcctagcacctacctttaataagtccttcaggaaaggattacagctgcccctgtacattgaacacatggctagggcccacggacatgcagttttcaaccaaatatggacggaaaagaccggtgggatgcgaaacccactgtatatggagggcgatcgcctatacgtgggttctgcaaggcagactacaag

SEQ ID NO: 217327 - DNA, 382 bp, Homo sapiens
cgagcggccgcccgggcaggtactgctgtaaaaaagactttaggtgaaaataagttaccaatcagctcaccttaaaataaggtgatggtcttaggttatccaggtgggcacaaggtaattacatgggcctgaaacaagcaggagaggatggaaaagaatcagagtgatgtggatgaaagagtaggagagatgaagcagtggggtccgggggagggcagaccatggagattggatgcaggaaaagggttcaacttggcatcatgagctttgaagagggataagcagtcaccacctagggaatgtgggtggactctaggatttgggaacagtctgtagcttacagctagccaaggacacaaggatctcactcctattaccctct

SEQ ID NO: 217328 - DNA, 405 bp, Homo sapiens
ggtcaggctggtctcgaactcctgacctcaaatgatctgcctgcctcagcttcccaaagcgctaagattacaggtgtgagccaccgcacctggccttgaactaggctctgaaggatgaccaggagtttttcagatgggggaaagaggagcaaagcatcccagatagagagactactatattcaaaggctaagaatggtgaaagagcaaaacgtgttccagggtggctggccgtacacctgtctggcgttcaggacaggaggatgttagaggatgctgcagcagaatgcaaggctcaggtgtggttggggtcagatagggaggaccgtacacaaggcatcatctctagcttccttaggaacacattcccttctttgagaactgcattggcccctaatgagctgaag

SEQ ID NO: 217329 - DNA, 1667 bp, Homo sapiens
  misc_feature (861)..(861): n is a, c, g, or t
tgtggtggtgcgggcctgtaatcccagctacttgggaggctgaggcaggagaatcacttgaacccaggaggtggaggttgcagtgagctgagattacaccattgcactccagcctgggcaacaagagtgaaaactctgtctcaagaaaaaaaggtttcagtaagatgcttttgtgacttgacttagaagctgaaattgggaatttccttagatgagacagtacatagttcatctgtgatatcagatcagttcaccaatacatgctacatacttgtgcccctgaagctttgtaaaggcctaggacattccagttctcctcactcagtttggtgaacaaggacatgcccatgtcaagtacagtaccccatgagacactggctgagtggggttatgtgtcatttcccatgtcctcagtcagcagatcctctttggccagtctgcatctttcatgcaaggagagagcttcatacccacttcttggtaagcagggtcttcaaatgtcaaacgttctttggacagatggcttccagtccacagaagcacttcttctagtgcttccccttcactccccaagaggctgcttcttgactaatgactgtgggacctaacttggtcgttcaggtgacaaagaatgttccccaagtctgtagctgacaattgatggttctctctgaacagcgctttagggtgggcttttccccccactctttttagagacaaggtcttgctctgtcacccaggctagagtgcagtggcaccatcagtgactcactgcagccttgaatactgggctcaagccatcctatcccctctcacctcagcctcccaagtagctgggactacaggtgcacaccactgcantcagctaatttttaaattttttgtagagatagggtctcactttgttgcccggggtggtctgaaactcctggcttcaagcagtcctcccaccttggcctcccaaagcgtaaggattataggcatgagccactgcgcccagtctagagtgggctttttttattgtcctccaaaggtacagaggttgcttcatgagtcatctggtgaaaaggtatagaataacatcacctagaataacatcactgtccgcctgtgtccaggttcaaggtcctgccctgaaggtgacagctctacctgtactgaccaaacctctgtctgacctgttagcagagagaccgtcattccaggggtggggcttgtttcttcacagagccagggctgcaacacaaaaggtgtgataccaagtaccgtgggggcttcatccagacgcagagaacttctttgggtttacatggcaaataagtcaacctttctgtttcctaaagggtttcacaaaaaaaggcatctttgaatggcctcagcagtgctctcacagaagaaagtaagggttttatcattccgagaggcactggtgggctcctctactttcagttaggtggaaatggggtctctgccactacctcttcaccagtgttgcacagctgacccttggagagggtcagcatttccagcacacaccagccctggtgttagcttgaatctgtgcgacttatgccacacagttagaggagaggcctgcagttctggagaggagagtggcatttgaagttgctgggcgacagagcgagactctgtctcaaaaaaaaaaa

SEQ ID NO: 217330 - DNA, 172 bp, Homo sapiens
tgcatgtgtgtgcatccgtgtgtgcttgtgtgcatccgtgtgcatccctgtgtgtgcatgtgtgcatccgtgtgtgtgcatccatgtgcatccgtgtgcgtgtgcatccgtgtgtgtgcatctgtgtatgcgcatccgtgtgtgtgcatccgtgtgtgtgcatccgtgtgtg

SEQ ID NO: 217331 - DNA, 233 bp, Homo sapiens
ccaggtcggaaatccaggtactgccagcctctgccgttctacgtgtggccaggcgggggagcttcgccctcccatgtccctcaccccatgccccagacagcacggtcctgcgatccccctcccattccagtgctcagtatagccgtatccctgcaggctcaggcccccaccatggccagatcccccaccccaccttcaccctccgccagtccattgcacacatagcatctgga

SEQ ID NO: 217332 - DNA, 378 bp, Homo sapiens
taggttacagtgagctatgatcacactactgcactctagcctgggtgacagagcaagaccctacctcgagaagaaaaacaagaagtttctaatgtctatgctttggaattccagtgttgctaaaactttttttaaaaaattgtgcttttataatttttcattatggctccttgaaacaatttgagctggtcccaacttttgctgacaacaactctgaaccaggtattacaatgagattcctgaatgtttcaagaagaaaaaaatgttctgtcaaaagattgacaagattttggaatattcaaaggggtttatggcctttaaataccataagtctaaatgaaaataaaaatctgagttttatttatttaagtaataaac

SEQ ID NO: 217333 - DNA, 374 bp, Homo sapiens
tacaggcatgagccaccacgcccagccccaaaatgttttaagatggtttacaaggaaggagtacgctcagtaggagaagataaaatacgtgaaaaaagaaccaaaacatggagatgaaagaaaaacagcgcaggaaagggacagaatgaagaacagagttggcgtgctggtgttttccacaaggcttctgaagcgtgccaccgtccttacctcggcaccagggcggggcctgacacgtggtggatattgaatgaatgtgcgccgtgggagtgttgagcacggttctgtattcttaataggaaatggcaatatgttcttgtgcagaagacaattctgtcaatatgaccgctaaatcaaaattcagtattctaatc

SEQ ID NO: 217334 - DNA, 341 bp, Homo sapiens
ttctttgaatatctgatacaattcagctgtgaatccatctggtcctggactttgttctgttggcaatttttttttattatttcaatctcacagcttgttattggtctgttcagagtttctatttctttctggtttaatctaggggagttgtatatttccaggaatgtaaccaggttttgtagtttgtgtggatgaatgcgtttatagtagccttgaataaccttttgtatttctgtgatatcggttgtaatctttcccattttgtttctaattgagcttatttggatcttctctcttcttggttaatcttcctaatcatttatcaattttgtgtatcttta

SEQ ID NO: 217335 - DNA, 774 bp, Homo sapiens
tgatcaggggataacagggaatgacagacatgaatggcaagatataagggcgcagtgttataagatgccgacttgagagggattgtcaaaagagcattttgatggctaaatatgtaccagaaattgtgctaggaatacaagattccaagaggtataaagtgtaattctgacttttgaaagtcttcaaaaaaagtttatccaaattttcctccagatgatttcctctatagaatctagttttctttttacatagtaatcctttaaatatttgaagttatactttaatttattttagcattttatcctggaaaatttcaaatatacaaaagcagagaatccgtgggaccatcacccaataattcccaaaagtgactgtaccattttatacttccatcagcagttaatgaaacttccatttgaccacaccttccctaacacttggtattatcagtcttaaattttagccattgtagtgggtatgcctttctggttttaattgtaattcctgatgattaatgatattgagcactttttcactgcttattggccatagttttttgtgtgtcagttcactctgactagctggaatttaaatgtcttgcagccctgtgacaactctgggaattgtttagcttacagttgttcttttttcctttagttattctttgcccatcctcaaggaatcttaccctacacaggagctgtttagaattcaggctgaggctgaaggagagacctccttgcatatttctggaactctacttgttcctagtg

SEQ ID NO: 217336 - DNA, 261 bp, Homo sapiens
tgctgggattacaggcatgagccaccgtgcctggccaggtttccaacctttcttctgatgagatttcatttatagaaatcccctttcttaggaacggtggacagaaaagtttgtccactgtcaaattctgtgcatacagcctgatcagtgcttgtcaggtgattaatagtgatgacatccacttagaacttttcttctttagggcatcaagaaatggcttcgggggcgaaggtgggaggatcacttgagcccaggagttca

SEQ ID NO: 217337 - DNA, 104 bp, Homo sapiens
tcccaaagtgctgggattacaggcgagaggcactgttcccagccgttggcccgttttctaaagccacgtcttcctctgcgatcatccagaacaacacagattct

SEQ ID NO: 217338 - DNA, 634 bp, Homo sapiens
cttgatagcaagaaatcgcaagtttaagaatgtgaagtccaacagccctcattccgtttttctttgacccctcaaaatcgcacccatcctatcaagtaactttgctccgctgtcattgcctaaaatctttgggagggaggaaggaagcaggcttggtaccttgcagcagagaatgaaatctacagtttaccctctcaacctaattcctcttgcagatttcacaagtggtggacaccatcccctacataacactaacacttggccatacccatcagtgccacctccaagggacctaaagatgcctgggggaaattacggaacccaaattgaattaggactccttgtgtgtgttacaccaccccatatgctgggttcactggaacaggggagaaagagaagaggcaaaagaggaaaagttacttgcagactggagtcagtgtcacggccaccgtcggcgcggggcaaacctccccggccccggctttgtctgcctggcgggggctggcgtcggggcgcgacccggtccacgccgggcgccgcggggcgaggggcgccgagggcgggcatacggcgcacacggccaggcagtgcacaccgcgccgggtagggctcccccgcggcagcgccgagaagg

SEQ ID NO: 217339 - DNA, 751 bp, Homo sapiens
agttcacgatatgcacgcccttggcttcctccagcaccttccacgttctgagaactgtgcatttccttgagctttgcacagaaatgaagtaaatacttgtgcacccgtgcattttatttaaagttacctacaattaagatatgattgatcacttatatttcatactgggaggatgtgattgtactctttgttgtatgtaattgtatataattgcactgtttatttcaatgaagctttcttgaccgattttaacttcttagaagaattcttacatttctcttatttaccttagcctttgatcagtcttccagtctaaagtctgtgactttacctgttacaatttcaatttggaaaaagttatttcattaagtatttaatctttccacagaatttctatacagtagaattgtttgcttttagccatggtaatgtttgttgtaaaggcttccataatgcctgatggaagtgaatttgttttctattttagggtagagagaatagtatcagtgaattgactacaaaaggttaggcctctttagaactgtgtgtgttgtcacattaaattgaaatttgaataatgtcacatagccacaccacaacactacagacaagaagccggccggcccaccactcaccccccaggagaaaccgtgcaaaaacacccgagtgcgcacccgggcccataacagaaaggaacacgggccaagccggtcccaggagaaccgggcacaacacagcccaggaatcaccc

SEQ ID NO: 217340 - DNA, 1038 bp, Homo sapiens
ccatcagaaaaagtgccacgagttatccagagaaacctgcatttccgcggttctgccacctttgagtctctgtcctcaacattacatcagagaagctaccagagagcactcacactgttccagcctctgcaggttccccaacgatgtctgtgttctgagttttcctggtaagagtctccaactgcccactcaaacccaacaatgtatgttagagtccatttccattgatttcatcatgccctctattcctgttgatggcaatcacttagaaagtccaaggctctatagttatccctcatccaccagggttatccacatgtagctgtgttccaaatctatccccatagacccttggacctgccccctagaataacgatggtttcagttaatcccctcatatcctaaacttccttttgagcaacttttccttcacttgattgccctaataaaaattatattgtcttctgtaacagggactggaggtgaggaggtgtctctgttgctcctgattgtcttcccagatcattctctctccttccttcctaaaaacttccagctcctttgaagtatcatattatatatccaataaccttttttaaattctctctctctctcctttctcttttttctctctctctttctctcacacacacatatacccacaccttagtgacttccttatctatgtaaatgatcattccagtatcctggagttatattcctgatctcttattttcttttctctcttttttttttttattatagacaaagggaaacaccggtgtttcccttggtctctttttttcttttttttttttttggagagtggagttccgctctctcgtggcccaagcgggagttgcatgggcacgcaactctcagctcaccacaggcctccacctcccgaggtttcaggcatttctctttcctcagccctcccgagttagcgggtttccgggctgtgtgccaccacttcgggctatttgggtttttttaagtagagagggggtccccccatgtgggtcagccggttctcga

SEQ ID NO: 217341 - DNA, 284 bp, Homo sapiens
ccctggcgttctgctcaggtgtttttgtttaatgaagaacgtcaaacatctggcaaggtcggaatgattttgcgatgagcacgcctggattctgcggtgaaagcgacatgtgtgcgccttcacggcctcgctgtccctgcatcagcccatctcgtcaggcagatcaacatgaagctgtaaaacggatgacttaggccgggcgtcgtgatgggcgcctgtaatcccagctactcgggaggctgaggcaggaaaaccgcttgaacctgggaggcggaggttgcagt

SEQ ID NO: 217342 - DNA, 441 bp, Homo sapiens
gccccatgagccttgggtgggtttctcctcagccctagtgacccctaaaattacccccccgacccacccactgtcccctgatgcttcccccacccccggaaaaagctgtggcctccctctcatttggggcaggctgcctcctgttctctttttctggtgtttcagcaaggcaggccagtggaggtgaggtgaccagaagatggctaaagggaaaacaaaatggtgggcctctttttgggaaactgggccagggtttgggggccctgtgctggtggaggagagaagaccccagggcgatggtaggagacgaaagcttgggctgcagcgtaagcttggaggcccgctgcggtggctcacgcctgtaatcccagagctttgggaggctgagacaggaggattgcttgagcccaggagtttgagaccagcctgggtctcaaacca

SEQ ID NO: 217343 - DNA, 1048 bp, Homo sapiens
  misc_feature (871)..(871): n is a, c, g, or t
aatacgtttgtggtaggaacacatctcttggccacataggaaattgcattcctagatccttctctttgttctgagtttaatgttacatactcattgcactcaggaaactgtttaaaagatcctgggacagtttgttgcctggataagaaaattcagtgagcctgagttcccttccagactggagctccctaagggaggaaccatttcttattcatcattggtttgcattggctggcaacatgcctggcacataaaggcaatcaatgaaatatgacttaaataattgattaccattgccacaatgatagaggttgctgatgtgctgttattacagaacagggtaggctcccagctgtagagggccctttagggaccatgctgcctggagtggatcagacagtctcatctctgcttccatcaggccatcaccagggttctcagtcaggaatgcctgctgctgtctatatttgccatgcaataagattagacgaaggaaaaatggcccatttgggggctaccgctgtaccttaaaaattctaccattaatgtcactccctcaggatctttgttgctgttggggttttgtttatttgtatttttttgcaattacaggtcaatagagcttgggaacctgttagaaggagtcaaatcttaccaactcttcaatatgcaatatggctggctcacaactaatccaaagggtatgggactgagaagagaaacactttagcaagtaggcaggaaaggagacccattccagaccatgagaatagctccagttccttggtcagaaaggaatagtgctacatgggagtatgagtcctggagagggagtgtgcaccagaagtggcacccaggcgcaattctgcanccaggcgcacttctgcacccaggcgcacttctgcacccaggcgcacttctgcacccaggcgcacttctgcaccacaggcgcacttctgcacccaggcgcacttctccacccaggcgcacctctctctagtgatgtctgtgccatttatcaccccctcaccaccagaagtgcgcctgg

SEQ ID NO: 217344 - DNA, 428 bp, Homo sapiens
agtcttatttgctcagattcagttaaacctagcagcaaagtctcaggcaaaatggtaaagcagatatatatcctttttacggcttttggtctttttaacattctttttccctgtgtattctttctcttctcctatggttaacccctttttctatgtccctttacccgagacctaaaagttaatgtatgtaaggtttaatactattatccaatttttgttgttttgttttttaactaagactttcatttttgagacctcaccaaaaaattgatcccagcttttctactttctgctggccagtgtatcaactttttttttttttttgaggtggagtcttgctctgtcgcccagggtggagttgcagtgagccgagatcgcgccattgcactgtaacctgggcgacaagagtggaacttaacccccccaca

SEQ ID NO: 217345 - DNA, 450 bp, Homo sapiens
ataagctctggtgtacttcaatcctaggctgcagcaatttaaggcaaatttacttaatgcacatggaaagatctctaacattctagaagggaaaaagtcaatgaataccacagtgaaatactattcaaaactcatcagaaaggcaaaaagtaaaaagtctgtcaataccaagtattggcagggatgtggcgcaacagaaaccgcattcctacttatgggagcttaaccactttggtgaggttgaagaactgcatacactacagctctgcaattccatttctgggtatgtaccattcttgcacacgtgcacaaagagaatactgaaagcttttctaatagtaaaaaacaaaacaaactaacaaaaatactgggaacaaactaaatatccaccaattgctgaactgatgaacaaaatgtagtctatacatacaatagaatactacgcagcag

SEQ ID NO: 217346 - DNA, 173 bp, Homo sapiens
ctttgtttctaggtatccccctcgtttccagctgctctgctgttctttattctttattctgttctctatttttcagggccataatgattcaccttcctgcagcccaagttgttgcatggttgggaatgtgcttagagaaagaaaagaaaaggaaagggaagggagaagggatg

SEQ ID NO: 217347 - DNA, 509 bp, Homo sapiens
taggaattttttagttctattataatcatatgggacaaccattgtataagtggtccactgttggctgaaatgctattatgcagtttgcatgactgtactgaaagaaaaagctatccgtccaaaattcttgaccaggtgaaaataactttttatgttgtcattcctcccaccccaaatatcttcaaaggcaaaatagtgaagttttcagatataaaaaagctgaaagagggccaggtgtggtggctcacgcctgtaatccaaacactttgggaggccaagatggaaggatcacttgagcccaggagttccagtccagcctgggaaacatagccaaactggctatgttttatagactccatctttacgaaaagtcaaagattagctgagcatggtggtgtgcacctgtggtcctagctacttgggaggcaggaggatcacttaaggccaggaggtggagactgcacttaagcgcaggtgacagagtaagatcttgtttcttaaaaaaaaaa

SEQ ID NO: 217348 - DNA, 430 bp, Homo sapiens
aaatttaaatctacccgtaagcccaactaggtagatactgtcgtcattccctatttacaggtgaagaaatagaagctgagaaactaactttcccaggggcatatatttagtaaactggaaaacccaggcttctacccagtgagttcaaccactaggctttaattgctttcaggatcagagaagtctgttctctggtagctttaaactatgaacccaatacagagtgtcttcaaatttgggttgatatataaacgttatttttcccacagttgaggctgcaccgaggacacacttctggtgatgaatggcatatgagggtgctgggctgagtgggtggggtgacatcacatcacacccgtgacaaagagggagcaggtatttactgaagatacaggagccctgtgtcagggcagtaagcattcgtacataa

SEQ ID NO: 217349 - DNA, 610 bp, Homo sapiens
aaatttaaatctacccgtaagcccaactaggtagatactgtcgtcattccctatttacaggtgaagaaatagaagctgagaaactaactttcccaggggcatatatttagtaaactggaaaacccaggcttctacccagtgagttcaaccactaggctttaattgctttcaggatcagagaagtctgttctctggtagctttaaactatgaacccaatacagagtgtcttcaaatttgggttgatatataaacgttatttttcccacagttgaggctgcaccgaggacacacttctggtgatgaatggcatatgagggtgctgggctgagtgggtggggtgacatcacatcaattaattttgtctgtcttgaactttatataagtggaatcacacatatgtaccctttgagtgtgtcttttatttttggtacaatattgtgtctgtgagcctcatccagtgtgttgcatgaagcagtagttttgtctttgtcatgggtatatagtgttctgttgtgtgaatataacatttgtgatattgtgaaatatatttggccttagtcctctgttcttgacataaaactcctaaaatatttggtatcttcaaagtga

SEQ ID NO: 217350 - DNA, 357 bp, Homo sapiens
gatcaaggtggagaccatttccagcaccccgtagtctctgtgcccctcctagctcatacctctcagaggcaaccactgtcctgacctccagcaccatcaattaattttgtctgtcttgaactttatataagtggaatcacacatatgtaccctttgagtgtgtcttttatttttggtacaatattgtgtctgtgagcctcatccagtgtgttgcatgaagcagtagttttgtctttgtcatgggtatatagtgttctgttgtgtgaatataacatttgtgatattgtgaaatatatttggccttagtcctctgttcttgacataaaactcctaaaatatttggtatcttcaaagtga

SEQ ID NO: 217351 - DNA, 188 bp, Homo sapiens
gcattaatatttaactgtaaaacatttgtcaccaggcagctgtgattgcaagtagaggagtaatttcaaacaagaatgcttaaaagttagctatgccttgataaaataggtttatcattaatagattgcattcccatgacatgataagaccagatcaaggacagaccttacagaattgcaaacccatt

SEQ ID NO: 217352 - DNA, 594 bp, Homo sapiens
gtccatgccttcctttgtaccaaatgcctttagctcctgaatccttatttggttctgtggggcagatttgctgctgcttgtcagtattactctctgtagggtttcatcttcctccatctgtctccatatacattataatctaccttcatgaattaaagcttcagcttcatatatttcctggctttattgaagtttgttgatatttcttatttttcttgttgttctgtggtggaaatgtcattacactattagtttcttagtactgccataacaaagcaccacaaactgagtagcttaaaagagcaaaaatgtattgtcccacagttctgaaggccagaaatccaaaatcgagatgttggcagggccatgtttactctgaaacttggagaagagaatccttccttgcttcttctaccttctggcatttgctggcaatccttggcatctcctgatttgtagatgcctcacttcagtctttgcctccattgtcatatggctgtcttctcgcggtatgtttctttatttcttctcctcttcttataaagacactggtcatgtcatattggatttggatccattttaatgacctcatcc

SEQ ID NO: 217353 - DNA, 376 bp, Homo sapiens
tgtagcttatgttgtacccacaaagaaagaattgaaatttgacatttcagttatttcaaaaatgatctctttgaccttattttccttttattccagtctctcagatttcaccggcccttaggctatttgcttgacagcatctctgaagaaaaacatgttaagcttttctagtgagatacagctgatggcagccattgtcaaaagctatcagtggatttctttgtatcagcaaaatgcagttgacatctaacatggaacctgtgcattaatctttattcatacaaaatgttaaaatatttatacacttaattatgccttatcttgtccagtttgtccaagtatactaataaatttgaaaataatttcagttgattat

SEQ ID NO: 217354 - DNA, 471 bp, Homo sapiens
caccattggaaatataatcccctaaagttatgagtaaacaaatgatggtggggtgtggagggtagaaagaaggcctaagcttgatgtgggggccacagcctgggcaagagaaatttccagcaaagcctctgacaaatttctgacaaagcctctcatgttatctagttgtggcagaagcatctgaaccaaatggctaggaagcttggtgaacagtcagacccagtgagggttgattaatggatccatgtcagcctagactagagggaagtctccagcagtatgccttagggctcagtctgggcctgtgtcctctctgacatttttattgacaactgaccgaagcagcaggctcatcaagtttgcaggtgatagagctaggaggggcagttaatactttgcatgaaagagtcaggattcaaaacgatttcaacaggctggaacactgggctggaaccaacaagattaaactta

SEQ ID NO: 217355 - DNA, 183 bp, Homo sapiens
gaaaacttaattttgaaaaaatgtagcgcattctccttcatgatctattatttatgcagtggtaaagttgtatttgtgcctgactccatagtttgcaagatcggtaatctaatcagttgatctccatcctgagagcctttctttcttgttcccagctccctactaaatttccatgccccacac

SEQ ID NO: 217356 - DNA, 284 bp, Homo sapiens
tctctagccattctgtagctttgggaaagtacaatgtataccccacatactatctttgtttatgcctggaatttagtcacccaatttcttcaccagctcctactcattttttttttttttgcaatatatctgctctagaagctttctctaactttttcctattccattgcctttattctttctgcagagtgatatcaggggccacacatccccatggcaggcagtgcttagcttggcatagggcttctcactctgtttcctcacctgctttctgcatgtactgt

SEQ ID NO: 217357 - DNA, 443 bp, Homo sapiens
gtcatgaccatgaagttagttttgtgaaaattcaacaacagaaaaagggcttcatgcttacttttgcaaagcatgatgtgggaaacacaatgtgagactgcttttgagatgttttgtgttagatttatctaaaattcaaggccaggtgaggtggctcacacttgtaatttcttttaaggttttcttgagacagtcttgctctgttgcccaggccggagtgcaatggcactaccactgcagcatcagcctccccaagtgatcctcttacctcagcctcctgagtggctggtaccacagatacatgccaccacacctggcttatttttaaattctttctagagacgggttttctctgtgttgtccaggctggtctcgaactcctgggcttaagtgatcctctctcctgcatggaggactcttcagactcccgagactcctgggat

SEQ ID NO: 217358 - DNA, 244 bp, Homo sapiens
gtcatgaccatgaagttagttttgtgaaaattcaacaacagaaaaagggcttcatgcttacttttgcaaagcatgatgtgggaaacacaatgtgagactgcttttgagatgttttgtgttagatttatctaaaattcaaggccaggtgaggtggctcacacttgtaatcccagcactttgagaggctgaagcaggtggatcacctgaggtcagaagttcgagaccagcctagtcaacgtggcga

SEQ ID NO: 217359 - DNA, 434 bp, Homo sapiens
agatggggcgtctgagtcagctcgggctgccacaacaccagacactacatggcttaaacaacaggactttatttctcacagtactggaggctggaaagtccaagcttgaaggtgctggccaatcccgttcccggcgattgggcccctccctggcttgcagaggcctgagttcccgtggagtcaccacgcgcctttccttggtatgtgcacgtggagagatctctccttctcttataaggtcactaatccagccgggcgtggtggctcatgcctgtaatcccagcactttgggaggccaaggtgggcggatcacctgaagtcaggagtttaagaacagcctggccaacatggagaaatcccgcctctaataaaaatacaaaacattagccgggcatggtggcgggcacctgtaatcccagctactcgggggactg

SEQ ID NO: 217360 - DNA, 435 bp, Homo sapiens
aatgccaagtcccccacttgctgtgctttccctctcccataagcacagattctccatggtacataaccactgctggagagtacgggaggagtggtgttggtgattcaagacggtctttcctacctcttgagtgcctctttcagtgagaggaagtcaaaaccaggtactgtgattgcttacctgatggttagttcttatgatggtgcttttttatgtgtaggtagttgttaaaatgtggtattcctgcacaggggcatgattggtggaggcttctattcagccatcttgctccacctcagaactgttatattttcctgtttgagaatgaggcttcatgtttgcataaagaaaaagtttaaatgtataatttattttgacttaattcccatgttgtatttctaggttaaaaagtgaaactgtagggtactacaacca

SEQ ID NO: 217361 - DNA, 515 bp, Homo sapiens
gcagatgaacacacaacattactatatattttataagcacaactcagaacatatatcaagcttaatagagtatgaggtgggggagaagttggataaaacaggtgttcagaacaaaaggagaaaagaaagcttgagcaggattttagaatacttatcatgactatgtcccatgcactattaggaatggttagcctaattctctgcacttgaggtccaacaagcaaacaaaaccacttctattacacagcttgttagcagcaaaggcagaacttgaagcaaagttgcaagaatttctgttcctaattttattctctttttatattgcatactgcttttgtactaaatatttacataatatattcatgtgataaggatattgtaattcaattcaaatacatttattaagcagcaattatatgtaaaagattgattgtcttgggtgttcaaggacaacacagctagacgtataagccaaataaagcttggctaagtttggtctagttcaatttttttaa

SEQ ID NO: 217362 - DNA, 338 bp, Homo sapiens
  misc_feature (24)..(24): n is a, c, g, or t
  misc_feature (32)..(33): n is a, c, g, or t
  misc_feature (41)..(41): n is a, c, g, or t
  misc_feature (53)..(53): n is a, c, g, or t
  misc_feature (55)..(55): n is a, c, g, or t
  misc_feature (73)..(73): n is a, c, g, or t
tcccgctattgagggaaggaaggntgaggtgnnaggaaatntgagcctaggangncaggctgcagtgagccangattcacagcactgcactgcagcctgggtgacaaagcaagacctgtgtgaaattaaaaggaggtattcataaggacttaggagtgacacatttaagcaaagacctgaatgttgagaagcagctagccatttgaagatcttcatgaattccaggtagaaggaactgtaattgttaaatttctgaggtatgcctctacagttgatgttttgaaggcaattgagagaagatgaaattaataggggtactctatataaagtaatgggaa

SEQ ID NO: 217363 - DNA, 550 bp, Homo sapiens
cgtcccaagcgttccgggccgcgtcttccagagcctctgctcccagcggggtcgctgcggcctggcccgaaggatttgactctttgctgggaggcgcgctgctcagggttctggtgggtcctctgggcccaggagctgggagggctgcgccggcctctggagccccgggagccagtgccgaggtagggagacaacttccgccgcagggcgccggacggtcggggcagagcaggcgacaggtgtccctaggccgcagggcgcttccatagcgccatccccaccaggcactctactcgaaatcggaaagctcgaccttttgcgttcgcctctgccaagcctgttatttgtgctggccgctgggtctggagctgcgcttctcggcccctccccggtggagcgcagagggctggtctgcaagcgcggcctccagccccgcggctccccggcccaggagccaggcgcgggctgacccgggagcacccggcagcggagggggctggaagcggaccctaggcctctcctgtgccacccggccctaccgcgcggccgc

SEQ ID NO: 217364 - DNA, 345 bp, Homo sapiens
tggtgaccttcccgagagccacaggggcggcctcggcacccctccttccctcgccctccctgccgcccatccccaccaggcactctactcgaaatcggaaagctcgaccttttgcgttcgcctctgccaagcctgttatttgtgctggccgctgggtctggagctgcgcttctcggcccctccccggtggagcgcagagggctggtctgcaagcgcggcctccagccccgcggctccccggcccaggagccaggcgcgggctgacccgggagcacccggcagcggagggggctggaagcggaccctaggcctctcctgtgccacccggccctaccgcgcggccgc

SEQ ID NO: 217365 - DNA, 454 bp, Homo sapiens
gactccctgtcaaaaaaaaaaaaaaaaaaaaaaagaaaagaaaagaaaagaaaaaaaagaaatgagtgactatctcctgctgtcccctgtccctcatatctctcccctgggcagtctccatgtttgttcttgagttctccagtgcctgggtactcattacctgatgctttctcctgggtgtaggaatgccacgttgacccatcaccggggctacttggcctacccatcaccatccttaaagttgggagggccttacgaattagtgactacctgccatctctactaaaatacaaaaaaaattagccaggtgttgtggcacatgcctgtaatctcagctactcaggaggctgaggcaaaagaatcgcttgaacccagaaggcagaggttgcagtgagccgagatcgcgccactgcactccagcctgggtgacagagtgagacgagactccctgtca

SEQ ID NO: 217366 - DNA, 466 bp, Homo sapiens
gctctcactccagggagctcacactgcttaccttaaaatggcctaaagagctgctgctcctccggagggacatttcaccagccctggtagaaggtgccggccagatgcccagggcatcagcacccaggcagctccagacaggccagccacgtatgaccagtgtcctgcctcgcctgtgcttgtcattcgggagctgattgatttgtgtatttctttatttatttcacacatactaagtgctaagaactgtttttaaaagcttcatgaatattaaatcacttttttcaagatgatcaactctggtttggctaggctcccagtcactctctccttctcttgttcctgccatttgaatggctttttggcagaggactggcaaagcgtggggtgatggcagggtggcgtaagttgctccaacagcacttggtgagtctttggtggatggggaggttggaaatacctggag

SEQ ID NO: 217367 - DNA, 514 bp, Homo sapiens
ttatcagactaacatgcagcctatgcttctgataaacatttactttgtgataattttgaggaaatattttgagatagattctattagtatgtattttatagagagagtttccagctagtgtgttgagctcaaaatgtttctgtttgttagttgtcctagcatattggtgcttcttcacctcatcctttgagaattgctggggcttcctatttagaatggagctggctgggcacagcccattacatgcctgtaatcccagcactttgagaggccgaggcagtggatcacttgagatcaggagtttgagaccagcctggccaacatgatgaaaccctgactctactaaaaatacaaaaaaattatctggatgtggtgatgcgcatctgtaagcccagctactgggaagctgaggcaggagaatcgcttgaacccgggaggtggaggttgcagtgagccgacatattgccactgcactccagcctgggcaacagagcaagactccatctcagggaaa

SEQ ID NO: 217368 - DNA, 636 bp, Homo sapiens
aataacaaaaaatatttattcttgaatttaatttactaaactagttttggatatatgctacttttgtcccccttaaaccaaccagatgcagttatttgcatgagtattaatgaatagagcctatttgttgttagtaccagattttcaatccaggaagaaatgagggtttggggagagagactattaatgttttatgattacatactgtaattgtattaggttactaaaccagttaattatacaaaagattttgtaatctcagcaacaaggaataaagaaacagaaaatgagttagtattaaagattgtctttgttgggtgtctatttttgttaaaccttacaaatccaatttaaaaactaaactaacgcatacctgacaaaatattcttacatttctcagtctctactttagttgttctttgacccttttctccccaaagtaactattgcccaaattaagcttcaggagaaaacaaaatcaagaacgacaagcaacatttccaaaattatataaactttttggtccttaatgattttgaaacagagttgagaggccgtatagttcaacctacttttgtttttggtttggtatttaacttttgtttctctatctgcattctctccagattctgaaaa

SEQ ID NO: 217369 - DNA, 551 bp, Homo sapiens
gagaacctatgaatgtgtgccatgcatggccagcctcctccgtgagctctgcatctgcagatttaaccaaccacgactgaacacgtacagattcctgtcatgattctctaaataatacagcatgaccaccatctacacaggatattgcagtaggtattacaagtcatccaggatgtgcatagcttatatgcagatactacaccattttctatcagggacttgcacatccatgggcaggaggttgagtcctggaaccaatcacccatggattgtaaggaataactgtactattttaactactgttcaagttcagatttttcacttcagcctgagaggtactgtttatttaattgaaggattttcgatcatcattatattccaataacttgggacacagtaggcctttaaggggttatcaaaataactagttctttgcagtcttttttttttttttgagatggaatcttgctctgtcacttgggctggagtgcagtggcacaatctcagctcactgcaatctctgcctcttgggttcaaccaattaattctcc

SEQ ID NO: 217370 - DNA, 149 bp, Homo sapiens
tgctgggattacaggcgtgagccgatgcgctcagccaaaatgaaatcttttaatctgaaataagatgaatctgataagataaagacaaaatgacaccatgagagttcatgtaagagataaagccaagaagataagatgttaaaacagaa

SEQ ID NO: 217371 - DNA, 599 bp, Homo sapiens
ggtgggaggatcaattgagcccaggactttgagacaagcttaggcatcatagcaagaccccatcttttaataataattatagaattagagttaactttataataagtttagcacttaaaaagcagtatgttatttaatccttacaacaacccagttgttgctattgttattcttattttacaatcaaggaaataagtttgcagagattaaaataaagtgtccagagtcactcagtgacagaccctggacttgaacccagttctttctaagtctaaccctaaggtctaactgctacataactttaaaaaattataatattacatacattattaaaatatattagtgatataactaatatcactgagttttggctcaatgacagtcttaactatggtcattaatatttatgaggactctaaaggcctctctttgagcctaggaattctataataaacctcaagtagtgagcataaatgtatcttatttaaagatgtaaaacagcactcatgtttaactcatctgtgaagcaaaaaacgacccagaaaagcctttctttcctgactctaaatgagattctgaaaaatgcgttcgcgggcttc

SEQ ID NO: 217372 - DNA, 597 bp, Homo sapiens
tatcaaagttataaataactgagtagatcctgtatgaaattgggaacttccttttccataagataataaatgcctgcatcagggacatggtccttattctctttttgttccttttacttaaacttctcccttactggctgctattctatcctcccttctctaattacacatagacacatctatgcttccaccctctttctcctttcagaatgtgcttaaacacacttagtaaaaacagtccattttgggatatcattttctccttgcgcgggagtcttttaaggttttaggatgaagcattattgacaggtaacttgtgtcctttctaatcactgttgaatcatccctgcagtttctgtgtttattcttatgcctgatcacattcgataacaaagcttgtgcaaaatcaaaaacaaaaaggtcttgaactgcaatcaaataaaggggagctacctggttaacaaattttacaaaacatttattggaaaatatatctatcccatgagataggacacagtcaaaggaccacccactttctccattaacatgtggatagctgtctgcttcttactgcactttcattctctaaaaataacc

SEQ ID NO: 217373 - DNA, 775 bp, Homo sapiens
acggcgttcagtgctgaggatccagcacagccaagaggtgggctcgtcttaaggggctccctatgtagtaggggagatgggcagttaacacagagggtaatggctaaagagggggcgcttctctaaactaaaaccaggcataaaaggaccaacggcctaatgcggcataccaactggatcctcgttcaaacaaaccaactctaaaggtcatttctgacacaatcaaggatatctgcaggtggacaggtgatgtctaagaagcacagttaattctgttacgtgcagtagtgaagtgtggttatgcaagacaacgtcctttttaaaagagttgtatactggattatatagaggccaaatgacatgacattagacatttgctttaaaatatctcaggaataaatattcctttcagaggggaagggagaaaaagagagagaggaagccaaccaggcataatctcaataactgtggaagctgggtaatgagtatatggggctgattatgcattatgagtttgtgtatgtgaaaatgtttgtaatatttttgagagaggactgcaatacatcctggtagataccctcatggacatagctcgcataaaagctaaggaaatacagagcaaagagcacagaggatttgcaaaaccagaaaataaatctgccaagtttctgagtgttttaaatgccatttcatagtgaggtgagaagacatgttcataaataattacaatatagggtgagaaagggtaagtactgtagccccccctcatctcagg

SEQ ID NO: 217374 - DNA, 372 bp, Homo sapiens
atagtatctatgtcttattgctcaagatctaaactcttatgtttgggagtaggggtttgctgtgtatgtgtgtatttttttttaacatcttggcctcacagtgtaaagtgataagctcaggaggaatgttgtgctgcagaacgcctacattactagattacttacggcaacactttctttaatgaggatctctgtgaaaccatctttttttccacttacagtttcaataagaggagatcagttatgaaattaagtaggagagaacaatagagagagagagagttcagcattcctcttcaagctagctaatatttttaaaatgtcgacactgttccaggaactctgctttttaggccaaagattctgccctgg

SEQ ID NO: 217375 - DNA, 710 bp, Homo sapiens
cttggtttactaaatctctttctaggcaagtgcaagtgcaattcttcacaaccatgaagaactggacttgtacctcttctcttggagaagagatgagggcatcttttagatctgcctttcataagagagtgcaaattaatctgagcgacagaaggagaggattgcaccagatccagtttatctgcctctcaaatcttctgcatcacgcctgcccaagcctgagcaacttgctcttcttcctcttcggcatggccccaggatattccctggcataactgtgattgtctgcttgcttctgccatcacctcaccttctatcacatctatctcagcctcccctgaggtgatgagggcctggcctttgcccatttgctatcacttgcactgggacaggagtttcagtagctccagtgcccaggtacccctggatggattggctgtgtcttagaagctttgcagagtggcaggaagcacaacctggaagtaagaggaggttaacacatgcatattaaagtccaattttcgttgcacatcacaatccgattgagaaatggttcagtgttcttgcatagaacaagagaagatgacacttcagctcatgaggcacccacttaccaagttttttcacctttacaatttgctttaaacgctgaacgactgtggaatggtcaacgttgagtgctttgtcaacttctagtatagttttaagag

SEQ ID NO: 217376 - DNA, 496 bp, Homo sapiens
gtgtgatgaggtgttaggaacacaggaatcagctggtcaagtcaaatcctctacagcaggacagcacatggagtgtgggctctggaatctgaaattcctgggtttatatctttgctctgttatttattagatggatgacctagaaaccaaaaagtatctgagccatgtctgaatcagtttagagatttattttgccaagattaaggacatgcctggaagaaaggaacacagaatcacagaaacaatctgcagtctgtgcctttctccaaaggtgattttgaggtctttagtatttaaaggggaaaagtaggctggagggaaaaatgggaatgtatggtcacatgactgaatccacatgttgccagagaaaaggagcagataggggaatagtcaaatatgtattcttctcacgctcagtaaatcggggctttacataagataaggtgaacctagagtagctatctgtggagatagttaagcttttatctgtagctaa

SEQ ID NO: 217377 - DNA, 570 bp, Homo sapiens
cagatgatggtgctctgaggatgttggaattcaccattgcttcactaacagaccaccccaaagcttagtggcttaaaacagtgatttcttacttcccataattctgtggtttgactgggctcagctgggcagtgtttctgttccacatgctgcagactgaactcaatcgagcaggctgaggcaggagaatggcgtgaacccgggaggcggagcttgcagtgagctgagatggcgccactgcactccagcttgggtgacagagtgagactctgcctcataaaaaaagacttaatgcaccaactatatccgctcatccagttattttgtagggttcatgtgagagttaaatgaagttgaaagattggaattaaactgacatagtctggaatgcttagggatgtagcttctgtacaatttggaacaaaggagaagttaagactgcattttaaaatatcactggccaagctgaatcagagggactaactctagagaggagattccagaggcagtgagggaatatataatggaaatttattaaggcttagtgactaaacttgagggtgagagaag

SEQ ID NO: 217378 - DNA, 390 bp, Homo sapiens
gagcaggcagctgtggggtctgcatgacatgctgaggtgtcttgtctgccgggaggtcacgctggcaccatcttgggcagagctaggttggaaaggggctgtttgtcaaagcaaaacagacatatgcttgagctgtgttctgggatgctcttaagttgctcggagacaacttgatccctttgagttttgttttagcatttgctcggtgggaacacagcagattttaatgtaagattaataatattagttgacaatctccaatgcttggcaaggctgtagttggaaacgaggactcatacgctgtcagtaggagtggtagtaacatctatctggacatttatttggcattttctattaagggaaagatgtgcatacccttccagctgtagg

SEQ ID NO: 217379 - DNA, 423 bp, Homo sapiens
ctctttgtctttttctctcaccactctgatactctggtgtcttcagatgtagatcttctattctacttgaggttcactgagatgagcttcttggatctttagattaacatttttcatcaaaattttaaagttatcagccttggccgggcgcggtggctcatgcctttaatcccagcactttgaggggccgaggcgagtggatcacgaggtcaggagatcgagaccatcctggctaacattgtgaaactctgtctctactaaaagtacaaaaaattggcctggtgtggtggcagttgcctgtagtcccagctactcgggaggctgaggcaggagaatggcgtgaacccgggaggcggagcttgcagtgagccaagatcacaccactgcactccagcataggcgacagagcaagactctgtctca

SEQ ID NO: 217380 - DNA, 337 bp, Homo sapiens
tgcacccccctcccaccccacaccaccaccaagctgctgtctttctgagtcagcttctgtagggtaagtgttcacagctggtgcagctctttgggaaacctaacctcccagtgagctgagcccctggtgcggccgccacgcttgcttctgccccacaagggcagtaagcacaggacttctggatggatctgggagcctgccccttgggatttggcaaaacttcccatctccttagctacctgtccttaatcttatccctgacccctcgagggctttcaagatagcctctgttaacatcactaccctctgcctgtgtagaactttatagaaaggctag

SEQ ID NO: 217381 - DNA, 562 bp, Homo sapiens
agaaaaagttatatcaaacaaatacttgtcttgcttgggtagtaagagccaaataatacaggtatctttagttcaacagcggcacctttataagcttgtatttaaaaaatacttttgctttagttataattaatttccaaggctccacagacttgatggcaaactcaattgtctagcaaacctcacccatacagacatatttgagaattacagagagaaaaaaaaaagcctatgacaaatctaggcttcatagaggtatctctgagatgttgtctcagaatgttttgtcttactgaatgcacagttttaaattctaagtgaaggaatatatcgaaaatgtttaacaaagtacctgccactgtattatgtgaatttaaatgactgctcttattacaagtaggcatagtgatagtattgacaagtgacagtctaatgacaaaaagacaaaaatagcgaagcataaatgtaagaatgcaaaatgcttagtcacatgagatattttggcatgaacactggaagcccagtatgctttagtaatccctgaggacattgatatgcctta

SEQ ID NO: 217382 - DNA, 637 bp, Homo sapiens
agaggacccccaggtcttttcccctcaaacacacatcccatttgtatgtccttatgtcctgataagataatagcatgctgttagaagatttattgtctgagatgtgaatattcatacaaataaatttttcttgttcattttcacatttaaaaccattattttaagtggatggggaattggcttattaatggaatctcgctgaagaaggaacattggatgttctgtgattattgtggctcagtggtatatggaaccttgtcattgaacaggagtgttggaaggaactttcagatttttttagactagtaagggtatgattttgcacccaatgagatatttgcagtttctggagacatttttggttgttacaacttgaggggaagggagcggtgctactggtaggcatctagtggttagaggctagggatgctactaaacatcctataacgcacaagacagccccccatcccaaacaaagaattatccatctcagtagtgcccaggttaagaagtcctgctttggaatactgagtaaggagcaagaagatctgggctcttgtggcaaattttttcacttcagggcacctcttttcttcatttgcaaaatggagataaaaatattctccctggtcatctc

SEQ ID NO: 217383 - DNA, 293 bp, Homo sapiens
gaatggactaagaaaagactcaaatttctaaaatgagaaatggaaatgggacattactattgattttacagaaataaaaaggattgtaatgtagtactatgaaaaattctataccaacaaattgtataacctaatgaaatagacaaattcctagaaacataaaccataccaagataaatcatgaagaaatggaaaatctaaatagacttataactactaagaagatttggtgaatgtgaccaaacatttaaagaagaactaataccatccttctcaaacttttctgaaaagta

SEQ ID NO: 217384 - DNA, 226 bp, Homo sapiens
tatagctttataaagcgtaaatgaatttatatattttaactaaggtaccttctagttaacagtgcccatacattttagaaaatgttttagtctttacagaataagtaaggcaaaaacaggtccagaagtctatagctgacctcccctcaccacaaggccaagttgtttttgtttttgtttttgttttttcagaaagagtttcgctcttgttgactaggctggagtg

SEQ ID NO: 217385 - DNA, 408 bp, Homo sapiens
tggctcactcactttgggagagttcgggtgccatgttgtgaggacactaagcagccctatggagaagtgcacctggggaggaactgaggtctcctgccaacagccagcagtatcttgcccacctcatgtgagccattttggaagtggggcccctgtagagcctccagatgatggcagccccagcagacctctttactgcaacgcatgagagcccctgagccagaaccacccagccaaacagctcccaaattcctgacccacagaaactgtgagacataaagaacgttcattattgttttaagcctatatgtatagttatgcagcaacagataaccagtacattgggagagtatttagtctgcagtttttatggtcaaactgaggtaaataacaaaatcgtagggaaac

SEQ ID NO: 217386 - DNA, 740 bp, Homo sapiens
agcggacaggacggcttccgggatttggcggggcctttgtctctagctgctgcgggagctccaggtctagtctttactgctctgtgtattctgctcctagaggcccagcctctgtgactccgttatctgcaggtattgggagatgcacagctaagatgccaggaccacctggaagcctagaaatgggaccactgacatttagggatgtggccatagaattctctctggaggagtggcaatgcctggacactgcacaacggaatttatataggaaagtgatgtttgagaactacagaaacctggtcttcctgggtattgctgtctctaagcctcacctgataacctgtttggagcaaggaaaagagccctggaataggaagagacaggagatggtagccaaacccccagagtcttactgtgttgctcaggctgatcttgaactcctggtctcaagttatcttactgccttggcctccctaaagatgtgggattacagaaataatccactttgccaggctactatgtagcccttcatgtagaactgtgctagtcataatgaatcataacactgtcaccttttattttgaaaagtctttatttttatctgttttttaaagtacactaatcttgaatcaagtattcttggttaggaattttattactgcatcaaaatttgggaagttcttagcctttttcatctacaagtaacctctacattactttttccctacattcttctt

SEQ ID NO: 217387 - DNA, 1167 bp, Homo sapiens
agcggacaggacggcttccgggatttggcggggcctttgtctctagctgctgcgggagctccaggtctagtctttactgctctgtgtattctgctcctagaggcccagcctctgtgactccgttatctgcaggtattgggagatgcacagctaagatgccaggaccacctggaagcctagaaatgggaccactgacatttagggatgtggccatagaattctctctggaggagtggcaatgcctggacactgcacaacggaatttatataggaaagtgatgtttgagaactacagaaacctggtcttcctgggtattgctgtctctaagcctcacctgataacctgtttggagcaaggaaaagagccctggaataggaagagacaggagatggtagccaaacccccagttatatattctcatttcactgaagacctttggccagagcatagcataaaagattcttttcaaaaagtgatactgagaggatatggaaaatgtggacatgagaatttacaattaagaataagttgtaaaagtgtggatgagtctaaggtgttcaaagaaggttataatgaacttaaccaatgtttgagaactacccagagcaaaatatttcaatgtgataaatacgtgaaagtctttcataaattttcaaattcaaacagtcataagaaaagaaatactggaaagaaggttttcaaatgtaaagaatgtggcaaatcattttgcatgctttcacatctaacacaacatataagaattcacactagagagaattcttacaaatgtgaggaatgtggcaaagttcttaactggttctcagagcttattaaacataagggaattcatatgggagagaaaccctacaaatgtgaggaatgtggcaaagcctttaaccaatcctcaacccttattaaacataagaaaattcatattgaagagaaacccttcaaatgtgaagaatgtggcaaagcctttagtttattctcaatccttagtaaacataagataattcatactggagacaaaccttacaaatgtgatgaatgtcacaaagcctttaactggtttgcaacccttactaaccataagagaattcatactggagagaaacccttcaaatgtgaagaatgtggcaaagactttaaccagttttcaaacctta

SEQ ID NO: 217388 - DNA, 1145 bp, Homo sapiens
  misc_feature (49)..(49): n is a, c, g, or t
  misc_feature (76)..(76): n is a, c, g, or t
  misc_feature (138)..(138): n is a, c, g, or t
  misc_feature (155)..(156): n is a, c, g, or t
aaaaaaagaaggcaggtaaggtccggaattcacgggaacaggtctagtntattacagcactgtgtattatagcacnaaaaagacagcatctgtaaataagttataagaaggaattgggagaagcacagcaaaaaagcnaggaccaactggaagcnnagaaatgggaccactgacatttagggatgtggccatagaattctctctggaggagtggcaatgcctggacactgcacaacggaatttatataggaaagtgatgtttgagaactacagaaacctggtcttcctgggtattgctgtctctaagcctcacctgataacctgtttggagcaaggaaaagagccctggaataggaagagacaggagatggtagccaaacccccagttatatattctcatttcactgaagacctttggccagagcatagcataaaagattcttttcaaaaagtgatactgagaggatatggaaaatgtggacatgagaatttacaattaagaataagttgtaaaagtgtggatgagtctaaggtgttcaaagaaggttataatgaacttaaccaatgtttgagaactacccagagcaaaatatttcaatgtgataaatacgtgaaagtctttcataaattttcaaattcaaacagtcataagaaaagaaatactggaaagaaggttttcaaatgtaaagaatgtggcaaatcattttgcatgctttcacatctaacacaacatataagaattcacactagagagaattcttacaaatgtgaggaatgtggcaaagttcttaactggttctcagagcttattaaacataagggaattcatatgggagagaaaccctacaaatgtgaggaatgtggcaaagcctttaaccaatcctcaacccttattaaacataagaaaattcatattgaagagaaacccttcaaatgtgaagaatgtggcaaagcctttagtttattctcaatccttagtaaacataagataattcatactggagacaaaccttacaaatgtgatgaatgtcacaaagcctttaactggtttgcaacccttactaaccataagagaattcatactggagagaaacccttcaaatgtgaagaatgtggcaaagactttaaccagttttcaaacctta

SEQ ID NO: 217389 - DNA, 1040 bp, Homo sapiens
agcggacaggacggcttccgggatttggcggggcctttgtctctagctgctgcgggagctccaggtctagtctttactgctctgtgtattctgctcctagaggcccagcctctgtgactccgttatctgcaggtattgggagatgcacagctaagatgccaggaccacctggaagcctagaaatggtattgctgtctctaagcctcacctgataacctgtttggagcaaggaaaagagccctggaataggaagagacaggagatggtagccaaacccccagttatatattctcatttcactgaagacctttggccagagcatagcataaaagattcttttcaaaaagtgatactgagaggatatggaaaatgtggacatgagaatttacaattaagaataagttgtaaaagtgtggatgagtctaaggtgttcaaagaaggttataatgaacttaaccaatgtttgagaactacccagagcaaaatatttcaatgtgataaatacgtgaaagtctttcataaattttcaaattcaaacagtcataagaaaagaaatactggaaagaaggttttcaaatgtaaagaatgtggcaaatcattttgcatgctttcacatctaacacaacatataagaattcacactagagagaattcttacaaatgtgaggaatgtggcaaagttcttaactggttctcagagcttattaaacataagggaattcatatgggagagaaaccctacaaatgtgaggaatgtggcaaagcctttaaccaatcctcaacccttattaaacataagaaaattcatattgaagagaaacccttcaaatgtgaagaatgtggcaaagcctttagtttattctcaatccttagtaaacataagataattcatactggagacaaaccttacaaatgtgatgaatgtcacaaagcctttaactggtttgcaacccttactaaccataagagaattcatactggagagaaacccttcaaatgtgaagaatgtggcaaagactttaaccagttttcaaacctta

SEQ ID NO: 217390 - DNA, 1082 bp, Homo sapiens
acaaattcactggttatttaaaaagactatgcttgtaaatgacatatcatttttatactgcaactcacaagattctcttcttgtctgtgacttttgaaattgtgtttatatatgtgtttgttataaatatcattgtgtgtatcctaatttgttgagcttcttcatttgtacataactttttttttttttaacttttaggattttttagttatttatttttgtattttgcttatgtagtttgtgtaattttataaatttgatatgtaaaatatattcatctgagtctaggaagtggtgtaatttgttacttttatgtctttcagttatatattctcatttcactgaagacctttggccagagcatagcataaaagattcttttcaaaaagtgatactgagaggatatggaaaatgtggacatgagaatttacaattaagaataagttgtaaaagtgtggatgagtctaaggtgttcaaagaaggttataatgaacttaaccaatgtttgagaactacccagagcaaaatatttcaatgtgataaatacgtgaaagtctttcataaattttcaaattcaaacagtcataagaaaagaaatactggaaagaaggttttcaaatgtaaagaatgtggcaaatcattttgcatgctttcacatctaacacaacatataagaattcacactagagagaattcttacaaatgtgaggaatgtggcaaagttcttaactggttctcagagcttattaaacataagggaattcatatgggagagaaaccctacaaatgtgaggaatgtggcaaagcctttaaccaatcctcaacccttattaaacataagaaaattcatattgaagagaaacccttcaaatgtgaagaatgtggcaaagcctttagtttattctcaatccttagtaaacataagataattcatactggagacaaaccttacaaatgtgatgaatgtcacaaagcctttaactggtttgcaacccttactaaccataagagaattcatactggagagaaacccttcaaatgtgaagaatgtggcaaagactttaaccagttttcaaacctta

SEQ ID NO: 217391 - DNA, 1355 bp, Homo sapiens
agcggacaggacggcttccgggatttggcggggcctttgtctctagctgctgcgggagctccaggtctagtctttactgctctgtgtattctgctcctagaggcccagcctctgtgactccgttatctgcaggtattgggagatgcacagctaagatgccaggaccacctggaagcctagaaatgggaccactgacatttagggatgtggccatagaattctctctggaggagtggcaatgcctggacactgcacaacggaatttatataggaaagtgatgtttgagaactacagaaacctggtcttcctgggtattgctgtctctaagcctcacctgataacctgtttggagcaaggaaaagagccctggaataggaagagacaggagatggtagccaaacccccaggcagaactggccgtgaactgtggctcagggagctggaactgagtcatcgaactgcttcagaaaccacagtaaaggacaaggtctgcaggcctgcctgcgtggctataaatggctgtcttcctccaggcctctggaagggcacggtctctcccagactgtggctgggaggagtttgggatgattagagattatatattctcatttcactgaagacctttggccagagcatagcataaaagattcttttcaaaaagtgatactgagaggatatggaaaatgtggacatgagaatttacaattaagaataagttgtaaaagtgtggatgagtctaaggtgttcaaagaaggttataatgaacttaaccaatgtttgagaactacccagagcaaaatatttcaatgtgataaatacgtgaaagtctttcataaattttcaaattcaaacagtcataagaaaagaaatactggaaagaaggttttcaaatgtaaagaatgtggcaaatcattttgcatgctttcacatctaacacaacatataagaattcacactagagagaattcttacaaatgtgaggaatgtggcaaagttcttaactggttctcagagcttattaaacataagggaattcatatgggagagaaaccctacaaatgtgaggaatgtggcaaagcctttaaccaatcctcaacccttattaaacataagaaaattcatattgaagagaaacccttcaaatgtgaagaatgtggcaaagcctttagtttattctcaatccttagtaaacataagataattcatactggagacaaaccttacaaatgtgatgaatgtcacaaagcctttaactggtttgcaacccttactaaccataagagaattcatactggagagaaacccttcaaatgtgaagaatgtggcaaagactttaaccagttttcaaacctta

SEQ ID NO: 217392 - DNA, 420 bp, Homo sapiens
ttcccccattctttctttttgtgaaaggcaaaactcctcaaagtcataaactgttaagagagttaggtgccccaagaggagacgggagagcggtgatgccttcagggcagcagcagaagcaatggaaggatggatgaggaaccccacaaaggggagagaactctggagtctgtgaagagcggggagctgagacccaactcgttatgttacgggttgtgtgttgctggatccggcagagacagccttgatgtgtcacccaagctggagtgcagtggtgccatagctcactgtagcctccaactcctgggctcaagagatcctcccgcctcagcctcctgggcagctgggactataagcatgcttcaccacatccgacatttttaattttttaagtttaaaataaaaatgtgatgttttgta

SEQ ID NO: 217393 - DNA, 435 bp, Homo sapiens
agggtgtttacatgaccagcccccaggaaaaacccagggcactgagtctctaaggagcattcctgatagaaagcatctcacttgtgttgttacaactcactgctgagggattaaatgtgtcctgtgtgactctaccaggagagtctctaggatgcttgcctggtatcctctgggtttcaccccatgcatctttctcctttgctgattgtgctttgtatccttttgctataaaaaatcacagctgtgactatgattgtgctgagtcctgtgagtcttcctagtgaaccagtaagcctgggggtggtcctggagatccccaacacagtgggacctcagaggcctggatgccagagctggagttaaagccaccttttccagcttctcagtcacatgtttctcaggttcttcacatgaccccctccttcttctctttaa

SEQ ID NO: 217394 - DNA, 300 bp, Homo sapiens
tgaagaagagaagacatagctgtgtttgcagaacaggaaggtactcggtagggaaaggggactggggagggggagggaagaaggaaaaacttgtggctgcacaggtgggctgctcaagggatgtctaggaataagctgtgctgaaaactagaaaaaaaaaaagtcacctccagtggtccatctgatttaagttgaagaagatggccttgaatttaaatgataattgatataatgcatttcagcaggcattaactgtgagtctgctgtgtgccagcccccgcaccaggcacggaggataca

SEQ ID NO: 217395 - DNA, 501 bp, Homo sapiens
ggttcactttgttccacatggatttacagtgaccccagcaccgtttgttacaaagactgctcttttcccactgaattgaaacctttgttgaaatcagtttggtctgcttttggcttctctattctgttccattgatctgcgtgtgtgcctaccattatgccagcacaaaccctctcaactgcagctgtgtaagtcctgaaatcaggtagtttatctcatctttgttcttttttaaaacttttttagctattctaggacctttccatttccatctacattttagaattaacctgtcatttctaaagaaaaagaaggaggaggaggaggaggaggaggaagctgagattatgttaaacctatagaacaattgaggaaaactgacatcttaacatcactgagtcttccaatctgtgaacatggtttatctccatttacttagatacttaagttttaacctgccatgttctgtagattttgtaaaagtctcatatatcttatatt

SEQ ID NO: 217396 - DNA, 539 bp, Homo sapiens
ttaattttgcctctgtcctgtggtcctgtgatctcatcctgcctccacttgccttgtgatattctattaccctgttaagtacttgatgtctgtcacccacacctattcacacactccctccccttttgaaaatctctaataaaaacttgctggtttttgtggcttgtggggcatcacggatcctaccaatttgtgatgtctcccctggatgcccagctttaaaatttctctcttttgtactctgtccctttatttctcaagccggccgccgcttaggaaaaatagaaaagaacctacatgattatcggggcaggttccccgatataactagtttttcttgatatttgtgaaatcacttttgcaatccctgaaaatttagcaaactgcaccagtatattttccaaaaatgagtcttcacctccagattcatattttaaatcattcagaacaaatttattattattttcttgaatattttccatttcccattattctactgtcttctccaaagatgtcaattatggtttttcactatctgc

SEQ ID NO: 217397 - DNA, 246 bp, Homo sapiens
cagccaaattttcagctcaagaaataaaaacagggctcaaagaagtggtaactgctgtggaggaaatgacaagtaaaggaaaaccaggacaagaagtcttggaagacgaccaggaaaatactttaaaatatggtaatcaacaacacaagtttcttttgttgtagctgtggctgtttcgtttgtctttgaaatgtgatgatcaaaattttcaaaaatacccattaaatgttacccagctgtgttaca

SEQ ID NO: 217398 - DNA, 413 bp, Homo sapiens
aaatgcttatcatattatgagttccacagaaaagaggcttgaagtaatcttgtatcctagtaatttatttgagcctgcattaccatggaagcaggaatggaagtaaaggatgagttaggcaaaaaaaggaagagagaaaatacaagacatatttagctggctgtcacttcataatcacagttgatttcttcgtatgtgtttaaaaggagtctgtgaaatttctgtctctatccaagggaagaaataaaaagaatgtatatattggctctcatctttcattggtcagagttttcagggtgtcccctctgtgtatttctcaactatattttctagcctctctaaccagcccctggtgtagcaagatcccgagagagcagcaacagcacttatggcataagcagggcacattgaaa

SEQ ID NO: 217399 - DNA, 215 bp, Homo sapiens
gaatggaatcatctaatgtactcgaatggaatcaccattgaatagaatagaatggaatcaccgaatggaatcgaatggaatcatcatcatatggaattgagtggaatcatcgtatggactcgaatgtaatcatcagagactggaatcaaatggaatcattaaatggactctaatggaatcaccatcgattggaatcgaatggaatcattgaatgg

SEQ ID NO: 217400 - DNA, 129 bp, Homo sapiens
agtttccatgcctccttttcctttaaaatccctttggctaccctaaacatttgacatagtctttgaggcactagtccaccacctcctcaggttgccatctcttgaataaatctgcttttccttccacca

SEQ ID NO: 217401 - DNA, 529 bp, Homo sapiens
gctaaaatattacttaagtagatgtaaatttatgcgtagttttctgatttaaaaagtattatatgctcatgcaaaatttagaaattacaaaaaatataagagaacaaaaaaatatagtagaataagaatagtttttaaaattatcatttgatccaagcgttattaatattttggtatctttctagtattttacaccctccacacacatacaacatttataaattttgagtcatactaaacagttttatattctttttttctcaacgttatattgtgagcatttttctatgtcattatgtagacattaaaatatgtttttaatgacagcatatataagaatgagtcaagtgttttactaaaccactcttagatatataacgtttgttattccaaaaattttgccattataaatgatactgttataaacatttttatgcaaagtgttttttttttaccatattgcttattagtgtcataggaaataaaattactgtgttaaaaggaataaatattttaaaagcaaagatca

SEQ ID NO: 217402 - DNA, 340 bp, Homo sapiens
gggtagccactatcttttctcctaacaccacagattcatgttgcctatttcattttaattttatataaatgtaattgtacagtacatactgcttctttcttttgtgtaacattatgtttgaaggtagtttgttctcactgatatatagtattccattgcatgactataccacaatccatttgttcattctactgttgatggtcacctcaatggtttctagttttgggctatcatgaatagcgctgctgtggacacttttgtttgtgtcttctggtgcacatatgtacacatttttgttgggtgtatatacacatagagtagaattgctgcatcatagggc

SEQ ID NO: 217403 - DNA, 300 bp, Homo sapiens
ggaggtggcaggtgacgggttaggcccagccccctctggcctagccactcaggtacgaggcctttcccccccatcccccggggctgggatctcttttataaaaggccattcctgagagctctcctcaccaagaagcagcttctccgctccttctaggatctccgcctggttcggcccgcctgcctccactccagcctctaccatgtccatcagggtgacccagaagtcctacaaggtgtccacctctggcccccgggccttcagcagccgctcctacacgagtgggcccggttcccgcat

SEQ ID NO: 217404 - DNA, 484 bp, Homo sapiens
acgcccagctaatttttgtatttttaatagagacagggtttcgttatgttggccacgctggtcttgaactcctggcctccagtgatctgcccacctcggcctcccaaagtactgggattacaggtgtgagccactgagcttggcctaagaataggaagaatttgcatatgtaggcaggtattccaaatgtcagtagaagaataaaaaaaggcagaaatatgaaaatttactcattcatctattcaatcagaatttcttttttatttttggttatttatttgtcaccttattattttttgttttcttttctgaattgggatttcttaagcccctactacaggctgggcactatgctagaccctagagttttagagtccacttggacctgatcctcgcattccaggaaatttcaagcttagtagagggagcagttaagtaaccataaagatcctagagtattgtaaaagccatgatagaggtaatt

SEQ ID NO: 217405 - DNA, 458 bp, Homo sapiens
  misc_feature (344)..(344): n is a, c, g, or t
ggtttcattgagagtttagagctattcaataggtagcctcctatatgcaggcagttagttgtaagtcattcaaagaatgaaaccaacgagtagaagttaaatcactatactcattgggagcttaaaaaataaataaatatgatttaaaagatgatgtcaacacaggtgaaaaaggaaaaatattagaatctcctgaactgactagacagacatgtttagaagactggtcttctctggaaacaagtaaagctggcagagaaatccaaatatctctgtgttaaattatatactcatgagccaccacacccagccttatctttcattttgaatagtgagtcggattncatctagaatgcgtctctttatgtttattgccttaaccaaatattaattagccttattttatacatgtacaaatgttctaaaacaacaaaaaaggttgttttccccccttaaaa

SEQ ID NO: 217406 - DNA, 377 bp, Homo sapiens
agcgtgatttttaatttccatctttaaaacacctgagaaaaattcatgtcagctctaggttagtgttttattatgattgctttaagaaatgaaaataagaaaacaaacacattgacttcattgaaatagcagatatatctcagttattgtttaccaggccttacaaaagtcatcgtacacagttaatgcagtcatataattggaatttaccctttgaggcaaatgaaaaatatgcaagcaaagaaccaaaatagatacattaaaacttttggttaaaaaaaagaattatgaaaaccggcaaaaaaaaaatcaatgcatgctggtaaaatatgctaatcatttgtttgctcccacattaaaaaaaaaaaaaagatata

SEQ ID NO: 217407 - DNA, 627 bp, Homo sapiens
ttacattttctttatcagcttaattgtaaatcccagcccacataccaccaagctataggaaattccatctcaggcattatgggattgtcttcccctttttggtttacaccagaatcgggaggtttacatgatgctaagaaaatgaaaggggtctttgatttatagtcaccagtgatggtaatattgcctaaccttttagtggttgcttgattcctttacggcctccctgaatctcttggggcacagggcaggacctgataggagccagttaatggcccagattcttgtgcatcaggtagagtttccttcaaaatgtcgtatatcctcatgcgaactaaaaataaaatcctaaaattctaagccccccaactgactgaaaagacccctcttggctgggggaccccagagaaaccttaaaaactgagttcctagccatgacagaatgggagcttgtacacacctcattgcacccactctgttttacaacttagacacaacaactgaccagtgttaatgttaaaatggagatcataagactgacaaaatggactctttatggctataagatactaaattgtaaacaagacctaaggtcacgccaagcaagagttaagtcacatacccccg

SEQ ID NO: 217408 - DNA, 618 bp, Homo sapiens
gcatgatcttggctgactgcaacctcccacctcctgggttgaagtaattctccctgcctcagcctcccaagcagctgagattacaggtacccgccaccacacctggctaatttttttgtatttttttggtagagacagggtttcaccatgttggccaggctggtcttgaactcctgacttcagatgattcacctgccttgtcctccccaaagtgctaggattacaggcccagtaccatttgtgaaaatggtgtcctttccccattttatgtttttgtttgcttttcgaagatcagttggcttttaagtatttggatttatttctggattctctattctgttccattggtctatgtgcctgtttttgtgccagtactatgctgttttggtgactatggccttacagtgtagtttgaaattaggtagtgtgatgcctctagatttgttctttttgcttagtcttgctttggctatgtgcgctcttttttggttccatatgaattttagaaatgttttttctaattttttgaagaatgatggtggttttttgatggggattgcattgatttgtagattgcttttggcaacatggtcattttcacaatattgattctaccca

SEQ ID NO: 217409 - DNA, 393 bp, Homo sapiens
cgatgattcccttgccgatgaagaacatgaagtgtgagtccctagtgtgctaggctgtgtcctcgcgccctgtgcccccgcagcgggccctcagccggggtggggacccagcttgcgggcggcaggaggctgaggttgcccgtggccaccagatggcgctccagcattgtggaaggcaagccccacggtcctggcgtccggagtgcttgctctgctgaagggcgaaccaggaggctctcagaggagctgcagaggagcggcttgatgacatagaaggggaagaatacaagggaagtttgtaggatgcctgtaggtctgactgcctgcttccccctctgttttgacgacctcctgtgactatgccagcatttattattaaaatgtgtcctttga

SEQ ID NO: 217410 - DNA, 589 bp, Homo sapiens
ctacctggagaatgcccttccttctctcactgccagcagaaaacacttcctcagcctggcacggagcatgagtcaggtgagtccatgatgctttgtgatctatcctttgtcatctgttgttattgtgctctttcccatccttcaaggcttgagattcttaccaccccctccaggaggcctgactggattcttcccatccagaaaacattccctccttcccaagttcagcgagaagtggtcaacagggcaacactgtccaagtatgcccacctgggttcctctatttttcaagtccttagaaagcagagactaagagtcacaccacactcacaacacatcctgctcctaggccagaccctgtgggaggaacccagtacagcctgacaatggaagggggacccaagacggtccatgacctacaccagggcagacaaggccctgccctgtagctgagaagggaggaaggagccagtgctttacccagaaccccctccacaaagcactgtgcctatatgtttatatggcctcatttaatcctttcagtaacccttacatagagtgttatttcttttttttttttttttttttt

SEQ ID NO: 217411 - DNA, 425 bp, Homo sapiens
ttttgctaaagcatacatcaattgcctaaaatattagcagtcagtgcctgagatgagtgattatatattctggatggtttcctggactgactcttttccaagcaaatggctttgtcagatatttgtaatttctgaaatattttattaatgatgtcctcttgccagagggatggtccagagtacacaattagctgcatgcctcagaagcgagatgctgcccagcatccactaagatcaagcaggagttcaaggacacttctaatcaactgccatagagcagagaacagaaaatgtttttacaagttgaaggccgggtgtgtggcccatgcctgtaatcccagcacttagggggctgaggcgggaggatcacttgaggacaggagtttaaggccatcctgagcaacaaagtgagaccccatctgtac

SEQ ID NO: 217412 - DNA, 135 bp, Homo sapiens
aattacaaacttgttctttgaaagacaccattaagaaaatgaaaaggcaagccaaagactaggaagaaaatagtctcaatacatatatttgaaaaagaatttgtatctgaaatatataagcaattcctacaactc

SEQ ID NO: 217413 - DNA, 460 bp, Homo sapiens
cttacctgtgatctagaggttctgtgtagactgttaatgaatggcgatgcatgtaatggctgcctgtccctaacatacccaaataccccacacaagagtcagcactcattagaatgtcatcttatattcacatgacaccgatttgtctgaaatatttggagtgggatcaaaggaaatcttgtaatctagatccccttgggctactgaggatttctttttctatctaatgattacttttctacattgatgaaaaaattctagattcttctaaagtttataaatgtccattactttgtgatcttagtcatgtgcacttttgtcttattattattattttgaggcagggtctcagtcacccaggctggagtacagttgcagtgagctcggagggcgccacagcactccagcctgagcaacagagcgatactccatctcaaaaacaaaagggagagatgacaaa

SEQ ID NO: 217414 - DNA, 379 bp, Homo sapiens
tttttttgctttattgtcttttgataaacagaagcccttgattttaatgaagtgtaatttaatcagttttttaaaatgattgatgcagtcaggcgccgtggctcatgactgtaatcgcagcagtttgggtggctgaggtgggcagattacttgaggtcagaagttcgagaccagcctggtcaacatggcaaaagcccgtctgtactaaaaatacaaaaattaactgggtgtggtggcacatatctgtagtcccagctccttgggaggctgaggcaggaggattgcttgagcttgggaggtggaggttgcagtgagccaagatagtgccactgcactccagcctgggtgacagagtgagactccatctcaaaaaaaaaaa

SEQ ID NO: 217415 - DNA, 416 bp, Homo sapiens
taaaaaaatgttcctttgggaggccaagggggtaggattacttgagcccaggagtttaagagcagcctggacaacatagcaagaccctgtttctaaaataaataaataaataaataaaaataattagctgggcatggtagtgcacgcctgtggttccagctatttgagaagctgaggcaggaggatcattggaacccaggagggtgaggctgcagtgagctatgcttgtgccactgcactccagcctgggcgacagagcaagaccctctctcaaaaaacaaaaacaaaacgaagttctcttgtctctaaagtttctatagttcagtgtgatgacatttagaactctagaatgttgggtttgtcatttgtcaatgacacttaaatatctgtgtaatgggacagttccttccaaaaaa

SEQ ID NO: 217416 - DNA, 667 bp, Homo sapiens
aaatactcccttagttgatgccagacagtaatgctctatccgctaccttcttcttcattccaagttgtctcctaggtagacttacccagatcctctaattatcttattcctcatattcttataacattcagatatttcttcattccagacatctatcatgaaatgtaattccacatttctaaatgcttacttcttcttttaggtttccagtttcagtgactaacactatcattttttattagaaacctgagaattgctttaactttatttttccttctcactttcaatcacatataggaagtccatatttaattagtcaaaacctttgacagattatatatcctttatccataatatttctgacaacccttcactcttttcagagttcaccattcctttctttaccagaaatactgggattaagcagtgactatctgatcacatgcaaagagaacctcatcaggctaacagcaaacttctcagcagaaatcttacaagacaagagagattaggtgcctattttcagcattcttaaagaaaagaaatccaaacaagaattcatatcctgccaaactaagcttcataagtgaagaagaaataaatctttatcagaacagcagtgcaagggaattagttactattacaccaagtcttacaagagaccctt

SEQ ID NO: 217417 - DNA, 228 bp, Homo sapiens
aaatgttgcccatatgaatgcttagccagggatcaccagatagttattaaggatcttcagatagtaatgaatacttccaaaatgaaaggcagactgaaacaaactaaaaagaaacttggaaaaaatggaaacaaccaaagcagaagaaaattcaccgcccccagccccctttccaaatattcagagatctaagagattatagtgcatctatagaataagcacaccata

SEQ ID NO: 217418 - DNA, 225 bp, Homo sapiens
ggtcaacagaatactggtaccccaaagatgtgcatgttctgattgccccaaaagactctgcagatgcaattaaattaaggaccttgagatgagagaaattatcttgggcaattcaggtcagccctacataatcataagaaagtggaggtaggacaatgaaagtctgaaaaggatatgtggcaacagaagcagaggttggagtgctatgaggaaaaaaactgaaag

SEQ ID NO: 217419 - DNA, 579 bp, Homo sapiens
ctggccagcatggtgaaaccctgtctctactaaaaagacaaaaattagccgggcttggtggcagatgcctgtaatcccagctactcgggaagctgaggcaggagaatctcttgcacccgggaggcagaggttgcagtgagccgagatcctgccattgccctccagcctgagcaacagagcaagactccgtctcaagaaaaaaaaaaaaaaaaagcaatctgcccctccccatgaggtttcttttaacgtttctcagtattataaaagaaatacctgctgaggtaaagtcaaaataatcaaaatgactttaaaagtttcatttcatcctaatcttttttaaacgggaagataatatgctttctaaagcatattttaaaatgaacaggaaccacagcaagggaagttttaaaaaaaaaattacatccagcctttttatctataaaaacaaagcttgttacagaacaaacacgttcacagtaaaagaccactcgctgaggcacgaactgaagaaatgctactgtacttacaaaccgcttctagccacatcacatttggcttagatcacataaacgaaccact

SEQ ID NO: 217420 - DNA, 848 bp, Homo sapiens
ataccagtcatacagatgaggacactgaggcttagaaagagtaaatgtttttcccaccctcagccttagcaactttaaacccaggctgtgtgacttgagatttcgtggggttttttgtttatttcgctttgtttttgagacaaagtcttgccctgtcactcaggctggtgtgcagtggcatgatcttggctcactgcaacctctgtctccagggttcaggcaattctcctgcttcagcctcctgagtatctgggactacaggcacgtgccaccacgtccggctaatttttgtatttttggtagagacggggtttcaccatgctggcagggctggtcttgaactcctgacctcaagtgatccatcagcctcagcctcccaaagtgctgggattacaggcatgagctaccatgcccagtgagatttcgcattttaaactactgaccatttctttaaaaactgagtagagttcttagtgactgtaagtctggtagaatgcagcagcttccagatccattgtattttcttcctactgataacacttgccttttaacaataccttccactgagataatggcaaaattttttggctgggaaggatggctgtttatgtgaagtagcatactatcagaaaatgttgttttagccaaaaatgcgggataataaacctctcaaagagctcagtttcttgtttcttccatactgtaattcacattctcagaagatgacccttttgttcaaattgcaatggataattttagaaatactttatatatgtgatctggaaaagggatgatacagatttatgacttgggccaagatggacaaggaatgagcagagttgctgctg

SEQ ID NO: 217421 - DNA, 210 bp, Homo sapiens
ttccccacaactctatccccaacgcttttgggaaggctgataccttggaagacgtggagaaacacgttatgtgcatgaatgactttccaagcatggaaactaatacctgccctcacctcttatttttttcccatcagggttaaactatttggtattttcaaggtcaaaactactttcccttttgttagctaggttttgttgcaaaatttg

SEQ ID NO: 217422 - DNA, 516 bp, Homo sapiens
aagacagatcatggtgacagttgtacaacaacgtaaatgtacttaattacactgatctggacatttttaaagggttaaaatgatagaattttatgttatgtgtattttaccacaataaacacacacatacacacatattcagcaaactaggaatagaaggaaacttatttaacactaaaacggcatttatgaaaaactctgagtagggcatggtggcacatgcctgtagtcccagctactcaggaggctgaggcaggactgcttgatccccgggagttcgaagctgcagtgagccatgaacatgccactgcactccagcctgggcaacagagtgagaccccatctcaaacaaacaaacaaagaagttggccaggcatggtggctcacatctgtaatcccagcactttgggaggccaaggcaggtggatcacctgaggtcaggagtttgagaccagcctggctaacatggtgaaaccccgtctctactaaaaatacaaaaattagctgggtgtggtg

SEQ ID NO: 217423 - DNA, 310 bp, Homo sapiens
aagacagatcatggtgacagttgtacaacaacgtaaatgtacttaattacactgatctggacatttttaaagggttaaaatgatagaattttatgttatgtgtattttaccacaataaacacacacatacacacatattcagcaaactaggaatagaaggaaacttatttaacactaaaacggcatttatgaaaaactctgagtagggcatggtggcacatgcctgtagtcccaggcaagtcaggcgctgactcgcctgggagaggggagagcgagatgctgtagagcacatgacaaaataaaataaaat

SEQ ID NO: 217424 - DNA, 498 bp, Homo sapiens
ttcatggtagaaaaagcctggtagcattgaagaagagattgttgctagaaatatggatgttaaaagcaattctagtgagggctcagatggaagtgatgagaatggttgagaaagcttctataatcttagagaatatatataatcatatatatagaaagaatgttgctagaaataggaacattaaaggtacttctggtgagaccgtagaaagaaatgaggaacatattactggaaactgagcaaaggtgattcttataaggcgtcagagaacttggctgctgttgggcaaaaagcagaattcaagttggatgtttagctgaggagatttctaagcaaaatatggagggtgcagcctagtttctccttattgcttacagtgaagtgcaagaggaaagagataaattgaggaaggaattgttaagcacaaaggaaccagtactttatgatttgggaggttcttggtttctctgttgagaaagcacactgtggagagagctc

SEQ ID NO: 217425 - DNA, 445 bp, Homo sapiens
ctactctatcagacatggctcagaaatgctgcgtttcaatcactgcagggctgaaactcctcttcctgacacacaatggggggatttcatgagtgttctctgctttccccttcattctacagataaggaagctaagttccaggtcaaggtcagggtcccatggaaggccagcagcatggacgggtgggtgagagcagggctgtgtggatggagtgccgtgctgccactctggccaccacctcccagctacgtgtgcccctgggcatgtcagctctcctaaccttagcttcctcccccatcagatggggataataataatacctacgtcactgggttcttacaaaaatcaaattatgtgagcttacaacactgatgtgtcaggtaccattctaagctaaaatcatggcattctaatgatttattatacataaagcgttcagtgttc

SEQ ID NO: 217426 - DNA, 284 bp, Homo sapiens
ccgctctggccgagctcgaggagcccttcagtccgccactgtgctgtgggggcccctctctggggctggccgaggccccagccggctccctctgctagggaggagatgtggagggaagggcactggcgggagcctgggctgcgctccgctgggcttgatcctggacaagctccctctgagctgctggagtgccgggctaggtgccacaaagtcctgtagcgagtgccattgagaggtgaagcggctgggcttctgggtctggtggggacctggataacttttct

SEQ ID NO: 217427 - DNA, 427 bp, Homo sapiens
gcatgcaaatacccatacagttgtccctcagtatctgtcagggattggttccaggacatcctgtgggtataaaaatccaaggttgctcaagttcctgatataaaatggtatagtatttgcatataacctatgcatatccgcttgtatactttaaatcatctctagattacttataatacctaacacaatgtaaatgctatgtaaatagtcattatactttattgtttagagaataattacaggaaaaaatctgtatatgttcagtacagacacaacattttctttttttgagtatttttaattcaccaatggttgaatctgcagatgtggaatccgctgatatggagggctgacccgatatcccaaacgaattttaaaacatttttatggcctcattatctttttcaaatatatatttacccattgt

SEQ ID NO: 217428 - DNA, 1095 bp, Homo sapiens
tcgatagaagtatacaatttttgaatagtagagggaaaaataaagacaagctattaagttaaagcaaataatccaaatagaaaactgaggtttaagaacattaattgaattcatcaagggtagtaagaaactatatgaacataggattttgtgttttccgaatatctctagtccaaagccatcactatgtataaaataagatgttaattacagtttaatattcttgtaagtttaagcaaatttaccatttatacgtgatttatacaacatattacctcttgaatattgtctcaaatgactggcttcaagtagcacgttaaataaaaatagtagaataaatgtgtcaagctacacttactattcacaattattttatagttagattatggctctgttagatatacaattttatatttgcttatcttctgaattaatgttacagtaatagactacagtcatcatgcaatgtgttgtcaaatatattaataaacataagaaaaaacatagtaatatactgtgtcaaatttttctatcaagtggaaatttagcacattcttcaggaaatattgactgcaaaatctatgattaatatatttttcagaaatattggatataaatacaaaatgaagtgatgaattattgatatgtgcagttttactatcatataatgttactgataaaattaaaaaaatataactcatttttagcatcagatgaggaaacttggttcactaaagttagtattatctttatttgaatgctacaaccttgaaaaattattacatttgatagaactatttgggaacagtttgttacttctcattgtgactatggacattaatgggatgcccatattccttccattcccttttcttagcatagtggaaatgattacagatatcagttatgtttcttgactgatgttacagtcattccgcattatgaagtatgcaagactaaatttttacaaagggtatctcttatccttatgatagcctaaaaaggtgaaaatttgtcaagcaggtttcctaagatcctataaaattaggggacagggttccagcatcaagatgtagttttacttattgaattaac

SEQ ID NO: 217429 - DNA, 472 bp, Homo sapiens
cacattaccttactcatttcttctgctaccctattctcagtaaatgtgtttcccaagaaaacaggaatcccccctcagactttgcttctagaccatccactctaaagtcttaaccttgcatgcatgttttcttctctctgtattttacatgtataacgtgatcaacccacggagttattagaattcttccaattaaatgagatatagcagagaatgagtctattttattggctagcaaatagcaaagtgttaaattcaataatggctgaaattgttaccaagtagtaggctcttttattagcttatcggactaccaaaatagtataatgcatcaatatcaaacttaaatttcaacttcataaaacaattctgggcccaacaaatatgaaggtattgctccatcttatgtagcaacatcttgtatttctattgtttgataaatattccacttagaactaaaacatggatgtct

SEQ ID NO: 217430 - DNA, 436 bp, Homo sapiens
ctaatgaacagaatatggcaaaagtgataggatgtaggatgtcacttctatgattaggctccaaaagattgtgacttctgatgtgctagttctctctctctgtcactatctcttgccctcttctttgctccctctgatgaagccagctgccacagtgtgagctgccctatggagaggcctctatagcaagaaagtgaggccttcagtccagcaaccctcaagcaactgaaacctgccaacaaccacatgagtcagcttggaagtggatccattacccatcaggctttcagatgagaccacagccccggctgccaccttgattccaacttcatgagagatccagagacagagaacctagctaatctgtgactagattcctgactcacagaaactatgagataataaatgtctgttgttttaagctgctaaattctag

SEQ ID NO: 217431 - DNA, 618 bp, Homo sapiens
ctgtttgcaagggaatcaaagaagtaggatatgatacttcctcttcttgacagccttatggttaaggagctttcccttttctgttccggacggtcatcaccatgttcctgttggaaggtgctgcttctcaaggcagcccagggcgctgcagagcagttctagacagccacaagtcctttgcacactgaaccgtcatctgagcctctcctgtttggtcaggtgctttcccattcagtcaccttgctctgaaacattgcaactgtcagattccttcttcccatatgtctcctggatataggtaattttataaaattaaattttgagagattcctcttaagaaaaaaaaaaaaaaaataaaaaaaaaaaaaaaaaaaaaacaaataaaaaaaaaaaaaaaaataaaaaaaaccaaaaaaaccctaacaaaaaaaaaaaaggccaaaaaaaaaataaaaacaaaatatcgcgcccaatattgggcttcttgggccaattcccccttatggggctcgtttacaaataacgggcccgggtttaaaacagtttgctttggaaaacccgtggggtcccaaatatatcgccttgggaaaaatccctttttgcccggtggggcgcccc

SEQ ID NO: 217432 - DNA, 178 bp, Homo sapiens
agccccaacttgccaagcatgtgaacaagctaaactgaaagcagatcttcagccccaatcaagccttcagatgacagtaacctcagccaatatactgactataacctcataaaagaccctgaaccagaaccctctaagccactctcaaactctaccccacataaactgtgaaataata

SEQ ID NO: 217433 - DNA, 496 bp, Homo sapiens
tgctatatattgttttatacattacatctgagtgctttgcctttgtgtctttttacaacctaatgtaagagccttttgttcctggcttagaggaatttaacccagtggataaacttacctggactaaatagttgctgaaaatgcatctgtaaatttaaacttaactgtaaattttattcaattcctgaatatatactttcttatgtatttattatttatttttcacttgactaaggtattatcaagcgttttaaatacctgctccatatttgaaaatatgttgtatttgcctccacaaatgagaagtaatttggattaatatgtaaactcacttatcctttataactattgccacagtatattactgtgtttgcaaagtctagtataatatgtgattctctttcctttgtatgatctctccactttaagaaaacttgtacatattatctttcacaaaaaatgctccaaatttctatacattaaagttagaaagtta

SEQ ID NO: 217434 - DNA, 466 bp, Homo sapiens
gaacacttaggagtcacctcagacaaaccagacccacccagagggtcccccacctccccacattcccacctctggtgttgctctttccaccactgttctctcagccaactgcaagccctgtgataaacccttcctcccagtggaattttgttttcttgtctttgaaatagaggttgctgagcagcatcggcactgtccaatagaaatataacagcagccacgtatctcacttaatcttgtctatttatcacatgagaaaaagtgaaaagaaacaggtggaattaattttaatagtatgttttaaccaatatgcccaaacaattgtcatttcaacatgtaatcagggccaggcctggtggctcatatctgtaatcctagcactttgggaagctgaggccagagaatcccttgagaccaggagttcgagaccaccctgagcaacaaaataaaactccatctctacatt

SEQ ID NO: 217435 - DNA, 595 bp, Homo sapiens
ttgacctcccaggctcaagcaatcctcctgcctcagcccctcaggtagctgggattataggcacacgctaccacgcctggctattttttgtatattttgtggaggtggggtttcaccgtgttgcccaggctggtctcaaactcctgagctcaagcgatctgcccaccttggcctcccaaagtgctgggattaaaggcgtgagccactgtccctggccaagactctgggtttagtaagcctcttgcaactcactaggagtggatttctaggacctccccactttcttgcttgttgtttcttttgctagccgtaagtccctggagtacactgggtactttatgggaaaaagaggaacagtgtgggacagactttgccctgggctgcttaacgtgatgtggggaacagaggtgataagagcctgtggcagctcaggcagccctgccatgacctggagttggggaggggtatcaaggataacaagtcttatacacatgccatgctgtttctttggatcaatagatggataatttttaaaaccccctgtatgtatcaaactcactttggagatgtaaggcatggcctctgtcctggtgac

SEQ ID NO: 217436 - DNA, 324 bp, Homo sapiens
aataaaaatttttaaaaagtgtgacagttgagctatgttaagaggattaagtattggaggatgtggctgtctcatatggggggttggggttgcagtatattctaaggcacatggaatctggaaaaggcattgaaatgagtaaatgttaagagatttcagctttggagctatgtgttcagacacccacagtttatacagcttgagtggtggccctttgatttatgctgtttttaggcccctctagtaggaatcaaaagtgttttttactttttaagactcaactggagccagcgtgaaacctacccctctaatgtatttgcctgg

SEQ ID NO: 217437 - DNA, 351 bp, Homo sapiens
acaatatatattatatatattgtatatagtatataatatatatttgagatggagtctggctctgcactccagtgtgggacatagagtgagactctgtctcaataaataaatgaataagtaaataaataaataaatatggtccttggttgcagtacccaggtgctcggtaaaagcaagcacacatgctctctgcaagagtgccttcagcctaagcctcaaggaattttcatgaaatacaagctcacacacaaagcaataaaaggacaaatctttgagaaaatgaatgaagataaaagtgagaacactagaatgggaattttttgttaaatgtcataactataggtaatgcag

SEQ ID NO: 217438 - DNA, 467 bp, Homo sapiens
caaaccaggcaggcaggccaaattagtcagagcaatgtttgctggccactataacaagcaacccaaaatctcagtggcttaaaataaaacttacgtctttctcattcgaagtcattgtcccttcagtggccctacttggttggtctcctccgagtggtaactcagagataggagctgcttccatactataactctgccacctggaacatgtgggttcctggattcccacaggaggaaagaagagagtagtgtcttatggtcaactctggaagtggccagcgttccatctacacagcactggtcagaacacggtcataggctcccaacatcacccataagggagtctgggaaatgtagtcttttcaggtttccaacaagtgggggccacgcgatgaggaaaacaaggagttcaattctggacaaatcaatcggaatcgaccactcttgtcacacaggagcacacaatc

SEQ ID NO: 217439 - DNA, 779 bp, Homo sapiens
taatcttctgccccaggcatctgagagttaaatgggtttgaaatgtttttaagctttttttggccttggatctgacttaggcaaaacagaagaggagtgccttgtgtcagtcagactccagacacattagaacagacacacacaatacattttgaatgaggtctccagcagcttctggtaggcacttaaggttagaaaacattgtttaggaaaagaatagaatataaagcttagcggttggttgtagaaggttcttgctgctggatccactcagctcctgggcagttggtggggggccagcctccagctgaccagtgagtgggatgctgggctggagctgctggtattatgttaggaaggttattcctgagaaattcagatacttgttgactgaattggtatgatgcttatagtctttcttaaatgattaaagtttaacatattattaaatttaaaaatattgtgaaataatacttcttgtagaacatttagaccgtaaaagtggatgtgaaaaattatccattgccgggcgggcacggctgcacgcctgaaatcccagcactttgggaggctgaggtgggcggatcatgaggtcaggagtttgagaccagcctggccagcatacaaaaaattaaccgggcatggtggtgtgtgcctgtaatcagctattcaggaggctaaggcaggagaattgcctgaacctgggaagtggaagttgcagtgagctgagatcatgccactgcactccggcctgggcgacaagagtgagactccatctc

SEQ ID NO: 217440 - DNA, 805 bp, Homo sapiens
  misc_feature (232)..(232): n is a, c, g, or t
cttcgacggtgttctgttataatttgactattagatattctgggatcttactgatccgaatgtgtccaattcaattgacattttccaagtataaaccactgttaaagagttgcctatttttattcataaattatacttagtttgttagcatggccaccaaaatagccaccaccaaccccaactgtcctgtcccattgatcttcctaaaaaacactttactaatcatagcctncagaccaggcccttggacaaataagaaccatgttctcgaccgggcgcagtagctcacgcctgtaatcccagctattctggaagctgaggcaggagaaccccttgaacctgggaggtggaggttatagtgagctgctggtattatgttaggaaggttattcctgagaaattcagatacttgttgactgaattggtatgatgcttatagtctttcttaaatgattaaagtttaacatattattaaatttaaaaatattgtgaaataatacttcttgtagaacatttagaccgtaaaagtggatgtgaaaaattatccattgccgggcgggcacggctgcacgcctgaaatcccagcactttgggaggctgaggtgggcggatcatgaggtcaggagtttgagaccagcctggccagcatacaaaaaattaaccgggcatggtggtgtgtgcctgtaatcagctattcaggaggctaaggcaggagaattgcctgaacctgggaagtggaagttgcagtgagctgagatcatgccactgcactccggcctgggcgacaagagtgagactccatctc

SEQ ID NO: 217441 - DNA, 511 bp, Homo sapiens
tcctacacatgttgtctattctctatgcaaatttgctaaatttggaataatttttttctgtgattttttttttgtggtagttctgtttcgttagcaaaactgctttgattctcctttattgtacttgaaaaacaaaggtggcgttttaaattaagtattttacttgtttttccatttgagtaagggttttaaatatctagcaattttacggtaatttttttttcaatttcctttgtctgtatagcacaggtaagtattgcaagtcatttaagtataacacaggtgtccagccagtagataggatctacttgtagatatctgaactggctgtagttgttactggctttcttttttctactagaattcccagtcaggaaagacatatgatgtgtagtggtgacctttgtccttctatggtcaagatttaaacattataaccagtgtttctttcttgttctctgttctttggtgatattgggactttcagaaaataagaaataggtcttcctca

SEQ ID NO: 217442 - DNA, 357 bp, Homo sapiens
aatctggtcatggtactgttatttaaaatgtgtaacttttcaaactgtattgttaaatttgcaatattttagaggttgtggtaaaatttaacatgcaaaattgctttaattgcaaaatattgctttacagaatgatattcaaaaacattcagagttcataaatttcaacaaaaattaatgccagtcatgctttgtttctgagtttagtagattagtacaccacgtagtatcttttgggattgagtctactattcaaatgtatattttatacttttgggaaatacctaaaattcatgtaataaagaacaccaacttgtaataaatataataaatgtagtagtttttgaaaactgtaaa

SEQ ID NO: 217443 - DNA, 399 bp, Homo sapiens
tccaggtctctcttgtgtactcctgcccaaaacctggaggaagccattcctgcaaggcacccttcttgcctttattggggaaatggtgttttaagactgcagtctgggacccatggatgctcattgctactaagtaggtcattgtttctaggccttattagtgggcagagctaggaaatattataggttgcaggctcgctctctttctttaaaaatataccatgaaaatatgtgtgtgtgcatgtgtgtgtgtgcatgcatttatggtaaactagctcacaagttctgatgggtatttccaaatcaaattcaagaatatagggtttttacttaactctttctatcctgtatttgtttttttgtttcgcttgggtctcaagaagccaggggatgatagaa

SEQ ID NO: 217444 - DNA, 421 bp, Homo sapiens
gcaccttttcaacagggatttgttgaataaattaagaaaggaacctttactgtcatattttaaccacctaatttcagtttatttcagtcgttttattgaaaattattctcaaaatcatttttgaaagaaagctatgagtttaatattttattataaggacaagtttccgtgacttaacattgcattgtttattctaggcatactcatgtaagtcatgacatgctttaatgacttctgtattccagtagacactaaaggtcaatgaaagcagaaacttttctctggtagctgctctatcctcaaagccaagaacatagcctagaatgtagcaggtaggtaatcagtaaataatttttgaataaataaaggaattatttaatgaaatataaaagccaagaaaagacaggaagaaaaacaggaa

SEQ ID NO: 217445 - DNA, 519 bp, Homo sapiens
gtctgcaataaattgggagggagaggggaggaactagttcttcactatagacaaatgtcagtttagaagatctatgctgtttggtttgggaaatgaaaggtttgggctacatttattgtttgaatttggagggacagagagattactagggactagagtggtttgagcaggatttatggaacaagtgtgacttcacattgttacaaattataggtgaagaatgaaggaacattccaggatcaagtttcctaaaatttggaaataaactgtggaaattctcctaaggtttgtatctttcttgtctgaatctaagaatctttttctattatgatgagtgagatcaggaaatgaattaaaatattttaatttcctccttggttttgaagttctttaaagaagggatttagaatttaaatagtatggttattagtatctttgagtgaaggagaaagcgtaaattaaatgtcttctcattttttaaattaggtagaaaagcttactcccacttaagaaaaagaa

SEQ ID NO: 217446 - DNA, 457 bp, Homo sapiens
gagagagtttttcttgagtctttatttttccaaggtggtaaattgatgcatgtttaaagacagttggaaatttcagggtggaagttatggacaaaggatctatacttgatcctgctgagaggttctagggaggtaacaatgatgaggccccctgagactagccagaaagctaaccagaagtcgtaagacagaagaggactaggcctctcatatgatgtagagactgtaaatgtagtcctctggcttccagggaaaaagaaatatctgccatacctggttgaggccctttaacacctaaagaattccagcaaaaggtcacagaaaactcttgaagactgatacaaaggttttgaaagaatcctaaatatagtctggggttggtcttcagacctctgctgatacaacactttctctcacgtctctcacgctcctttggttgcttcagaggaaaagcttc

SEQ ID NO: 217447 - DNA, 359 bp, Homo sapiens
ctgggtaacatagtgagaccctatctctacaaaaaaataaaaaaatgagcctggtgtagtggcacacaccagctgaggagggagaatcgagcctaggagttcaaggctgtggtgagccgtgatcataccacaacactccagcctgaggtgactgagtgagaataagaaaaaaaaaaaggatggcctgagcccaggagtctccagcctggggaacagagagaccttgtctctaaaaaaattcctcccatataacgagcttccaatttctaaattttagcttgactaaaagtgcttttcaaaatagtctttgccactgtttaattatattaatgttacaaaaaaaaagcccttgccattct

SEQ ID NO: 217448 - DNA, 297 bp, Homo sapiens
actggccaaaaagtatctaagttgttttaccatgtgttcatatgcatttgcacaaactgtcaaagtgctcagaaataggaaaccttatttaaggatgcctccaactagaaatccttgaatggaaagactggcaatatggtaaaagtgaattgttatttatacatcaccgatttctttcaagtgtatgctttagttaagaggcttatcaagtgaaccagctttccctgaattgagctccgaaggaagataggctaccccagtcctgcttgaaactaaactgtcttttactgttaacag

SEQ ID NO: 217449 - DNA, 665 bp, Homo sapiens
tgagttttaaaatccaacgtgatcagccaataagctaggggcttcatcatatcagctgtgaataataacagttgtatatcttttccatttctttcttttcttcctctttctggcttgctgaagtggctggaaccgcctcagtgagcatagcatgtctctattccccttcgcatcagacgaggcagcttgaaggctggagactggaatcatgttaagagccttgtggttggtacctggaagacttaaatagatgggggttggcacagctgggaatccttgggtatctttctcttcaccatggtggctttagggctccaaaagcacatgtcccaagggagaaggagacacaagcaaaagttatggtgtcaccgtctatgacttggctttgtgagtcacacagtatttttcctgtcaccttctatttgtcagaagtgagtaaactagggctgccccatattcaaggaggggacaattagactccaccttttcgtgggaggagtatcacagaatttgtggatgtattttaaaagcagcacaatcgatgttctaccccaaattatttacatgtttccttcatgcaaaatacacttgcttcatcccaggacttgcaaagttgtatctattaagagatcaggtttaggtttgaggcccagggtcttgtcatc

SEQ ID NO: 217450 - DNA, 273 bp, Homo sapiens
gtcaaatagagaagctgataaagctgaacagaacttaatctcactatataagtaaactgtttaggacaacaaattgttttctctcatttgactttcactattatttcagagattagaaagctgacctcaacatacaattataattattcatcattacctcagactataacaaccaagtcacacaactcctatctcttatctaacattgaaagagtgcttaatatgtatatactaacaccatgcctaccattcttgatgtaccatctcaatcct

SEQ ID NO: 217451 - DNA, 499 bp, Homo sapiens
acagccaagtatcctgtccgtagggtaggctaagggatgatgtctgctatgataagaagctgagtttataatggcatcgcccagtgttcaattgattatatgcctgaaacactggaaatatatgtggactttgtcctctgtaccttgttcctaggatagaaaaatctagttggggtctaactctgataataataataataatatgtcacttgaagcattcctcctgcttgagagaccaggaatccaggcaaagccacttgctgtcccttttcctctcctagggtcaggccagagagaaagagaagggttggactttaatgtgaggttgctgcctctttttctagattttcttccctaaaaaatgcttaaatcatgttgaccagagataggacctgtagacctctcacccacttttctgcctctggcacttgaaaggcttttcaaggatgtcagcactgtggctgggggaggcgggtcgccctcgccagcctctgctgtg

SEQ ID NO: 217452 - DNA, 415 bp, Homo sapiens
gatcacctgaggtcaggagtttgacaccagcctgaccaacatggcgaaaccccatctctactaaaaatacaaaaattagccgggcgtggtggcgggtgcctgtaatcccagctactcaggaggcggaggttgcagtgagccaagatcgcgccactgcactccagcctgggtgacagggcaagatttcgtctcaaaaaaaagaattcataattattatatgttctaggaaggaaacaaacagtgtactgagacagtaaatgatttgtgggagataatcttatcttagataggtttgtcacttttaaaatgagacctgaatctgtaatcccagcactttgggaggctgaggcgggcagatcacgaagtcaggagttcgagaccagcttggccaacatagtgaaaccctgtctctagt

SEQ ID NO: 217453 - DNA, 269 bp, Homo sapiens
gtgtctggcctgctggagtctgacccttccacctagaagcagggtctagtgaagaaaaagatttatatccctattaaaaaaaaaaaaaaagtggccgggcatgttggcttacgcctgtaatcccagcactttgggaggccgtggctggtggatcacttgaggtcaggagttcaagaccagcctggccaacatggtgaaacccatctctactaaaaatacaaaattagctgggtgtggtggctggcgcacgcctgtaatcccagctactt

SEQ ID NO: 217454 - DNA, 249 bp, Homo sapiens
gagaagaacaaaattccgtctcaaataaataaataagataataggactctgaggctgtatgactgccaccctgtaggtcagaaatgggatctgattccagctcttatccgtaagctaggtgaatgcaaactgacatgcccaagcttattgatattgcaaaattatttattacacaaaagattggaagcaacccagatactcatcaataagagactggttaagaaaaatgatgacacactatgtagttgc

SEQ ID NO: 217455 - DNA, 643 bp, Homo sapiens
agtcccagctacttagggggctgaggcaggagaattgcttgagccagggaagcagaggttgcagtgagcagaccactgtacccagcctgggttgcagagcaagaccctgtctcaaaacaacaaaaacctgaccctggtccctttgtgacatgtcccttttgactccccagagcggtttgcctctcctcccaggccccatgcttgcttcctctaaacatcatcatgtgcccgaatttgtctgcaggcatgtttgcccaaattgcacaggcactgtacattttatatactttctttcagttagtcttacagcaaccccgttttgaaataggtgctgttttctttttttttttttcaccagtgttacttgccaacaggtggtttttaaacctgctttacaactgcgaaatctggaggctcaatgaggttacaaaattgactgtgctcactcagctaataagtggtagaatcagaattcaaatccagaatgtgtggcgttgagctgaggttccctcccaggctgagttccgtgaagggagggagtgtgtgtctgttttatccttatagcagtagaaccagaaacacagttggcgcctgataaatgtttgagctgaatggagtctcccaaattaaaagtttttcctgg

SEQ ID NO: 217456 - DNA, 592 bp, Homo sapiens
tggacagatcatgaggtcaggagttcgagactagcccggccaacgcagtgaaaccctgtctcaaaacaacaaaaacctgaccctggtccctttgtgacatgtcccttttgactccccagagcggtttgcctctcctcccaggccccatgcttgcttcctctaaacatcatcatgtgcccgaatttgtctgcaggcatgtttgcccaaattgcacaggcactgtacattttatatactttctttcagttagtcttacagcaaccccgttttgaaataggtgctgttttctttttttttttttcaccagtgttacttgccaacaggtggtttttaaacctgctttacaactgcgaaatctggaggctcaatgaggttacaaaattgactgtgctcactcagctaataagtggtagaatcagaattcaaatccagaatgtgtggcgttgagctgaggttccctcccaggctgagttccgtgaagggagggagtgtgtgtctgttttatccttatagcagtagaaccagaaacacagttggcgcctgataaatgtttgagctgaatggagtctcccaaattaaaagtttttcctgg

SEQ ID NO: 217457 - DNA, 459 bp, Homo sapiens
gtggttgtatgctgtgtaggtggtaggtgttgtgttgcataggatactttattatttttgtatttattttctcatttgatctcaccagcaaccttttaggggtccttacctgaccttacaagtgaggaaacaggtaaggaaggccgggttactcaggagtcagtttaggagagtaattaagagcctgtacctgagccaagatactgggtttgaatcctgaatctgccacttaccgtgaccatggccaaattgctttctctctctgtgccttggtttcctcatctgtggaatggggataataacaggaccttgtattgtgagggttaaataagttagtaagtgttgacagcagtgtgtggcacatggtaagtactgtgtaagcgtaagctgctatatttatgtgtgtatttgagcctgggcaacagagtgagactccatctcaggaaaaaaaaaaaaaaa

SEQ ID NO: 217458 - DNA, 453 bp, Homo sapiens
gtatctagaagctttgatgttggatgtatttacagttgtcccttggtgtgggattgcttccagtacctctgtgtgtaacaaaagctgcaccattcaagtcccacagttgccctgcgaaacctctgtatatgaaaagttggccctccatgtacatgggtttcccatcctgtgagtactgtatttttgatcctcatttggttggaaaaaatctgcatataagtggacctgtgcagttcaaacccgtgttgttcaagggtcagctgtatatttacagttgttatattgtcttgataaattgatcctctgtcattatgtaatgatgttctttgtcttgttttacagtttttacttagtctgttttaagtatagctacccctgctctctttggtttccatttgcctgaaatgtctttttctagcctttcactttcattctatgtgtgttcttaaatgt

SEQ ID NO: 217459 - DNA, 347 bp, Homo sapiens
aaaatttaagatattctcctactgagaaacagtagtcctttacccaattataatgtctgtgtgctttcccagctgttacaaactcttcagagtggaaacatgaatttaaacgtctctgatacaccacccatgaaaggaaccttttttgaggactagactacattaggaaaaagtatagttacagtatacaacgcaggaactcagttgaaatatgctaaaacatgtatgaagagatcctagttttcaagaggtagtataataaccatgaataagttctagcttttccagaacttggcttcagtgtacatctgaatgttttagtagagttgttagaagcagttaaaaaa

SEQ ID NO: 217460 - DNA, 576 bp, Homo sapiens
ccattacaaaccccagtattcctcctacacacacacttacacacataccagatatgcttgctcattgaccccgaactaaactagtaaacatctctctttccctttaggtcaggatgtatgttcttccatttccacctcctggctcttgacctcatctcttgtaaatggatccctcgtggacccaccctacagtcctgcagacatgcccagacatggctaaatcccagagtgaacacagatcttgacatctactacactactaattagcaatgaagtactttccattatatacacacagcctcttttgcagattgttgctgatgatttacataacttgccctttatttctaaaaagaaaaaaaattatattttagtacattgaatacattgagaacattcaaagataaaaatatatcacttatgtggatggcactttgtggtcttccttccaaaaatccataactgtggtttaaccatgagaaaaacattagaaaacccaaatcaaagaacaatctagaaaagtatctgactagtactacaaaactgtcaaggtcatcaaaaccaggaaactcagaa

SEQ ID NO: 217461 - DNA, 434 bp, Homo sapiens
gacattattatttcaccaaatgtatattcttactcaagcttgcataaaaattaataggcatccaactaatgcttgtgattgccctgtttggtgactgtgagcagtcaccaaaggtaaaaggccttgagtataacatttattgtttatgaattctatttctttccctttgggtgcccactatttttaattctctggggaacttggcagtggtactcttcttgataatactctgtcctaaacattttctttacctagaattatgttttaacactttgttttatttttaattaaaggatacagtcttcttttttagaataaaaatatattttatgatttcttagagtgagtacatacatctaaatgtagttatcaatcactgttttaattattatttatattgcatcataaattataatgagtttgttaaggtattc

SEQ ID NO: 217462 - DNA, 529 bp, Homo sapiens
ggttagatggtaaggattttctgtttcacagatttttagactgggaattgtgctattataaaataatattttacattaaataatgctatctaggttgtaatcaccttaatagacatgatttatttgggccacaaatgaactctggtaagaatggagggctggttacattattttagttttacagatgaaaataatcagtctcaaatagcttaagggaattcctttagaccatatggttagtatatggaaaagccagagctagaacccaggttctgatttccagagcagttcttatttcatgataccgcataattttataatgtccctaaatccgaatttcatttctcatgatgtgaaaggattctctttatttctgtttggttagctgcatcagagcatgacagaaatggagcagaatttgagtattctttccccagatgggtcagttagcttttcttaaagctattctgtgcttacattgttaatcagttgtccctggttcctagacaggatgttgatccatgtgaaa

SEQ ID NO: 217463 - DNA, 470 bp, Homo sapiens
ctttgcagaaagaaacatggtagacattttcgaagttttctttattaaaaaagttttttgacgttttctgtggccatatgacttgctttggccattgtggtataatcattgtggtataatcaggagtgatatggctcactttggaaccgaatctttaaaagccaattaataatttactgcttgcacttcccacagctctggtgatcacagatgctcatgtcaacaagcctccattatctcacatccctgagtcactccaagggcagattgatctaatgatctacgtaggacatgtacacgaaatgcaaactttccatttgtcaagcaagcaaaattttgaagttactttatactgcggaattactgaccccactgtgactgtcagaataacaacatgtgtcttcattcgtttctgtaataactgtgctaccctacctgatatcttctgaataaaaggatatctaaacact

SEQ ID NO: 217464 - DNA, 977 bp, Homo sapiens
aggagactacaaaaaaaggaaaggaaatgcattggaatgtccaggaagaggtgaccacaaaccagtctccccggaaagctgcagcccagattcacgttacttgaaaaaggaatctgaataatcctatttatttaaagaaaatcttcccacaaagaaaactctaaactgggcgtgttggctcactcttgtaatcccagcactttggaaagctgaggcgggtgaatcacttgagctcacaagttcgagaccagtctgggcaaaatggcaaaactctgtctctactaaaaataaaaaaagtggccaggtgccatggtgcgcacctgtagtcccagctacttaggaggctgagttgggaggctcacttgagcccaggagcagaggttgcagtaagccgagatcaccgcactgcactccagcctgggcgacagagtgagacctcatctcaaagaaaaaaaaaaaagaaaggaaaagaaaactctaggccttgatattttcattgtcgttttctaccagtcaaggaagactatctttctgaaaggtatttaagcagaaaaataaatgcccacagaaaatagcacaagggaaacgccctagctacacaattttagtacatttctcattcatattcccttcaacaatgctaaaacgtgttcatttcattacactaagcaattctataattactcaaaatatggtgaaagactttcttctctaattctatctagtctttcatattgctcactatattgactgccattactataatctgttaaataatgagcatttcagaaagtattgtaatacctaaaaatgttaaatgatagtctagtcgcaggaatcaaaaccacagtccatccacatctgcacactggtgacaagtcgtctgaccataataaaataataacttaatattatatattttaatagtcataattttaaaattattctctcttgttagtaataaaaattattcaggt

SEQ ID NO: 217465 - DNA, 739 bp, Homo sapiens
gagttactaatatttccttaaggattttttatttatgttaatgaaggatattagtctgtggttttcttgtattctctttggttttggtatcagtaatactgacatcagtttatgagattaaaattacaagtatttccttttctattatttttttaagagattgtataataattggtgttatttcttctttaaatgtgtgatagaatttgtccttgaagccatccaggtctggagattttttgcagaagatttctaattacaaattcagtttcttaaaataattataataggattattcatagttgtctgtttcatcttgtgtgactttatgtagtttgtgttttttgaggaattagtccatttcatttaaattatccaattcatgtgtatggaatttattattgtgttcacttatccttttaaggaattagaggtctgtagtgatgtctcatctttcctgatatcccttctttccattagtaatttatgtctgctgactttttttcttggttaatttttcaggaggtttttcaatttttatttttttccaaggactggctttttatttcattaggttttctctgttgctttcttgttctcaatttcgttgatttctactctttattatttctttctatttactttaggtttattttggctcctttttgccaagagtgcgactgcaaaagtctttggtgggaaaagggggcgagatgggccttatgcccaaaagaaaaaa

SEQ ID NO: 217466 - DNA, 653 bp, Homo sapiens
gagaccatcctaggcaacatggtaaaaccccatctctactaaaaatacaaaaaaattagctgggcatggtggcacacatctgtaatctcatccactcaggaggctgaggcatgagaattgtttgaacatcacttaaactgaggaggtagaggttgcagtgagcggaaatcgtgccactgcactccaacctgggtgtgagagtctgtctcaaaaaatagtaataataataattttataattaataatgctaagaccatgcatttgtaccacaatttaaatttttatacaggcctttcagatcaatcatcttgaattctgaactctaaaagaatcctcctaatttttatttatttattttatttattgagacagaatcttgctctgtcacccaggctggagtacacaatctcagctcactgcaagctgagactatagtcgtacaccaccacgcctggctaatttttctatttttaatagagatcgggtttcaccatgctgagtatggtggcgtgcgcctataggcctagaactttgtaggcccgggcaagtggatcatttcgagccggcagttcgagaccatcctagggaacatgccccctatctctaaccaccttcccgacctcagtttgccatggtgcatcaccctggtcccc

SEQ ID NO: 217467 - DNA, 298 bp, Homo sapiens
tacctctgggatacacgctgtatgggtttttactttcattcaactcaaaatatgttctgatttccctcttgatttcttctttcaggccctgtatctgttatgattacttgttttgtccagtgttaaagtttccaactataagtttggattttcctacttctacttcttacagttttattagtttttgttttatgcattttgaaactttgttgttatatatgtatacagttagtgttgtgtctttgttgacttgaccacttctattggatatttccctttattccttgttctgaaatct

SEQ ID NO: 217468 - DNA, 445 bp, Homo sapiens
ggaacctctgccagcgcatatggatatgccctttggactgattctcaaagctcagtcttttactttttcaagtgtatgtcattaaaaaaaactttaaacatacagagaatatgaaaattttaaaggaatagtacaatgaacagccttagacacatcattcagattcaacacccatgtacctactacagagatgttaacatattttgtcatatttgaatatatctgtacgataagaagaataagaatattctcttacataatcacgtactgttaacacatctgagaaaataaacagtattacagtatttttctttattttctttttctttttttttttggagacggagtctagctctgttgccaggctggagtgcagtggcgcgatctcggctcacactgcaacctctgcctcccaggttcaggtgattctcctgcctcagcctcc

SEQ ID NO: 217469 - DNA, 298 bp, Homo sapiens
ggctggggaccctgcccacagcacctctgcaaagagtagctggataagctctttcaatagaccagtcccaggttttgaaatggacagagcattcaatctacagtgactaaaggctgcctggctgcccgggacccatttctaaagagaagtggtctctctgtgctgtgcccccaggctccctatgggaaatccatgctgcactgagtcaggcatctgctgccctgctaattccggctggctgccaaggcaggggccttcctttgacagagccataaatacagactttattttaaccctt

SEQ ID NO: 217470 - DNA, 602 bp, Homo sapiens
ggctggagtacagtggcgtgatctcagctgactgcaacctctgccactcgggttcaaatgattctcctgcctcagcctccccagtagttgggattacaggcatccgccaccacacctggcttattgttgtatttttagtagagacggggtttcaccatcttggccaggctggtcttgaactcctgacctcgtgatccacttgccttgggcccccaaagtgttgggattatgggggtgagccactgtgcctggccggaaatctttactttgttagtatctaaatattaccggagtatgtttggtctgacataagaatcccacctctgaagtcatcttctggtgactccattctagatttttaggggagtgggggaagcagggagaggggtgagagggtggcatcctccaccctgtagttagattccttcccctctgcttagcctctctcatcttcttttaattagtgccgtgcttaattacccgctgcacttgcttgtgtatgcatcattgcattccccccaccccccacccagaagcctgacacagctcttactctccaagtaatgatagtaattgctggtagggcagtcctgttcctcatc

SEQ ID NO: 217471 - DNA, 533 bp, Homo sapiens
gaatggaattgtcaaaaattgttaatgtgtttgacaaagtgtggctgtcagtatgatctttttgttacattttgacatgaacaattgtccttttattggggctgttaatgctattttagaatatcatgagcatctgaaggcaatagtttagcagtgtccataaagcatcaaataccattataatatctagtaaccctaacagcaatatttcagaatccctgcctgtttaaatgggctatctgtgaatgtacttgctcagggatgcatgacccacatcacctataaatttgattggaagctaacagtactggcgtagcctgatggatagcagattagagccctgattaaccatgtgattcaaagactgggaatatattgtctaagcaagattcatcagatgcaatcagaatttcaagtggtcagatgaaattcaaatgtgtgttgtggcttttcctcccctattgcttttcctcctaggttgcctttttttccttctttccccaaagctgaaaaatacttctttgatgaatctg

SEQ ID NO: 217472 - DNA, 531 bp, Homo sapiens
tcagagagtagcagttggattattccattataccaaggttggcaagcttttgctgtaaatggccagatagtaaatattttaggctttgtgggccatatggtttctggtgcaactattgtaacacaaaagaagccataggcaatatgtaaatgagtgagtgtggctgtattccagtgaaacttaatttacaaaaacaggcagcaggccagatttggcctgcaggccgtcatttcattccacaaactctctcagtcacatctgcgcacctgctagcatctttatttatcctcccctctagttactatagatggatcatgtttgctcctttctaagttcacctcttcagctcgttcactagattccgtccgttctaacctgaaggacttcactgctgcatttctttcctatcctttatcatcaatttttttatttttactagatcattttaataagcgtgcagtcatactgtaattcctcccacctttaaaaaacaaaaaataaattgaaacaaaacaaaacaactcctttatc

SEQ ID NO: 217473 - DNA, 363 bp, Homo sapiens
ggagtcccagcatctgagaagccagagggcgatgcatcctctctgctctatgggtgtttattgctgccataaaaattaacacaaaacaagtggctttaaacagcatctctttatcatgtcacagtcatgtgtgttacaatttcaacagtctcatggggctaaaatcaaggtaaggggaggtctgtgttccttctgactctgaggaaaaatctactgtcaagctcattcaggttcttgtctgaattcacttccttgcagataggactgagatccccacttccttgctggctcctgtccaggggccacccttagctcctagagccctctctcagttcctcacacatatcccatgcaacatatcca

SEQ ID NO: 217474 - DNA, 263 bp, Homo sapiens
aaacaaagaggtttactaacagcttcttcctaataatctgatccttctaagaataagctaagctcattcatcaacatcttaattgtttaattgctattaagctacttttaccagagtagatacattaataaatgataacctggtaatgaaatagattaaagtagccgtctagtcctttctcccttgggagattgtttcatcaaatacactatgttgcaaaacttcctccttaaaaataaaatgtgattttgcaatcacttctt

SEQ ID NO: 217475 - DNA, 172 bp, Homo sapiens
gaattacgcaaatccaaaatttgatattaggtgagaagtagactaactgcaagtataacgtagatgatgtgataaatttgaagcaaactctgagaactatgagaaaaataaattgccaaaaatttacatatgctatgtgcaactcaaccaacgtattattagcatgaatgtg

SEQ ID NO: 217476 - DNA, 374 bp, Homo sapiens
tacccagtggtaattccacactttctttcttacgtggcctgaatcccacactttctttcttacgtggcatgaatcccacactttctttcttacgtggcatgaatcccacacttactttcttatgtggcctgaatcccacactttcttatgtggcctgaatcccacactttcttatgtggcatgaatccctcactttatgtggcatgaatccctcactttctttcttatgtggcagattgtgtttggtaatgtcagatttgaagacttgtttattaaatcagagacagtatcttccaaggtgaagactggagagagatgagccgacagtcagtggcttctggagctttccaggtggagactccaataaatgaatt

SEQ ID NO: 217477 - DNA, 188 bp, Homo sapiens
gggctgaaggctgaggttgggggtcactatcattagataactcttagagtgagcaggtagcagcctaattcttctgccatgtcctcagcctgtgctgcccacccagagctgcttcacctcgcccctctgtgaactgtgttctggacccagagccacctgagttctctcctctgactataggtgtccct

SEQ ID NO: 217478 - DNA, 342 bp, Homo sapiens
cactgtgccaaattctgcactgccctggagctccgcaggtatcgcatcacaactgatggctttctggcctaacctgaaacctgctccagctggaactccatccccttcccatctgttgaccttcatactgccccttttaccacccaacagtcagcccaagattctgatggaatacttgttgcaaataagcctcatgccttggaggctttaacttgcatcttttcatttaatgccaagtagacaattgtgagtaaagggaggaattctctctcccctcccctctcccagcttcataccccagggagaaatggtggtgcttctaaagtggtgtggcaaaagaac

SEQ ID NO: 217479 - DNA, 581 bp, Homo sapiens
ctgcgataagcatacgagtgcaggtgtcttctggtagaacaatttattttcccagtcttgggattgttggattgaatggtagttctatttttagttccttgagaaatttccatactgtttgccatacaggttgaactaatttacatgaccaccaacaatatataagcattccctgttctgtgcatcctcactaacatctgtttttttgtttgtttgtttgtttgtttaactttttaataatagccattctgactggtgtgagatggcctatcttcttgtgggttttcttttcccatccttcactggtaccaagatctctttgtggttgtaatttgtatttctctgatgattagtgattttgagcattttttatgtttgctccctgtttgtgtaccttcttttgagaagtatctgtttatgtcctttgctcactttttaatgaggttatttgggtttttgttgttgatttgtttaagttccttatgtttctgcatattagtcctttgtaagatgcatggttcgcaaatgctttctcccattctgtaggttgtctttttactctgttgattgtttcttttgca

SEQ ID NO: 217480 - DNA, 506 bp, Homo sapiens
cacctgagctacacagaaagacccaatgggagaagggaagcctctccccacgcaagttaatcaactgccctttgggtgttgcggctgatacagaacctcagaggcacagtctggcctcatgcacaagtcatttttcctgagtcctggattccttgctaagtgggaataatcacaataatcttggtgtgtaaaatataaaggcttaggcaaggccaggcgtggtggctcacgcctgtaatcccagcactttgggaggccaaggtgggcagatcatctgaggccaggagttcaagaacggcctggccaacatggtgaaatcctgtctctactaaagaaaaaaaaaaatgcaaaaattagccaggtgtggtggcgcacacctatagtcccagctacttgggaggctgaggcagaagaattgcatgaacccgggaggtggaggtttcagtgagctgagaacaagccactggactccagcctgggcaacagagcgagactccatcaaaaaa

SEQ ID NO: 217481 - DNA, 384 bp, Homo sapiens
ccataggtaaatgtaccacggtggtccggtgaccagagatgcagcgctgagggttttcctgaaggtaaaggaataaagaatgggtggaggggcgtgcactggaaatcacttgtagagaaaagcccctgaaaatttgagaaaacaaacaagaaactacttaccagctatttgaattgctggaatcacaggccattgctgagctgcctgaactgggaacacaacagaaggaaaacaaaccactctgataatcattgagtcaagtacagcaggtgattgaggactgctgagaggtacaggccaaaattcttatgttgtattataataatgtcatcttataatactgtcagtattttataaaacattcttcacaaactcacacacatt

SEQ ID NO: 217482 - DNA, 353 bp, Homo sapiens
gagatagggtcttgctctgttgcctgggctggagtgcagtggcgtgaacacagctcactgcagctttggccgcctaggctctagaaattctcccaccttgccctcccgaatatctgggaccacaagtgcatgccaccatgcccagccaagtttttaatttttttttgtaaagaagaggtcttattgtgttgcccaggctggtcttgaactcctgggcttgagtgatcctcctgcttcggcttcccaaagtgctgggattataggcgtgagccaccactccagtccctgactctgtttttgatgtttaactgctgatgactcctctttttttttccccttctgtcgtcttctgg

SEQ ID NO: 217483 - DNA, 516 bp, Homo sapiens
aatagtaatggcactgtgtccgagagtccaaagaagatgcgtagacagcgaacaagacttgggtttattgggggaacttatatatagggatggtccagtggtagtaggctggacagaagaaccactactgtttgtaaaaagcatgcagtttatatagcattttcatttagcacactccacctagcaacctccatttaacccaaagcaaaggaccttgatcccctatattgcctgtgttgtaagggatgggctgggggttcagacgtccttcatagataaggagtgaaactcagggttagtcgctcctgtttccttagtttgggattctgagcacacattcgttttagatcacagggtcgttctcaggatatggttgttactgctgtcaggtgcatcctctctatagcggggtactggctacagtttttgttcactagtgataattgttagagctatgcccttaatatatgtcttgtgtgtattatacttcaataaaaagttaaattttaaaaaacc

SEQ ID NO: 217484 - DNA, 695 bp, Homo sapiens
cgtggtggctcacacctgtaatcccaacactttgggaggctgaggcgggcagatcacgaggtaaggagatcaagaccatcccggctaacacagtgaaaccccgtctctattaaaaatacaaaaaatttgctgggtgtggtgatgggcacctgtagtcccagctactctggaggctgaggcaggagaatggcatgaacccaggaggcggagcttgcagtgagccgagatcgcgccactgcactccaacctggacaacagagcaagactctgtctcaaaaaaaaaaaaaatttggatccagggatattgtttttttttttaattctctaagacttcttttagggcttagaggaattcagggccaggccattttaaattaaggtactaataaatttctctacagaaagaattctaaaactcttctctccttaattccacctacatcaatttcatggttacccaaagcccccaaaccctgcagataaacaactcacccctttcctttacagaaaataggtcaactggcataagctccctccgctgctctctggtcccctctacatctaaacctggcttcagccctggtctgaggaggaagcatgctacccactcctgctctggatctcaaccaaccctgagaccctgttaccacagacacttttctcatccccacctcaccaccaccttcacactggct

SEQ ID NO: 217485 - DNA, 473 bp, Homo sapiens
tgctcattctttaccaaggcctggtcccaaacctgttcaaaagaagaatcattaactacagaagagaggatagatttatttcaaaatcttacacatctgtgtagtgttttttttttgtcctattgttgcttgccagatgctctgtagagcatccttatttgccatggacagtttgacaatctatgggtctgctggatcataagccccaagtggtggattagcttaacctgcagtctgaactcactttcttttgttcttctcacttgaaatctacaggtaattctgtaaatgagtcaaagtcacacactgaaatgtggtatgtgttgcttccaaaatctaaaagacttttactattgtggataaatagtaaagtatattttctcatttaagaatataattgacttatctaaatgcaaaaccgatgtattgtggggtttataatatttgtagaaataaaatgtgtggcagcaata

SEQ ID NO: 217486 - DNA, 473 bp, Homo sapiens
aagaatgcccaggatgcaggagctgactcagccaagggcatgaaaaagctggagaggttggaaagctagcatttcatctgcataacaacctttgagctaagagttaatattccatatagagaaggaggccaggcagggtggctcacatctgtaatcccagcactttgggaggccaaggcgggtgtatcacttgcggccgggagtttaagaccatcctggccaacgtggtgaaatcccatctctacaaaaaataaaaaataaaataaataaaaaccatggagagaaggaacaaggctgaaaaaggtatcatgatttgcccaaggtcttgcctctaagaaatgacaaaatggagagtagaatccagttctctagacttcctctggaaccctttatgagtgaggaccagagtacctcccacatggcccctgcagcctgcctcacccatctcctgtcagtgccatggtctcacaggg

SEQ ID NO: 217487 - DNA, 544 bp, Homo sapiens
ttttgtaccaccctctgctccttttttccttcatcttttcctattcatctcctccgtccccaactcacaatataatagcagggtcggaaaaccaacccacttttgaaacatcaagtcttaatgtccaatcagtcctcaggcagcaactacttctgaacccaggaaactcaatagctacgaattgtacccaaagctgcaaaaaacaataagcaaattctattatgttgtttctttacttcttggattacttttctgagctaataaaagcacataaggatatttcacaagtgtgtttatgtttctatttaacaaaccttgaatttcatagcaggtatcaagcctcagccaaacccatgcagactgacagatcaacaaagacaacaggccctgaacaagtagctctcctgagaacagatgtgtaaacagaaacacaatgtatgaattagcccagtgctctttcccaggtagactgagagaatctggacactacctgtggctgagccctggagccaccagaatttaatcagatacgtgattaagaaaa

SEQ ID NO: 217488 - DNA, 231 bp, Homo sapiens
tcgctgtcagaaattctagggagtaactgcttgtcaaatttcaaaataagtcatacaatttatagaaaggaaatgaaaccaaatgcaggttttctaaaggtactcacacacttaagaacaaccactaagaaggcaaaacagtgaaaaaataaatgtaaaaacaaaagtcgtcttctactttaattgaatattgagctttcaatttagaagaaaatcatgaagcaaccacag

SEQ ID NO: 217489 - DNA, 490 bp, Homo sapiens
aagaggaacgtatttgagttacatagttctcttccagagaaagatatcagtatgtaatatctaaaacaaaaaaataggacaaaaattttatttagaaagatggatgttgatgttagagaaaacaggtaaaaaaactgagtggctatttctaggaagagggaattaaagttggagatgggtgggacataagactgttggtttaagtcttcagtgtaaactacaacttttcaaactacatgtatgcatgactttcataaaatgtgaaaactgaaaaaaggacaataagttaggttagaaatctcagaataaaatgtagtatatacatcttctgaagtctctacaatgtagggaaaaaaaaaacaaaacaaggatgaaactataaaatgatgtttcttttgcagttgtaggagtgataggagacttcagcacatttgggacataacaaaatatagccaagaactcagcaaattaaggacaagcttgctgttaa

SEQ ID NO: 217490 - DNA, 552 bp, Homo sapiens
tagaatataccatatgggctggtgtggtggcagatgataccatctaggtttgtacaatgacaaaatcgcccaatgacacatttctgagaatatatccctgttgttttgactgtatatgtgtggcttttatttttaccccccttatttgcaattagttttgcttccagtattttggggtaccagaatcaatacattgcaacctaccaccaacaaatgttcctttaaatatctacaatagactccacctctgtattaaaaatgaggctgtgggacaggcacagtggctcacgcttgtaatcctagcactttttgaggccgaggtgggtggacagcctgagctcaggagttcaagaccagcatgggcaatatggtgaaacctccttctactaaaaatacaaaaaatgagccgggtgtggtggcatgcgcctattatcccagctactcaggaggctgaggcaggagaattgcttgaacccgggaggcagaggttgcagtgagccgagactgagacactgcactccagcctgggtgacaaagtgagaccgtcttcaa

SEQ ID NO: 217491 - DNA, 528 bp, Homo sapiens
attgataggatttttatttctgccttaagaattctttccatcaccttttcattttaagacacttatcatttctatcccttcctttgtcccctgtgctgtccttccttctgaagttctcacccggaaaggcattacatctttgatgctgcagttcacttctgtgtgcacccctgagttcttccagtacatcctccagttcctctgctttccatttcacaacctggttacagttagtcacactgtaacttcctgttactgagtatttcaggggccaaagctctctatgccctatgctgtccacttagtcatctctctccacatttgtattattcacagcaagatgcatgcacacaaatcctttaagtccgtcaggcttttctttccatttcccattcaaatatgaatcacctagcaacatttattgaagaccaattgcacatgaagctgtgttcccattattgtgagcctcacaaaggaagtaaaagccatggtccttgccattaagaagtttatcctctactaaaagct

SEQ ID NO: 217492 - DNA, 429 bp, Homo sapiens
ggggtgaatgctgtacactttttatatattctacactgaggaagatcttcacacttgttgatttgttctcactctcccaacccttgccagggaatcttaagctggcatcattcagtaatggctttaattggaaataattaagtagaaagagagtaggagcctagaaccttagttggttttccttctgtgtttattgcagcattcccagttagctgagatgctgctctctcctttcctggcctacttgttatgttaggagacctactaaacaaataatctactttaattagcaggcagtgatcaaatacagtctagatgatcatggctgtggtcagctctattgatagacattggcatggttccccaagctctttgatttgcatcttccctcttacctcatagcaccttgccattctaggctttgaagtc

SEQ ID NO: 217493 - DNA, 358 bp, Homo sapiens
atctatacatttgccctttagtggtgaaatggagttgtttgaggtgtcagcttggtttggagtgtcactaaaagccttttaagcctgcttcatcacagtagccctgggaatcaacgagaaatgtctctgagttaagagctaaaattacaaacatccagtctgacctgatcatgaggtatcttacaatggttccaactcggtgacattcgacattcgtactgtagcactgcctctgtttgtttgttagtggtcatttaacattcaaaggaagaagatgctaatggccaaggttcagagataatgtttctagagtttgctctgtgttatatgttttgttttgtttgagacggagtttcgc

SEQ ID NO: 217494 - DNA, 350 bp, Homo sapiens
gagctgagattgtgccattgcactccaacctaggcgtcagagcaagactccgtctcaaaaaaaaaaaaataaataaaataaagaaagaaagaaagaaaagaaaagatgtatcggtattagaacatggaataaaaattctgtgacattaagggttcatggtaatttgtatcagaatgtacatgaaagaaaatatcaagaaggaaggtataccagttcaggatgtgttatctactaaatagtgtgccagaatcctaataggcatttctatttacatttggctcctctgaaccttattacttccttcaacttgtcttttatgaacaacatcttttattagtagacaaaaaaaa

SEQ ID NO: 217495 - DNA, 419 bp, Homo sapiens
ctgctcattccaaatcagtaacagtaacatagtagattgcattgtatagtcatcagtcatacaatcattcaaaaacatgcatttatcaaaacgtaaagcaaacaaacaaacacacgcacacataagaaagatgctgagaaagaaaatgaagcatttccaacctacaggcaacctgccatctcatcaaaaagcataagcacgagtatgcgtccatctcagctccctcatgatccccacagtgagagctctttctgaactgaagcaattccagtgttcaaagatatgtatttttgtacaacacggtcctaaatacaaaccaacacctttatgcatgcacaaaagcaagggcaccactcactccaggagacttgaaaggtttattaaagtttactttgactcttgctggttttcttattaca

SEQ ID NO: 217496 - DNA, 353 bp, Homo sapiens
gagactgagtttcacttttgttgcccaggctggagagcaatggtgtgatcttggctcaccgcaacctccacctcccaggttcaagcaattctcctgcctcagcctcctgaatagctgggattacaggcatgcaccaccatgtccagctaatttttgtatttttagtacagatgcagtttctccatgttgaggctggtctcgaactcctgacctcaggtgatacacccacctcggcctcccaaagtgctgggattacaggcgtgagccactgcgcccggcctgtctgtgttttaaatatagaatacaaaaatctagtttaactctagtctatggtaaactgaaaaatgaagaat

SEQ ID NO: 217497 - DNA, 505 bp, Homo sapiens
aagcatatagtgattatggggtatgatactcaaagcttagtttttcagatgttggttttatctttcttgcctcagaataatcttggatgaagctgctttacatctatctgacaaatgcaatactgtcactataaatctgagtagaggtaagagttaaaaaacaaatggagtagataaattctgctttatttttgtgcgtaaataattttaaagcattttaactctgggataatgctagtgaactaagaatcttattaaagatccttaaagattaaagggtctttaagtatatagtgatcatgtggtatatattcacagcttcatttttcagatactggtttttcagtttgaaattgtaatgttcttataatgctagttaagtacatcaaattactatatatactacaaatttttatttaagataatttttgtttctaacaaaaaataaagtgaattttaggacttctatgggatgaaactattttcattgcattataattatttg

SEQ ID NO: 217498 - DNA, 443 bp, Homo sapiens
tcaatactaaggcacatagatcattcttagttttattgtcaagttttagccactttatcagggtatcgaggtagcctcaacatcaaagggatacagttgtcaacttgtttaagcagacaccaaattagtggaagtaaatgctaaagaaattcagagggtttggggatagagatcattatgacttgggtaccagtcagaggtttctttctttctttccttttaaaatagttaattgtataaatatttattttttagagacatggtctcactgtatctcaggctggtcttgaactcctagcctcaagtaatcctcatgccctggcctcttgaattgctgggattacaggcatgaaccatcacacctggccctagtcagaaagatttaattgggacctaaattaaatcttgaaagggttagacgtaaataagggcaagcgtgctag

SEQ ID NO: 217499 - DNA, 411 bp, Homo sapiens
acttttgacattctagattttaatagtgttgtttattgtaattacaaatatatttagacgtatcttgaccatcttttgtattgtctactatgtctttgctttcccctcctacgttttgcagggttgatttttctttataaccttttcttcttcactgctaatttggaagttgtatatatcaactttattggctttctgctattactctattttcatagttatcttgcaattttgaatacatacttaggagacagaaaccacattgcacaggtaaccaaacatgaaaaacttaaccaccttttactagttagcaattcttgtatttactactaaacggggtagaagtggactctaggggatacagaatatcaacttcaggatgcagatccttacccccaggggtaagggaga

SEQ ID NO: 217500 - DNA, 744 bp, Homo sapiens
gtgatatttaagtattttgtattttagattatatctactgagtaatttggtgacaaatttgcactgcttttacctattggctttcagtaacaatgctgcaataattacaggtatgcaaatgacctatatgatcatatatgtgtaagtttatatatgtgccgcattctgttctactagtgtacgtttttacctttgtactcataccaaattgttacaattctgtagctctgtaatgtgtttcaaaatcagaaactgtaatgccttcaaaattgtttattttattgcagatttttgggtactttattatctcttaagactttatatactttgggggttgctgtttctatttcttcaaaaatgcatgagaaatttgaacaacattgcattaaatctgtaaattacattgagcaggatggacatcttcacaagattaattattttaacatttcaacaagcatgctcaagagtgtattgttttaatttctatgtatttgtgaatttttcagttttttcttcttactgttctatactcatttcattttggtcatagaaagtaatccataaaaatttagttttaaataatttgttaagacttcttttttggtttaccaggttttctatcaaggagaatttcgtatgaggtattgagaaggctgtttatcattatgttgttgagtgttctttatgcctctgttattaataattgttttatactcccttcaagtccggtttctttaccaatat

SEQ ID NO: 217501 - DNA, 511 bp, Homo sapiens
ccccagtggtccgtggcaagtccacgaagctgaaaagctggtttctctcccagcgggtcccaggcagcttcaggccctcttgtttgtcacacctcttgtgttctagaacaacttggggtgagggatgcactcttgacaaggtggagacataggatatgggccacagggtcacgtagcagagattcagatgcggacctcaagagacatagaagcaggtgccaggccgggcatggtggctcacgcctataatcccagctctttaggaggccaaggtgggtggatcacctgaggtcaggggttcgagaccagcctggtttggcaacatggtcggcaacatggtgaaaccctgtctctactaaaaatacaaaaaattagctgggtgtggtggcaggcgcctgtaatcccagctactcgggaggctgagacaggagaatctgggaggcgaaggctgcagtgagccgagatcttgccactgcactccagcctgggccacagagtgagactctgtctc

SEQ ID NO: 217502 - DNA, 454 bp, Homo sapiens
tgataagtgtccttatgagagagaagagagacagaaaagaagaagagaaagccctgggaagacggagactgagactggagcaatgcagccataaaacaagaaatgcctggagccaccagaagcccaagaggcaaggaggggatcctcgcttagagttcccagagggagcaccgcccagctgaccttgattttgaacatctgtcatccagaaatattagagaataagttcctgtggttttaagtcacaagcttgtgttccttttgttatagagttcctgggaaagtaacattcaatgcctttttttcactgcaacctctgcctcccgagttcaagcgattctcctgcctcagctacttggaattggaaatcgcctgaacccaggaggcggaggttgcagggagggagactgcacccctgcacttcagcctgggtgacagaggaaaactctgtctt

SEQ ID NO: 217503 - DNA, 375 bp, Homo sapiens
tgataagtgtccttatgagagagaagagagacagaaaagaagaagagaaagccctgggaagacggagactgagactggagcaatgcagccataaaacaagaaatgcctggagccaccagaagcccaagaggcaaggaggggatcctcgcttagagttcccagagggagcaccgcccagctgaccttgattttgaacatctgtcatccagaaatattagagaataagttcctgtggttttaagtcacaagcttgtgttccttttgttatagagttcctgggaaagtaacattcaatgcctttttttcactgcaacctctgcctcccgagttcaagcgattctcctgcctcagcctcctgagtagctgggattgcag

SEQ ID NO: 217504 - DNA, 403 bp, Homo sapiens
gactccagaccgagaggccaagtgtactggatgcacggagcctggatttctgaacaactgcatggcaagcacttcctgaaggtgcacctaacaaggaatactgtggtaggttgtggactgaaggagaaagaaattttaactgtgttaagtcattgaaataggagttttttgcctaaccttacgcatccagtgatttatttaatgggttagactaagcagtcgcttcttggctcctgttgtcagggcttcttactctctaaaggaatgtatttcttcaaaatgttaagcagtctgtggttcttacattgcaagaaaaagcaaaaatgacaatgcccagcatgctccgcaaatgattttatatattaggttccaggcttaaagggtctgagttgatgtttgggtt

SEQ ID NO: 217505 - DNA, 586 bp, Homo sapiens
gggctgtttcccccatgctgtttctgtgacagtgagtgggttctcacgagatctgatggttttatacggggcttccctttgccaggcacttctccttccttccaccttgtgaagaagctgccattcttaccctttgccttgtgccatgattgtaagtttcctgaggtctcccaaacatagtgaactatgagtcaattaaacctctttcctttataagttacccagtctcaggtagatctttatagcagcgtgagaatgactaataatccttccttcctttacctggagcttaagactccacagatcaatgtggcgacatcatttcttgcctcttacaacagggtgaggtacagacctcagctcctccaggggcatcttctgcctttcagaagctgatgcttccttggttggtggacaaccttaccctaccttaccttatcctctttcagcagtaaccagtcagttccaacaggaagtgagggaaacagaaacctctcctattgagaagatccattccaggaatgcctgctgtggctgtcaggcaactctagaaggaggtcattggaagtttgctgtctgcccatgg

SEQ ID NO: 217506 - DNA, 456 bp, Homo sapiens
taggaccttcctccgggcagcgactgctgctaccctgccgagaagtttgctgcccgtggcattgctacttccatgaaggaaatctatcttctcttttcatgtctttgttctgaaatttcgctgtggtatttctgagtataagttggtttggctgtgttgcctggcgctggccgtgtcttctcacctgagatagctaagtttcagttcccagcccttcccggccatctgtcctcccgtggcacctctgcaccctgacataattcttgttctggatctcctaaaagggagtagcttgcacccattcagtgtcttctccatctctcaaactgcgcttcccagtattggtctctgtgttctcagtttacgatcttccagtttactagttctgtctccatccaattagtttgtttaatctgttgagtttttaaataaaaccgcattggtctctatttctaa

SEQ ID NO: 217507 - DNA, 151 bp, Homo sapiens
gcctccaagtcggtctttgctgttttcctgagggaaaacccagatccaggttcccctttgtctttctttggtcctgggtgcgaggcttgtggacttggatgacaggggacttggttggttggtcttgccctcaagctctccctcgacgcag

SEQ ID NO: 217508 - DNA, 356 bp, Homo sapiens
aggaatgtgttttatttttgcacgtgctcagcatcaatttgctctaccttatctgaacttcatcttgaagcaactgcatgttagtctgatttgaacacaggcgtttccactcatgatgcagctggttttcatgctaggctacatggttcttactgagaactaattatttcgtatagcttttatactgttcagagtcttgagaatctcactgaatgatgattggcatatattactacctcacagattatattaaacaggcatatctcacattctaattgtattgccactctttagcccttgcactgggtcctgcacattcaggaatggtctcctctcctattctgtcatcttggtta

SEQ ID NO: 217509 - DNA, 655 bp, Homo sapiens
tataatttcccatttaatatttttggaccatagttgactgttggtaactgaaactacagaaagtaaaaccacagataaaggggggaccaactgtatctaatttcatgcagcagtggtggtggaagaagctactctgataggaatgtttgtgttccctccaaaatttatgtcgaagctgaatccccagtgcagcagtattaagagataaggcctttaggaggtgattaggtcatgagggttctgtattcatgaacagcttagtgccatttaaaggggcttgagagaccaactttgcctcttctcccttctgccatatgaggacacagtgctcgtcccctccagagcaggggtccccaacttctggtccgtggcccattaggaaccgggccacatagaaggatgtgagcagctagcaagacttcatttgtatttacagctgctccccatcacttgcattgctacctgagctctgcctcctgttggatcaagagttgcattagattctcataggagcatgaatcctattgtgaactgtgcatgtgagggatctaggtttcgtgtccttgtgagaatctaatgcctgatgatctgtcactgtctcccattatccccacatggcaccatctagatgcagcagaacaagctcagagctccc

SEQ ID NO: 217510 - DNA, 449 bp, Homo sapiens
ataatcaacagagtaaacagcctgcagaatgggaaaaatatttgcaaactatgcatccaacagagggctaatatctagaacctagaaggaactcaaacaacccaaaaatataacaaataacctcattacaaaatgggcaaatgacatgaacagacatttctcaagaaatggacatatcaacagccaacaaacttattaaacaatgtccaacatcagaggaatgataattaaaaccaccctaagttagcatctcacccagtcagaatgggtgttacaaaaatgaaaaaataatgtgggcaaggatgaagaaaaaaagggaacacttacattctgatggtgggaatgtaaactagcacaaactctatggagaacagtatgaagatatttcaatcaactgaaaacagaaataccattttatgcaccaaccccactacaggatatatacagaa

SEQ ID NO: 217511 - DNA, 507 bp, Homo sapiens
caaaccaccacaatcatgactgtgaagtgcaacgctaaagtcatctgtcagtatgcagtcatggagtgctgaatctgctttcagaaaatctttctgttattagagttctagtatcttaatgaagcagcctacatcaggatgtggatcctcaggtaaaataagaataattatattcaagcttgaaaaaaacaattgggaaatgtattggtttgtgtttttgacctgcaggcagaaacactgaaatcatttctacttccactttaagacttctactatttgctatttggaactttatattaattcatgtttaaacatacttttttttttttgcaaataggaaactatatattataggccacatttctcccggtgccaacaatatttagctcagttacagatgatacaggatatgcaattataggcacatctcatgttattgtgcttttctttgttgcactttgcagatattgcacgtttttacatattgaaggtttgtatcaaccccgc

SEQ ID NO: 217512 - DNA, 331 bp, Homo sapiens
gtcacccagtgcctatcacagtgcacactggtgggcttagaacacacttggggagttacaatacatcaaggcaccagaaagttcctgttaagcccctgttacagatttaacacatgacaattcacagttaccttgattccagtgtgttgatgcagtttcttcactttgcaggttgagttctgtactttaaaaatcaggggattcagccaggtgtggtgactcatgcctgtaatcccagtgctttgggaggcaaaggtgggaggatcacttgagccaatgagttcaagaccagcctgggcaacatagtgaaaccctgtctctacaaaaatta

SEQ ID NO: 217513 - DNA, 709 bp, Homo sapiens
atccatcctaacatataattggtctcttcttgtgataacgacgttaaatactaaagatgcagctgttccaaaaaacattgactgttgtttgggctaccagcgatactgtaaaatattccacatggctttccccaaacttttggtgacaaaaggtgggcatttataatttgttatatcctttcaacaaaggaaaagcagctttccaaaagctctggacactgctgctttaagtatcaggttgctgcaaaagtaattgtggtttttgcccttccattcaaatgacaaaaactgcgattacttttgcaccaacctatatagtttatcatttaaggaacagcaatgtataaaactgagagatctggggccatgttaaaaacttagtaagtctctttatttattcattcgatcaatgtataaatagaaccagtctatatttgctcatctagttaaaaggtcaaaagccataggcagccttgaaaaatgatgcaagagggctgggcgcggtggctcatgcctataatcccagcactttgggagaccgagacaggcggatcacgaggtcaggagatcgagaccatcctggctaacaaggtgaaaccccatctctactaaaaatacaaaaaattagctgggcatggtggtaggcacctgtagtcccagctactcaggaggttgaggcaggagaatcacttgaacctgggaggcggag

SEQ ID NO: 217514 - DNA, 147 bp, Homo sapiens
gcgtccctgttgcagttctgccctgataccttatcaaggaaaacaagtacttcttgaggacatggcccaagacacattgactgcggccagtgagaagaaagtccgggactcagctggacccactgacaatggctgtcaggtaattgg

SEQ ID NO: 217515 - DNA, 175 bp, Homo sapiens
taaaattagtcatctgtttgccaatttgacataaaattctagttatttagatctttatattccagagcctaaatgaacaaaaatacataaattgtctcagaatttccttttagccaaaagattcagggagatgggcctctagagtttttcacagttttttttttttttgtaaaaa

SEQ ID NO: 217516 - DNA, 475 bp, Homo sapiens
ttcccttttctctacatggacatttagattgtgccatatttttgtgattacagaaagtgctgtatccttgtacatccttgtctgtatatatacagtctcaggagtactttttaggtaatactaaaaataaaactgctgtgtaaaagagttttaccttttgatacatactgccaaattgccctcccaggatgattgtatcagcttacatgcccaccaataatgtatgagagtgtccttttttttctgtgccctcttaacattggatatcatctttctaaaagtttttcaatacagtagatgaaaaatgtaccttgttaattcctaatcagtaatgattagccattggatttttttccctttgtgaattgcttctttatatatttatgttgtatgcctcttgtcggtcatgtgttgcagtattttttccaggaatgctttgtcttttaactttgcttttcatgtgttttgggcttca

SEQ ID NO: 217517 - DNA, 637 bp, Homo sapiens
gtagttagtggtatgtcctcagcagaagccacaggactgtgatttgaagagaaggatatggggttgaactgcttcttactgccacggcagctctctggccccggaactggggcagttccttcattgtcccacctctgtcatcgcaggaatcccaagctgtcacacttctcagtattgtttcctttgcaatttgatgtggacttggcacatttccaaggtggaaacgacccctcattcattatttttgggacctcggtggccccgtgataagggaaatgatggatgcctggacttgtcttctggcattgcgcaccagatatcagggccctccacaggaccagcctatgagacaggaagaggctgaggtcttaaagacatactttcttgggagtttgatgtttcctcttgcttccacagctgtcagaaagggcttgttctgagggtgacctgcaggttgcaaggctgtggaaacatagcagtgacagcgttgaatggcttgtccccatcagtaagctttggtgtcacaccagccggatgactttctggtggagggccagcttcctgcacttccgtgacagcagcctgacagccccatggaggcatggctgtagacattaagacatttctgtagacattt

SEQ ID NO: 217518 - DNA, 361 bp, Homo sapiens
cactgcccattccatattccctttgccctcagcaagcactcagatggttgtggttctttacctagagggataactcaaacctttcttcctgaaaatctgaacctagcagttctgcctgaattggtagttttccattgactttcatcacagggctcagtgatactagtaagagatgccccaagtgttctcctgcattccagatgtactcctccttgtgtctgttgtgtcatagcaacccatgttccccttagtaatcaggataatccccccagcccacacagccacgtccttctttgcctgttggttcagaggcataaggagcccaaagtggttgggtggcagtttcagcttccaggtcagt

SEQ ID NO: 217519 - DNA, 460 bp, Homo sapiens
aatctggatttttaaagaaagcatcttgaacaacagtggcaaaaagttgacattttggcagtttgcttaaattttataaattgtagaatacttaatatgttcagatggatatataacatgtatatgtaaagaatagtaataaaacgaatactcatatacgcaatatccagcataagaagtagaacacagataccaccattatctttgaagcccctcattttccttcccttagacatgaatacttaccattgtgaattttgcggatcattcccttgcttcattttgcaattttatgacggatatatagcccaagtaacatttttttttttcttgagacggagtcttgctctgttgctcaggctagagtgcaatcacttgaacccgggaggtggaggttgcggtgagccgagattgcgccactgcactccagcctgagtgacagagcgagaccctgtctcca

SEQ ID NO: 217520 - DNA, 397 bp, Homo sapiens
ttagtataaagcatgtaactcctgacttggaaatccactgcaattttctgaacttctttgagtagcagcgaattacaaactactaaaaacatcttcacttaatacatggagaagtttttgtcttctgttatttaaactaaagatttgttagaatccatactgacacctgtgaacttaaatttaaaggtgtagaatttaagactataacaaactaataggtctacaggttgctttaacataaaacaactaatcaaacaactatgttacatgctcggtagtggtaagacactgaaaaagcatctggagacagaactgaaactatattgcctttaaaaattatggttcttagcctgggtgtggtggctcatgcctctaattccagcactttggaaggctg

SEQ ID NO: 217521 - DNA, 722 bp, Homo sapiens
tctggtcatttccttcccataaagccagggctcacccaatctacgccattccaagtgtggatgcaggtttaacctttaattcctgaaagcacagctaaaatgaacatagcatgtaactaactttactaaaacctgggggtcactaagaggataatagactatgggtgaaaaagtattttaactaattctcttgtttccttctcaagtctttggccatgccccttttggggccccttgcagccttgtctctccttagccccctaaggtatccccctctcacagtggacagtttacctcccccaaatgggaggtacctcagccttgcccctatgccttcagtccagccccaactgctccttcctgtgctcagccaaagaaaaatgtgttcacaaaaatctttacagagatccaatgttttccgcaaatgagacaagttttatattatgtgcatataacttaatctatcaacgtgaaacatcttcattcagattatagtgctattcctaagaactctgggtgtcctacctgtctcgacacctaaaccaatcgcttccagagcttccagaacacagggagagcctgctgggacaacttcggctgccaccccacatgcagaacctcttaagacttactaaagagcaattattttcgttgccaacaatcttaagatccagactctaccctggccacagaaaaacactcctcacagatttccaggagtt

SEQ ID NO: 217522 - DNA, 348 bp, Homo sapiens
gaattgtctagaaaagaagtgacaacttctgggtcgttgcaatgaaaaaaggtggtaacttccaggtcattgccatggcatttgcaaaccatcatggccctggtgggagggtcttatgccaatgagcaatgatggcagccagggatcaccctcctcgccgtcccctgattcctgtctccacttcatcccatccagcccagatcctgttttggtcagtgggtcagtgaccagaaaacaagtcctgccaccttcctacctcatcccctctcttcagagatgagatccttccccttaatcttaagggggtgcagaagggcagggtctgtcttctgggattgcttcctgctg

SEQ ID NO: 217523 - DNA, 499 bp, Homo sapiens
taatatttttatttacatagagacagggtctcactatgttgcccaggctggtctcgaactcctgagctcaagtgatcctcctgccttggcctcccaaagtgctaggattacaggcatgagccactggcctcatgttgctttttaaatcttaaatcttattgtacagtggtcttaaaatttgtgaccagtgacagaaactgaatgttttacttcttgtttctccccctgcatttagcatggtgcttttcatctagtaggtacccaataatttgtgtactaacttggctgtacattgctaagtcttttcagttttttatgttcgtttttaaaatcaggcttgtcttctgtaatctgttctggcttaactatgtctgataattagatactctttcttaatgtcattgtcaagtgtgagtatatcttttcctggtcagtgagaactgaggttgaaacgagcagtttgatttctggacttaaatttgtactaaagtgtattggg

SEQ ID NO: 217524 - DNA, 499 bp, Homo sapiens
agaagaccggaacttagcctttctggctctcaagctgtccctggtgtgggaacgggatgcaaagtacaaatggaaaggatagatcatgaaggaaaaaatggacacgcttttactgagaaggaagagatcctggatgagatgcacgtgagatggtcactgccaggaccaagatgctgctaatgtatactggaatagccccatggtttacctgtgattggcatccatcctgactggtctgtgcctatgctctcacttgttatacattttaaatatcatctctgtcaacttccagtgaaaacgttagggagtcaagatatgtcctcaaccagtgagagcaatccctgctttgaaagcacttttgcaccaatgaaatataaatatataaacaaataaattccaaaaatgtaaagccattatttcaaatgattttaaatggccaaactgaatgttttggcagcttggtgactttatggaaaaaaataaattgctgatgaattgg

SEQ ID NO: 217525 - DNA, 488 bp, Homo sapiens
cccagaaagacctacccatgcttctttgaatttggttttcctttaaactccctcacaatccctgtcttaaagttcctagaagagaaaacttttctcagagaccgtctccttaggaaaaatcaacagggatattgtttaaaacctcaaactgaagataaaaggctggcagtgaccattgaaataattgaggtctatgtatcatgcattgaggaagaaccaagcacattgaccagctaataggacttcactgaatgtccactttattttgaaagccagtttgggattgtgggggaggggatgcaaaataaatagaaaatatagtctcttcccataagtagcttatggtttagaagttcagttctctaatacaaaggataaccaaggacccatgcaatgcaaacagagactaaacagcaaaaattagaaatgacaactaaagttgtagccaggaaaaaaaaaataatctgattctatgagcataccttttt

SEQ ID NO: 217526 - DNA, 385 bp, Homo sapiens
tctgttttatgtctgccattagttgttaggtggggactgtccctgtcctggcatgcaggactctgctaccggaaattattatagcatacagagtaagagttccagtcccagacttagactgtctaggttcaaatgccagtttcactccttactagttgtgtgaatttgaaaattatttcatctctcagtgcctcatttttctcaagtagggatgatagtaatatctgccttttagaattgttgtgagctttcaatgaattaatttaaagagaaaatgtttcaaatagtgcctggctgggcacggcggctcacagctataatcccagcactttgggaggccgaggtggctggatcacctgagatccggagttggagaccagccttg

SEQ ID NO: 217527 - DNA, 410 bp, Homo sapiens
tttaatagcgttgccacagcaaccactgtcaccagaaaagggaagatagtgttgccccttctgctccaagcagtgagttagaaccttggaaaagataaactatccagatttccccatattcctcagcccactgggctctttaaagagagatcacaggctgtcaacagcagcaacagacaggaacaaggatcacctcatcatacctagactacctatacctgtatttgcatgacatagcttgggtgctgtgtaaataaaaacacattataaacacattttggtacttactgccagaatacttagtttggatgaatacacacaggaactcagaatcctgtcctacagtccaaggcagagaaacctaaaaagggactgaatcctaaaaatcctaaattctagcctttaaaaat

SEQ ID NO: 217528 - DNA, 522 bp, Homo sapiens
tctcttgaactgctgcaggagccccaggacctccaggtgcagggcctggagacacacacaaggagagatgcctgaggggctgggggccaggcagtgggacaggagccatggagagggaaaccgaggcagaagctcatgcctcagccacttggggctgtgtgccagagccaggcatttcctctcagtgtcctgtcagtgcccttgccacagcgggggcacgtgcccccagcctcaccattccaggcctggaatcagttcaggtgttcccagagccatcctctgatgagtggacttcagcttggacgaatgactctaaaacgatggggtgcgaggagggcacagcagcgactcatttctcagggcctcactgcagtcttcatccacgtgaatgtcattcccaccatccgcacctttctctcctgctgttttcccctccttgtgccacactgttttctgtgttatgaccgtgtgttcagaaccatcactgcagcggccacagccactccgccagtgcgtctgtgc

SEQ ID NO: 217529 - DNA, 499 bp, Homo sapiens
ttcttgctttaagtagaagccacagaaaccatatactggtagaaacagacatgagaattatgaagaacttttggaggctaagtgtggtctggcttgagggtgagaaactgatagggtggcatttttaagtagggccccatccctttttggggaaccccctatcagataatcacaaagaagagccaacaaatacctcctcctgattctggcacagagagggaaagaataacctttgtgaaataatcccagaatattctctgtaaataagtttactcttcaagggaaagactttgccagaagcttagttcatctgtgaaagcacatttacttgacgctagctacctccagcctttctggattacctacagggaggaaaaaaaaaaggtaaaaaacaattgtgaaggtcacagtccagaagaaactaaagcaactagaagaagagggaacatgatgtttaacttacccttaggctttcttatgtagtgagaagaaagcatca

SEQ ID NO: 217530 - DNA, 473 bp, Homo sapiens
caacatggcaaaaccctgtctctacaaaaattagccaggtgtggtggcacatgcctgtaatcccagctactcgggaggttgaggcaggagaattgcttgaacccgggagacagaggttgcagtgagccgagattgcaccactgcactccggcctgggtgacagagcaagacttcgactcaaaaaataaaataagcgtatctggatttttcttttgaattcttgactgataagtttgagaatgtatgtttttggaattttacagttgactcaagtgtgaaagtatacacaagtaatttttcttttctagctatgtgaatgtaaaatacttgcagataatgtatatattgtgtaatatatgtatatttggtcataaaagcagataattggaaacattgtaaaattaagcactttaattcctattaaatattaaacatttgtatcttgtaaataaacacatccttaaattaaaaaa

SEQ ID NO: 217531 - DNA, 414 bp, Homo sapiens
atagaaatgtaaaacatggctgattactttttattttaaatccaacaaatctccatttctggttagaaaatcttgccaaaaccaaccaaacaaatgcatagaagtatatgaagaaggaaatgaaagattccctgcctcccaatcccacttgcttggtgtcagccattatttatcacatggaggaagggggaaaggcacccaggaagtcccaagtcctgttctcacaatcatctggcctccctgggcaaagggaaaagagggaaggcaaaaagaatatagcactacggtttgcagaaatttccccttggtacaggaaactctggtaaactgagagagtatgttttccatgagggaggcctcaagggctcttctctggccctaagcccaaactggattttgcctcattttctgagg

SEQ ID NO: 217532 - DNA, 443 bp, Homo sapiens
ttgagagatagtaactgtgaagtacttagcacagggcctggtaagtaatgagcctacaataaatgctagctttgtaggtaagcaaaacatttaatggactatccttagttattgctgtggtgaatgcagtgggaaatatgaaagaagaatatgatgccccattcattgaatattcacaggcattatgctaggtgttttacaacactttttttcactctcataacaatactttgatatattttcattagagaaggaaatacaccagttgagtaatggaaggtcatccagcaggtaattacgagtgctgagattggaactcaggtttgtctagttttgaaacccatttcccctactttattactaagacttaatataaacattcactcatacattcgtgctttcaatccacaaatatttattatatgcttaatatgtgggagaaa

SEQ ID NO: 217533 - DNA, 508 bp, Homo sapiens
ctggcgctgggtgccagcctgagcatgtggcgaggctgggctgctgagcctcctcctccacagccaatgttccctcaaactgcttgggggtggggggagggactcatcctcatcccattagcctggctgggtattccctacctttctggtctctgagagacttacctcttccaagaagtcctcccgaatgagtagaagggagagagctggattggaacttaagtgacatctgggaggagcctgaagcccctccggttggggctgagactcctataccctaggtctggtgtctgggttccacctgggtcctctaccttggcctggattcctgctttcgttttgccagtctctcccaggatgggggtgcatggctggttcgtggctcagagcaacatctgcctctgtgtccccccatcatctgtccgccccctaacacctcttgccatattagaattgctattgctctgtcctttcattcatgtatccaacaaatatatattatctgaaa

SEQ ID NO: 217534 - DNA, 258 bp, Homo sapiens
ctggcgctgggtgccagcctgagcatgtggcgaggctgggctgctgagcctcctcctccacagccaatgttccctcaaactgtttcgttttgccagtctctcccaggatgggggtgcatggctggttcgtggctcagagcaacatctgcctctgtgtccccccatcatctgtccgccccctaacacctcttgccatattagaattgctattgctctgtcctttcattcatgtatccaacaaatatatattatctgaaa

SEQ ID NO: 217535 - DNA, 433 bp, Homo sapiens
caagactcaatttcctcatctgtgagatgggggtaagaagaatcagtgggaataagaggagataaaaatctgtgtagtacttgggcggggtgcggtggctcacccctgtactcccaaagtgctgggactacaggcatgagccaccacacccaacctcattttttaaatttttagtagagatgggatcttgctacattgcccagtctgatcttgaactcctgagctcaaagcagtcctctcagatcagcctcccaaagtgcagggattacaggtgtgcaccaccacaacccattttcctatggggatgctgaggcacagaaaggctgagtgacttgccccaggtcatggagctagtcagtgtcagggctgggatttgaacccaggcagcctgcgtagtaactgtatatagtgtctacacttgattgcttgttaa

SEQ ID NO: 217536 - DNA, 480 bp, Homo sapiens
gcgacgtggtctcactacattgcccaggagggtctcaaactcctgagctcaagtgatcctcccaccttggcctcccaaagtgctgagattacaggcatgagccaccatgcctggctgcaaatctcatttactacctcatatttcaggtagttatgtacacatcttggccttaggacttttagaaataagcttatggtggtaggctttgtgtatgtgtctctgcagcacggtggctttccgtctctttgaatactagactttgggaggctctcttgaagggttcacctggacctatgttgccttccacccactgctatgttgttgtttggatgcaatgcctcactgtctgcctgtgttccatcagaaattcataaaacaatgctctcaaatgtttctgtaagcacgtttccctagcccctacttgctgttagaacgttcttcttacctcccgcagcaagatttatctcactgaactcaagt

SEQ ID NO: 217537 - DNA, 434 bp, Homo sapiens
gattctaggacctcctgaggataccaaaatctgtggatgctcaaatactgatagtatttgcatgcaacttttgcacactcccttccatgtactttaattcatctctggattattataatacctaatacaatgcaaatgctatgtaaatagtttttatactatattcttcagggaaaaatgacaaaaaaagtctgtacatgtttactccaattgcagttttttttttttttctgaatattttcgattcttggttggttgaatccacagatgtggaacccagtgaatatggagggctgactgtattaccaatccaggcatttctagagaggtcaggattctggtatataaggaaaaagaggacctaagtagtttcagaggtaaagaaaggattttttctgaccacccttgtggctttttgagctttttagtttcag

SEQ ID NO: 217538 - DNA, 469 bp, Homo sapiens
actgtggaagcctatccttttctggtttaggaggagggtagaacgttgagagcatttgagcagacatggctttcagagccagagaaagtcaagggggaaaaggctttgctcagagactatggctgatggctattaaagatcacttcgtttcatttgtcattttatagattaaaaaaatgaggtaggccgagcgcggtggctcacacctgtaatcccagcactttgggaggccgagactggcagatcacgaggtcaggagatcgagaccatcctggctaacatggtgaaaccccgactctactaaaaatacaaaaaattagccgggcgtggtggcaggcacctgtggtctcagctactcgggaggctgaggcaggagaatggcgtgaacccggaaggtggagattgcagtgagccgagatcgcgccactgcactccagtctgggcgacagagcgagactccgtctcaaaa

SEQ ID NO: 217539 - DNA, 540 bp, Homo sapiens
aatttttgtatttttagtagagacaggattttatcacattggccaggctggtcttgcacgcctgacctcaagtgatctgcccccctcagcctcccaaagtgtagaaatatttctccatagcataaatttatgcatgtactatattccgctttctccttcagtatcacactcaaaatttgaatctacctctttcagtttgaatctaaaaattcttgtaaatcagtttttgaccattgacacttaacgcttgtattagtgaaactggccacttttcttacttgtgatcatgatttactctggcacctttaggattaatattataattttgaaacacattgacaaatactgaggttgatgctacatttcctgtttggttaaagctttgtttaactccccccatctgccgccttgcaagtcagcttgtttggtgcctggctggtgatcactgtgttagtccatttgcattgccatacagaaagggtaatttataatgaaaagaggtttaattggctcatggtacctcaggctgttcaagaagca

SEQ ID NO: 217540 - DNA, 434 bp, Homo sapiens
ggacctgtctgcctttgtaggactaacaaattagctacaagattagaaatgacagtttagggtcaggcagcctctggctgcaagagtctgaaccttcccaaattgttcctggggatcacatcactattgtaaaacctaagatcagtgcttgaggtattttgcagcccctgcactggatggatcagctgacaccacccagaccaattatttggctcaaccagttctgcaatccccgctcgggaacagaagacagcgagaaaacttcacttcgacccccgtgtgattccatctccatcctcaccaatcagcactttccacttcccaagcccctactggccaaattatctttaaaaacttccatccccagtcggagcgcggtggctcacgcctgtaatcccagcactttgggaggctgaggcgtgcagatcacctga

SEQ ID NO: 217541 - DNA, 550 bp, Homo sapiens
aagacaaatccagtacaaacaaagagaaaactacagaccaatatcccttatgaacacagatgaaataaaacctcaaaaaaagttagcaaatggaatctagcaatatataaatgtacatccatacatatgtatatacacacatatatacacacatacaccaactggagtttatttcagggatgcaaggctgtttgaatattcaaaaatttgtcactttaataaaacactgcattaacaggctaaagtagaaaaattgcatgatttcatcaatttatgcagaaaaaagcatgtgacataattcaacacccatttatgataaaaactctagccaaactaggaatagaggataacttcctcaatataataaaggacatttacaaaaagaccacagctttttgtactttgtacatgtactttgtaacagtaacatggttaatagtaaaagtctgaatactttacacttaagtttgtaaacaatgcaagtgcaggcactttcaccacttttattcaacacactactgaaaatcccagatagagtaataaggcaaga

SEQ ID NO: 217542 - DNA, 660 bp, Homo sapiens
gtgagtccaagtgtatggtgctctggagcaagagtgcttctgtcttttttatgttttggagtgcagtgcaggatttcaaaatgtttggaaatgactgaggtggtccgagtccttcattgacagatagagtagctgaggcccgaagaggggaagtgacttatcctgtagctggtgagtggcatgcctgcaatatgggctcctggatgaccaagtactgagtcctagactgggagttggtcttgagatgagcccaggcttgcctcagtgtgctttgttattccaacagttagctcccgctgtctttcccagcactacaggcagtgcttcaggttgggaagagtcactgggaaccaacccccaccctcacatacagtgactgtgttgaaggattctgggtgggtgaactacactatattcctgggtttcaaaccttgttggggatgctgcctagctgacagtcaaggttgcaagcattcaaatcgtggctccattgcttaccagctgtgcaacctctctgtacctcagtttccttatctgtaaagtaggggtgataattattcctacctcgtgggattctcttaggattaagtaagatagcatatgtaaagtgcttagcacagtgtctgacacacacagtgttattatcccagcaaggctggc

SEQ ID NO: 217543 - DNA, 437 bp, Homo sapiens
cagggacaccaggcctgactccttggcgcccccgcatggcccgggactccctataccagttcccaggcgatcctggagaggtttcatttcccacactacagccatcgtgatcctaaggcaaatactagaacagacacttctctacctaaatcctcagtgcttaccccagaattaaattgaaatcggccccttgccgcagccttctgggccagatctagggatcttccctccctccctgcactctagctgcaggagcttcctggtgtctgcccagagcttgcccctaaactgagtggctcatctttcccatccctgctgaagtcacctcctcttagaggcctcctcagagtggttcctgttgttctttttcagcaccctctttacttcctgctcagttctgataactatttataattatttatttgttggttaacatg

SEQ ID NO: 217544 - DNA, 416 bp, Homo sapiens
acatccatcagtgaatgaatggataaacaaaatattatatacacatacaatggaatattattcaacctcaaaagagaataaaattatatatatagtacaacgtgaatgaaccttgaagacattatgctaagttaaaccagacacaaaagaacaaatattgtatgattccacttctgtgaggtacctagagtagtcaaattcatacagacagaaagtaaaatagtggttttcaggggcttcagggaatggagagtggggagttatcttctaatgggtacagagttttagtttgggatgatgaaaaagttctggagatggatagcggtgatggttgcacaatattgtggatgtgcttaatgccactgaactgcatattttaaactgtaaatttaatgtttttaatattttaacacaat

SEQ ID NO: 217545 - DNA, 850 bp, Homo sapiens
cagccaccaatatgtcctaagctctgcactttctttgaaattacaagaaacgatgaacttactcgtgctttttagtctcccgtgtgaactgaattgttctgtattttatcttgctctgttatgggcaaaactaattcatgtcatcagtggcatttccctcttcactaggttgtaaatcctgtgaagtcagacacagcgttattttcatctttattttacccaaacacctacaattttcccccctcatgtgacagcctttgaaataagttaatcttccagaggagagaaaacactaaacagtcaaacataaggagagggtaaaggttttcctcataacctcacaattttcagtgttagctttaaaaaaacaaacaaacaaacaaacaaacaaacaaaaactctttatttgcaaatagtttgaaacttgaaaagttgcggaaagaaaaatagtacaaagaatccccagatggtcctttacccagatccacctgttgttaagattaaatccatttgcttaatcatttgtgtgtgctggaattctctgtctgcaaatacacactcatacggatacacatacagacacacagacatgggctaacaaatgcaaatatacagacatacaatatttttccaaaccctttgagatttcagggaagattacatacactgtagccacttaatcctaaattcttgaatgtgtatttcctaagaataggcatattctcttaaataaccacagtaatacgttaccactttcacaaatttacattgatgcagtacttttttctaacctgtccatattctaattttgggagttgaccatataatgtcctttctagaattttccctt

SEQ ID NO: 217546 - DNA, 339 bp, Homo sapiens
ctgaggcgggcagattatctgaggtcaggagttcgagaccagcatggccaacatggtgaaaccccgtctcaactaaaaatacaacaattagctgggcgtggaggcacgtgcctgtaatcccagctacttgggaagctgaggcatgagaattgcttgaaccctggaggtggagattgcagtgagctgagattgcaccactgcactccagcctgagcaatagagtgagaatctgtctcaaaaaattaataaatacggataaaccacagttatgcaattcatatggatggatgttggaaagatgtgtggcgaggtgaacaagcaagttgcaaacgtacagta

SEQ ID NO: 217547 - DNA, 122 bp, Homo sapiens
agtttatgctgcattagggttcactgaactctttagatcataggtttattgatttcatgaaacttggagacagtgtggtccttattctgaaattatttttgtcccccttctgtcgtcttctc

SEQ ID NO: 217548 - DNA, 432 bp, Homo sapiens
caagtcttttcagttagtaacatacttgctgagggtttgacaacaaagacttaatgaagattgtgataaattcacacagacacccaagtaaatgtaagcatccacagaaatgaggaagatttgttttatagactaaaattaaaaaatcttcaagaaagggaggagaagttccttcatccgtggaaaacaaaactcttgttaaacacccgacatcaggagctgttttcacatttcctttgccaacacaagaaacagttttacggtatctcatcctctgcccaagaatgagcaagaacagcttgtacacgcacatattataagaactgataactgagtccagcaatgttgcagcatgaaaaatcaacgtacaacagtcaactgtatttctatgtattagcaataaaccaaaaattaaatgaagaaaacaatttc

SEQ ID NO: 217549 - DNA, 750 bp, Homo sapiens
gcttaaacagtgcagctccaaagtgagggaataccagcaccagtaattttaagctaacacattccactgctgtgtaccagggacagtttaagtactttacatattttagctgatttaatcctaaacagcagtcctgtaaagagggtgtttttactatcccaattttatagataaggaaactgaagtgcagagagctagtaagtagtatggctaaaaaaattgaacccaggcagtttgactttggagtccatcttctgagaagttactgtatagtgtattagttaaggccttgctacaagagactttacagtgtgttcgagaaatagcagagttggtgtgagtatagcagaatgaatgaagataatggtaggagctaaggtccaagcagtggtatttagggaaggaatgaggtgggaagatttgactggacgtaagccactgtaaagactgggcttttaagtccgaagtggagcgtgtgagagtctttggatatttttgaacaggaggatgatatgatctgactttttacaaaatattttttactgattccttggacctttccttccttggagtctatgggtagaattcaggagggcccctggaatttagaagaaattacatctttattttcactaacttataactgaagcagtgtttccttcactcaatgtagccagttaaccatagtaatattagaattacctgtgactgttaccaccaataaaaatcacctctttgttgcatttatgg

SEQ ID NO: 217550 - DNA, 466 bp, Homo sapiens
agaatgagttaaagaattacttttcccactttgaggaccaggctctaggctcttagccctctggccattcctttggctacttccatgcttcccttgcctcccacacccacactttgttatatagcacactctcttacaaaggctgctgcactcaaagcattgtcacatcctgaagtaccgaggagcagcatctgagcaagcctgatggaattgctctaaaccaataaattgatttaaaaaaacaaaacatgtatgtgactattacttattttatattttctgaagataaaagatttttgtaagcccttaaatttctaccagattaaagtgaaatttcaatatgaatatcttacagtattgtgtctggctattttaaaattcattttagcattttacttaggaatttcagacctatgcaaaagttgcaagaatagtatactgaactcctatatgctcttcaccttgg

SEQ ID NO: 217551 - DNA, 330 bp, Homo sapiens
catttgtttatgtgcataactagtgtattatacacactaactttaatttggaatacagtaaatattgtattagtgtgtcatatatttactgaattaaaaattaaaattggttgggcatggtggctcatgcctataaactcagcactcagggaagcagaggcaggtggatcacctgaggtcaggagtttgagaccagcctggccaacatggtgaaaccttgtctctactaaaaatacaaaaaattagctgagcgtggtggtggacccgtgtaattccagctactcaggaggctgaggcaggagaatctcttgaacctgggaggcagaggtt

SEQ ID NO: 217552 - DNA, 417 bp, Homo sapiens
tacaaatgcacccccatagacaggttctggcatgctcatagcagcactgttcctaaagctccaacccagacactacccaaatgcccaccaacagtagaaagggaaaatcaattgtgatcccttcacacaacagaatgcaatacagcaatgagagtggccagccactgctactacatgcagccccatggaggactctcacagatacaactctgaacgaaagaggccaggcgtgaacagcacaggtggaactgaggagtcccaacccagggcaggaagggcacaagaacatcgtcctgtttgtggactcacctggtagttacccggatgtgttcacttttgataatttattaaggaatatttttatgattggtgcactttcctgtatgcatgttatatttcaaaaacaagttttcatga

SEQ ID NO: 217553 - DNA, 432 bp, Homo sapiens
ccccattatcaagctaaaagattttggcaacttgtgctctgttccactattgtccaaaaatctcagtgatccaccattctcatctagatgagacttcttctatagccactcagaggcggcctcattcttccttgcccactcctccgcagaactacatggacaggactggtgaccaagaggaaaagaaggaaaagaatgaagtctccctctgagactcatcttctaagatgaatcatattctatccaacaccaggagaaatatgctttgctttaggcatattttgcattatgccattgtctttgcttaaaatccttcagtgaggccgggcgtggtggcttacgcctgtaatcccagcactttgggaggctgaggcaggtggatcacctgaggtcaggagctcgagaccagcctggccaacatggtgaaaccct

SEQ ID NO: 217554 - DNA, 324 bp, Homo sapiens
agtagagacggggtttcaccatgtagccaggatggtctcgatctcctgacctcgtggtccaccaaccttggcctaccaaagtgctgggattacaggtgtgagccacagcgcccggccaagatttgaatctgtatttgttagaaataatttattcatgagtgttattaaattgccaattaaaaaactggcatccagatgtagttttatttctcttttattgtaaaatcctattaatacgtaatccagagttaagatggaaaatgtgcttacaatgtcctcagacatccagactcctttaatccttacctttctgtcatcttaggc

SEQ ID NO: 217555 - DNA, 507 bp, Homo sapiens
aatatgtcaaaggaaatggttatgcagtctgtagttatagtttctctctctctctctctctcagctacctcaaagaaaagatgaaattccctgtgtcaggattttgattctatgctcaaatatttttatggtgaattaccaccagtgattgtcatgttactaagaggtcaagaataactagccccatgtcataaagaagcacggctgaaggttcgatgttactttgaaaccaccctggtactctgcagcagaactaggagcaagactcaaaggctgctgtgccgtctttatttcttagctcattctttcattctttagaagggactatgccttgctttagaagatgctgtcattactttgtgacatttattatgagtttaacattaagcatacttgttacctgtatctgtgttggatgagtttgtatattaaacatctgtagccacttgacacagatgaggacctacttatactgtttatacatttataaagcttctttttttaaaa

SEQ ID NO: 217556 - DNA, 430 bp, Homo sapiens
aatcaccagccccaggtggtttgctgggtgagagctagcagatttgcaaggaacagagagttcccaactcacccaaactgttcaccagcatagaaaaatagacatggccactcaatttatagctagcaaaaccctggccccaaaaccaggtaaggagagcaagggaagagaaagctataattcaatctcctgtaaaaagaaatgcaaatagcaaaatgaaaccatgacagaatgaaaagaacaatatacacatgatcaggtagcttttatactaggagttttaaaaaggaaactatcaatatagttttatatttaaacagattaaagaccagaccatgtaattaccttaatgtaacccacgctgataaaattaaatcaatgatgcaagtaaatgctttgtatgcaaacagtgatgccccagcacacatac

SEQ ID NO: 217557 - DNA, 149 bp, Homo sapiens
aggtactagctaacacagccaagaaagttaacaatagagccgtaagtatttcccagatgaagaaaacacaagtttagcttcacttttgttttggaatgcaaatttatactggttgagcatcccaaatctgaaaatccaaaatccaaaac

SEQ ID NO: 217558 - DNA, 629 bp, Homo sapiens
attccataaaaattagactgcatttctggagaagtgccatctggcaggaactgataagaaaagagcttcaggaactaaaatgaacaattactttgaaatgtcccttcttacttaccatagtcaatgaagaagatatagacatggattaataatgaaatccagaggtatttgttcatgagtatacaaataccttaagaaggctttaaatatctgagccatgctactaagacatcaagaaactatgatactctcagtagcgctgtccaatagaactttctgcaatcatggaaatgttccatatctcctctgttcaaaatggtacatactagccacagtagctaataagcacttgaaatgtggctactggggctaaaaaagtcaatttcgtttttgttttttaagttcatgtagatgtgactagtagttagcattttggacagtacagctccacaatatctatgattcacattaggagcttactaaacatggaagggctactggaatctgggcctaacaattttatctgaagacagttctaaatcaagggtttaaaaataaaaggtcttcatcctattccttatcaatatagctggagaaacaatctactttataaaagaaatcagcataaa

SEQ ID NO: 217559 - DNA, 500 bp, Homo sapiens
aattcatggttccatgagcctttttctttttactcaaagaaatagctaagccttagagagccatctcaagatgcctatggatggggagggcaatgcagggacatattacaccttctttgagtggctttgggctgtctgaacatttgaatcccagcttctaaatggtaactgtaaaaagccctgatgtcattggattatgattaagaataagatttttaggccaggcatggtggcttatgcctgtaatcccagcactttgggaggccaaggtgagcagatggcttaaggctaggagtttcagactagccccagcaacatggcaaagccctgtctctaccaataaaaaataaaaataaaattagccaggcatggggatgtgggcctgtagtcctagcttcttgggaggctgaagcatgaggatcaattaagcccagaagattgaggctgcagtgagccgtgattgtgccagcctgggtgacagaatgagaccctgtctctaa

SEQ ID NO: 217560 - DNA, 377 bp, Homo sapiens
agatgataaggacaaagtacaagatgaagggaggtccattggtcctttttgtggagggagaacttagaatatgtatacaaaggctaaacaagagctgtggaataaaagctaaaggtagaagaagaggaaatatgtcctatatcactctggtgtcatatgctgccgcacaaaaactcagttgtactcttcaacatgatatatactagctgttcactttccacatatccatcatttccaaaaacattctcaaccactaaaagataaaaatgtctgtgaccccagggctttcaagttcctgttcattcagccttccaaccattcatccatctattcaacaaatgtttattaagcacttaccctgtcctggtttgtacacg

SEQ ID NO: 217561 - DNA, 592 bp, Homo sapiens
gctgggactacaggtgcacactatgcctggctaattaaaaaaaattttttttgtagagacaggggtctggccgtattgtccaggctggtctcaaactcctggcatcaagtgatcctatggcctcggcttcccaaagtgctggtattatgcacgtgagccaccgtgcctgatcttttttttctatttcctttttgttttcctatttctatcttcctttttgtttgtttgctttttttagagacagggtcttgttctgttgcccaggctggtctcgaactactggcctcaatcctcctgcctcccaaagtgctggtattacaggtgtgagccaccatgcctggcctttttttttctatttaattctgccttcttgtttgtttgtttgtttgttttagagacaggatcttgttctgttgcccaggctggtcttgaactgctggcctcaaacagccctcccaccttggcctcccaaaatgctgggattacaggcatgagccaccatgccgagcctaatttctgcttttatctctattaactgccatctgctttcattaggtttgctttcttcctttatgttcatcctttctcttca

SEQ ID NO: 217562 - DNA, 509 bp, Homo sapiens
taatacctagttgacttcatggtgcatggagactatccttccaactccatgacttctcaatttttttacctcttactttatttatgttacccactcactccctttatcgtcccctagtctttgtgatttcccagtaacatcacctcttgcgtgaacctcacttgcaagaatctcactaaccacccctaactgcacagtgcataccttctggttcccagactccaacaacctccctcccaagtcctcattttggccctaagtagccaaagtccatagtccatcattataattaattctctgcagaaaccatcagctaaattggtctgctcttgccccatcatactcacctgacaaaattccaaccataattaaatcttactccatgcctgcacccataaaccaaactttgctgaagataattacactaccatgctgaccatgccttctttaaattcatggtcactatcttcaatttggacccttaatgctgcctggcaatacataggcaa

SEQ ID NO: 217563 - DNA, 347 bp, Homo sapiens
atattaggactagtgtgtactgaatttactagtaggacattatttttcagatcttcaagaacattggtaagctggatgcagtggcctgagcctgtaatcccagcactttgggagactgaggcaagtggatcacttgaggtcgggaagttcaagaccagcctggctaatatggcaaaaccccatctctactaaaaatgcaaaaattaacaatgcttgatggcaatgcctgtaatcgcagctatttgggaggcagaggcaggagagtcacttgaacttgggagttgccgtgagctgagatagcgccagtgcactccagcctgagtaactgagactcctatctcaaaaaa

SEQ ID NO: 217564 - DNA, 363 bp, Homo sapiens
tgacgcatgtcttacactgttaggagatgaaacttgctggccagtatgtgcaattaacggttcctgatacactgttattgttatttggtatgtctggtaaacagccacaaatatattactcattgtttgcttctcagatatatttctgattaatggtttttgccttacaattgttgaaccccaaatttttcacaaatcaactacaaaaggacattgttattacatacgaaataaaagttctttacagtacagactatactagttagaaggttttgtatgtaaacctctgcttatcccaagtcacactgaattggcactataatttccatttacttcccctttcaataaacttttaaactctga

SEQ ID NO: 217565 - DNA, 302 bp, Homo sapiens
agtcaaattaggtaccccttgacattttagtcagcttgcgttatcttggtgagtggccttctgctgacaccgcaaaagaagattgtggttagagcctgttctgagttggctcaagttgactccactgttgttcacaacttacattaatgggatgactaagtaaacaagtaattaccttaaaaaaaatcttagaagcctggcatggtggctcatgcctataatcccagcaggtgggaggattgcttgagcccaggagttggaggccagctcgggtaacatagcaagacccccatttctaaaaa

SEQ ID NO: 217566 - DNA, 455 bp, Homo sapiens
tagatagtgggatactttcctttctgagcaaacaatgagaaaggctgcttcctctccaccctccctatccccgaccctgggcatcgcactcctctacctagacatcactataaaaagacagccaacaataaagatgggtctggacagtaggaatgcatgtgtggcggtatgatctctagtatgaggaccaaaggacctctacaaccaaaagagatttccaagaccttggtatatctaaagaggactcctcaaagataagaccacaaaagtgaggaacaattcaacaaggcaaccacacatgaccctgtgtaaagcattcctgaagctgaagggaaaacaaacttcaaaaatcatgacattgctgaatgaaagcagaaagtctttaaaatgcgagtttttcattaaaaatattaaatgcaaaggcgataaatgcttaaagaatataataaaagtcg

SEQ ID NO: 217567 - DNA, 413 bp, Homo sapiens
ctggaaagtctcagcaatagaattgaacaagtagaagaaattcagagctcgaagataaggtcttcaaattaacccaatccaacaaagacaaagaaaaaagaacaagaaaacaggaaccaagcttccaagaagtttgggattatgttaaaagaccaaacctaagaataattggtgttcctgaggaagacaattctaaaagcttggaaaacatatttggggaataatagaggaaattttccccagccttgctagacacctagacatccaaatacgagaagcatgaagaacacctgggaaattcatctcaaaaagatcttcgcctaggcacgttgtcattaagttaaaaaaaaatttttaaagaaaaatcacaaatcccaacatccagatagagttaaacaaaaatcaaatgcatc

SEQ ID NO: 217568 - DNA, 395 bp, Homo sapiens
gggattggcttggaggtgaggaaggaggaagaaaagcccagcactggaattagtccattgttatttcaagataactcactattttatggattatatttgtgtaagtattttacagttacagaatgcattaaatatattgaatcattttgatccccacaatgtcattatgagggaagatcattagcttcattttgtagctgaggtctggttaacttgccaaggtcatgcaggttgacccaaggctcaaaaccaggccttctggctctgggatcactgtttcccatcgtcacctcatacatgggtggatagaagtttgcgacagaaagagtgaatgaatgattctgtctccctagctagatactacagaggatatggaggtaaataatatttggttt

SEQ ID NO: 217569 - DNA, 389 bp, Homo sapiens
actccacctcaaacaacaacaaaaacaaaactagctttagcattaaagatgcactaatgcgagataaaatttggttttctcttttgaagaatatttttatgtaatattgacagagagagacaatgaaagatttttatttggctttggagtaaactattaaaaaaaataaaagaaagattcagttggcctcatgctatcttcactgggttttgttgtttagaaagctgagtcttctctctatcagagtaaaggtttttcctgttacaaaatgtttgagttatcattgtggctaaatgaattacttatggtgacctgggattctactttgtgatatctagtgtttcaaacctttgatatttaacatacttcccaagatcaaattctaagtt

SEQ ID NO: 217570 - DNA, 466 bp, Homo sapiens
ttttttttccttggtagcgatcaaaatgtcgcgagtttctacacacatattttacagacgttccataaatcttcccgtggtgcctcttctctataagtaaggtcccttgggaagtcattgaggcttcctcactacatgtattcaagagaaaattggttgtaacacttagagaaggcggctgtccgggagggggaggtaggggtggggagtgtggagaagctagtccaagttcagttgccaaggacagagagacaaggaagcctccttttcttggaaattcctgaaatttccaaactgtcttttacttctcatgcacaaataatctctttgtgctatcttttttatcctttttgtttacttatttctaatcgccagaggggtcattctttcgcacaaaatctgaaaaagtagacagaagtagaaagaaagatacaaccaaccaaataaacaaaaatcccacgacaaa

SEQ ID NO: 217571 - DNA, 534 bp, Homo sapiens
atgaatgggcttaatattctacaacgttcatttattcaacagaattgtattgagcagctattatgtactatactacatggtgtaagcccaagatatgagccaagaaaaattaagtattctacataaataaaatttacattaaccaaaatattgcaaaacattttaaaaaatcatttttatattttgcccaaatccacaaagtttgtaaagccaataatgtaaaatctccaaggacttgttaacgaaagagcccacctctaaataatctatggatcaaacaaatctcatgggaatttaaaaaatgcattgaactcaattaaaacaaattcagtatatcaaaatttgtaggatgcagttaaagcaatgcagggaaatttctaatactaaaatgtactaaagagtacagcagaaaaggagaagtttcaaatcaataatcgaagctcactcctcaagaacctagagaaagaagagtaaaatcacccaaaggtaagccaacaaaaggaaataataaagagctgaaatcagtgaaactca

SEQ ID NO: 217572 - DNA, 517 bp, Homo sapiens
ccaaatatcagttattttaggtgctgttatgtttttcatatgctgttccactcttacatagaagatgtttcacctgcttagatgttgtagaccgtggtctgaagccagagctaaaggctttattttagttgttgttttgagaagcataatctaagatgatgcttaagattttgatatctggggttaaataatgtcataaagaaaaaaattttgaattattttggagtggaaagcttcagattctgaccctaaagaatgttaagaaagcattcaggcacattttggtcaacatctgtgcattgaaatctaggtcttaaaacagtttatattttaagattatttcagcagcaagacaagaattttttaatgccagtacattttgtgacaggttaactggctccctaagaactatatttggcttgcaaatgtattttgtttggcccacatagtgttttttttttaattggaattaattgccagcatttaaaaataaggatatttcataataataataata

SEQ ID NO: 217573 - DNA, 694 bp, Homo sapiens
tgctgtggctcatgtctgtaatcccagcactctgagaggctgaggcgggtggatcatctgaggtcaggagtttgagaccagcctggccaacatggtgaaaccccgtctctaataaaaaatacaaaaattagctgggtatgatggtacacgcctgtaatcccagctaattttttatttttagtagagacagtgtttcaccatgttggtcaggttggtcttgatctcctgacctcaggtgatccgccagccttggactcccaaagtgctgggattacaggtgtgaaccgccatgcctggcgcactcacacagttcttaaattgttgttataagaatggtatgtcagaccaagttacagtgaaagataatccctgaagaagagcaggtctttttagacttggaaaaaacactaggtggagatagttaaaatcctgattctgccacaatgagtacaatacactattagtttctttttttaaaaaacgtatttatattataagaaagtagaaggaacacaaaacatttacattcatgtaatgtgaactcaaaatttaggcatggtcaaaaatggctcttgaaaatggtgacatttatatttttgaaatgtatcagtatctaatttcccctttatataatgagctactggaaagaaaataccatgtttcaatctacagtctctatatttaatagattcct

SEQ ID NO: 217574 - DNA, 410 bp, Homo sapiens
  misc_feature (13)..(13): n is a, c, g, or t
gggaaaggggggncccccccccaaattggaaggagaatcttttgtatctctcttggtctcatacctcccctgaattgtctaaaagggaaccaggggcatttgtagaccaaaatgatgatcttcatgccctgagccagagccccatccactgtcactggccctgctcaaccctgtcatgcgagaggctgcagggggaggaagagcgtcagctttcagtcctcatgaggggtcctgttccacacgcaatgaccagaaacaccaaggccccagctgcccctgtgatttgggcaattaactgttttaagagtctgccccctcctctctgaggtcaggccaccatcacgtctcacagtgttgagggataaaggccactcccacctggtttctctgccttcgaattgtcctccaac

SEQ ID NO: 217575 - DNA, 404 bp, Homo sapiens
ccccacacctggcatcccttcaagggaactacagcttttgcagctgaggcctctgcaggcagcaagtttcagtggtcaccactgagatggtaaggtgaggacaggggaagctggcatttttggccttgataccggagaaagacaagggataccctgttttgaggtggggggtgggtacagagagagatgggcactgacctctgattcattagcctagaacccttagggaagttttcctaggtattcttgcagaaagcagaaatggagcaacgaatccttttgttccatactgaactggaggtggaactgggataaaaggtcaagacaatttgtggataatccagaggtttattctcagatcctcttctttcccatctccaaataaagacttaagctttgtcaca

SEQ ID NO: 217576 - DNA, 596 bp, Homo sapiens
agtggtggctcatgcctgtaatcccagcactttgagtaacttatcagatggttagaaaatacaacttttaaaggttttgaggctacagctaaaacaaagatacttaagacagaagacagaagaggatagttcttcagagcatgagaaaaaaggaaaatatgatctgactccatgaatctaggagagagaactcaggctggcaggatggacatacctgataatctggccagaagactggatgaatcctcaggttggctaaaaattgaatgcaactgtaggctgccaaatgagattaatgtttgaagcagtctctttgcaaatactattagaattttttggctaataatgactaagataactcttccttcataatcaaagttacttatttttgcctacagttccccaggtatcctttactgcaggtgattagctgggaacaaaatccagcttagtaatactagaactgtatcaacttttgactgtccatttcactagctaagctgcctccattgtacatgtgttcctgataatgaactattctcaaacatctctgcctgtcatgtatgtatcagggacagaaacactttcatagttta

SEQ ID NO: 217577 - DNA, 579 bp, Homo sapiens
tgtatttttagtagagatggggtttcaccatgttggccaagatgatctcgatctcttgacctcgtgatccaccctccccggcctcccaaagtgctgggattacaggtatgagccactgtgcctggccgaggttttattttcatatattgctgttgagagagccagtccataatggtgatttcttttttcccccaaaggttttaggtattaaaattcacagtgctgtgttgtggtatagcctttcttcacttattatgctgggtactttgtgtgggtctttttaacttggaaactcatgtccttttgttcaggaaagtatttttgtgttatatctaataatttcctcccctgttttctccttctggaacttctgtgaggaaatttggttagttgtgtaatcatgtttttctcacctatcctcctttctctttatttttttaatcttctgagagatattcttttctttaccttccaattctttggaacttcgaatatttgttaaaaattttaattctacattctagtttttttctaacatttatgatatttgtcatttcacgtaaaagaggcttatgaaat

SEQ ID NO: 217578 - DNA, 633 bp, Homo sapiens
ttttttttcctgcttctcataaactcactttggtagtgactagaatctactttcattaaacaaaagtgaaaaaagacacatgtatacaagtaatcccaatgagagttttgagatttttacaagactttttcatagaaaaatttttgacttatagtaagtatgcaataattgctactattttttttaatttgcagaagggaggtttttcaaatgcagttctttctttttcactctctagcagtttagagtggctggacaatatcacatcacttatatagtcaaggaaagaaacagggctctagatgggaggaggtggaatttgagaacatgattatagaattgtaggtacaaggccaggcgcggtggctcacgcctgtaatcccagcactttgggaggccgaggcgggcagatcacgaggtcaggagatcgagaccatcccggctataacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctca

SEQ ID NO: 217579 - DNA, 416 bp, Homo sapiens
cccattctttgcaaagtcatttctctgctgtggggataaatgcatatgtgattgattgcttcctttggaaagggaatcagaaactcaaaagaatgcaactgtttgtctcttatctacctatgacctggaagccccttccctccttcgagttgtccagccttttagacagaaccagtgtacatcttacatatatggattgatgtctcatgattccctaaaatgtataaaaccaagctgtgccccaagcaccttgggcacaggacttcctgaggctgtgttacaggcgtgtccttaaccttggcaaagtaaattttctaaattgactgagacctatctcagatattttgggttaacacatacttacatattttcaggatgtgatatagaaaaagaatataaaatatggaaaaagaata

SEQ ID NO: 217580 - DNA, 258 bp, Homo sapiens
gacaattttacatttagttttcttttattttctccttttttttcccactgacaggcaaccttgaggttatttatattctgctgaactcatgggaataatacctctattgattataaagcatttttaaaataattggctttaatgttgttgagacgttaaggaaaactaaggctccgataacaaaataccagccataatagttaagaagctggagtgagaatgcccatgagtaaactctgggcttgccactttttactt

SEQ ID NO: 217581 - DNA, 435 bp, Homo sapiens
ttatcattggtgttgagtaatttgatcaggatgtaccttgatgtggttttctttatgtcttttgtgccactgagattcattaagcatctttaatctgtgggatttttgttttcaagaaagttggacaagtttctgctattatttcttcacacatggttttctgttttttcttcattattctgtcttttgtggggagtccatgtactgtatattaggctgcttaaagttatctcacagctcactgaggctatgttcattttttaaagttctcttttctctgtttcactttggatagtttctattgctgtgtctttacacttagtttcttttaacttttttctttttaaattgaggtagagtctcacctcagtttatgaggtaagactgtgttgcccaggctagacttgaactcttgggctcaagctatccttccac

SEQ ID NO: 217582 - DNA, 430 bp, Homo sapiens
tcgggtgggactggtggtaaacagtccaggtgataattgaggtggcagcagagtgagcatgcactaacaagaagacgggccatcgcgagggctaaggatggggcgggccatcccgagcatgtgcctatgcggacctgtttaccacgttgtggcagccttcttgttcagctctagttgctgagcccatcagcgtagttctttccaaggtcaaaggtgttttaggaacagaggaaggaatctaagagtatcaggctatgtactgattgcgttattttattcaattacaagaacgtgaggaaggcatagttcttgttcccatttgacaaataaagataatgcaaagaagagattgaagagcaaagagctgtgcaccaaaagttggaagttagatttgtttgattccagaccccatattccttggagcttcccc

SEQ ID NO: 217583 - DNA, 431 bp, Homo sapiens
ggaataagaagggcataaaaatgattcttaaatactccatgtttcagtaacagctcctaacagcccataattcagtgcattaacaaataaatagaattcacactctcctctatcacaaaagtggtaacgactggcataaaagttttcagaaaagatgtgttcggagtgagatacattcaacaccagaatctgctggagacagagttctccaggctcttcccctaagtgacggaagcattcattgttagttgcactaaattgcttcatttaattcttgcaatggccttatgagatcagcgtcattaaacacattgtacagatatttttttaatgggccacaaacaaagtaactaaccaaaatcacagctggcaagtgatggattcaaacccaggtctctccaattccaaagtccctgctctaatcatagcct

SEQ ID NO: 217584 - DNA, 546 bp, Homo sapiens
agcctaggcgacagagcgagactgtctcaaaaaaagaagtaattgtgtgtgtcctacaaggctgcgctggtgtcttgatcctttggccttcaaatagcaaaggtttgccattccttaggagtcattaaactcccttcacccctcatctattcactaaaatataggagcactccacaaaatatgcaggtccaggagagaaaggggcaaatgatcaggctttttactaatttatccactgacatgtttggtcattttgtggctcattagtagaatccatatttagagccaaatgctagagctcattttcttttgtcttttcgacaccagttaatgaatatgaagcccaaaaagatgtgcagatgtggtcaagctccccaagcaagactagaacccaggccaaatagtactactcatatttagaggtaatatatgttttctagtggcacatttatgccagagcagttttttaatataatgcatttattagccaacccttacctagttatcatcaatacttcatcagtgtgttgatgatagcaaaaaaaa

SEQ ID NO: 217585 - DNA, 496 bp, Homo sapiens
cagggctccttctgaatctcagatccttggggatctgtgttggctgccccagggctgtggctggggccggctccccagggctcaccgagaatgaacaggaagaacagccagaccaagtgagagtgatcggcagcttgctaacccagcctgctggtgtccctctctgctgccccaggagagaccccgcatcttccccacacactgctgtgggactcaggacaccttgggttcagatccacatctgccctcggcagccctgaccctgggcctgtggctgaatatgtctgagtccctttgtcctaaaatgaggtcgagccaggtgttcctggggtctttcccagcccccaactgaaactgaatgccgcgaggcagccagccggccttgggaggcctccacacagcagcatactttgggaggctgaggcgggaggatcacttgaggccaggagttcgagaccagccaggacaacatagcgagaccctgtctttatataaa

SEQ ID NO: 217586 - DNA, 742 bp, Homo sapiens
cagggctccttctgaatctcagatccttggggatctgtgttggctgccccagggctgtggctggggccggctccccagggctcaccgagaatgaacaggaagaacagccagaccaagtgagagtgatcggcagcttgctaacccagcctgctggtgtccctctctgctgccccaggagagaccccgcatcttccccacacactgctgtgggactcaggacaccttgggttcagatccacatctgccctcggcagccctgaccctgggcctgtggctgaatatgtctgagtccctttgtcctaaaatgaggtcgagccaggtgttcctggggtctttcccagcccccaactgaaactgaatgccgcgaggcagccagccggccttgggaggcctccacacagcagcagtgccagaaatgacgacacaggcctcaagcccgctggacagatccccctggccctgtggttagccttggctttggcccttaacagggcagacgtggaggatctagttcaaagcagtagcttcggggctgggagcagcccctcccctggaaacctcttgggaagccttccttctgtgtgttctgaggtggtggtagctctgtaacagctctgggcacctcctgttctttctttcctttggctttctttactttgggaggctgaggcgggaggatcacttgaggccaggagttcgagaccagccaggacaacatagcgagaccctgtctttatataaa

SEQ ID NO: 217587 - DNA, 535 bp, Homo sapiens
ttcttttaacatcagtgggtaatcttacctcacaaagttagatgtaatatggaaaaacctctacaattttcaaacccataataatcaagttctataatcaccaaaaaagaaaagtacaaaagaaaaccaatggtgagaactcttataaagcaagtacaaagacaaaattggctatgcactatcattaacagaagctatcacggctcctttgtaatcttaagcagctattccatgatcttttctctcgcaatgatgaaccgaacttttgataaaatatttgatctccttttagccaaaactcttctttataagcccatttaatattccagaaggattttctttcgtttgaagaaatataagtttgacattctaaaggcatttgtattttaaagcctacaaaaagatttttggagagtacctggtgaagtaccgacttgcccctgtggctcaaaagttcaattattatagacatttcactcagaacagcatttctgtcttttaaccttcatctaaataaatgttcatttttataaaa

SEQ ID NO: 217588 - DNA, 540 bp, Homo sapiens
tcaagcctcgggagctcacccagcaatacatagctagggagaaggggtagggagaataaaaatcagcgaaagccaggatattaataaagagttttgatggttaaggacaagcaggcgaattaagactctggaaaccgagaaggtgtatagaaaagaaaaccagagagctggacgacaaggacacagtaacagcacaaggggattcatctaaagggcattccgatggagcaggcaggctgcgccccgaaaggtggggagaggttggaagcagatgggcaggcacaggcgagcgtgcactgcctgaaaaagttttcatgatggctccagcctaatttcccaacgctggtctcgggcgccacaaaacctgggcggcccgaccggagccaggtgccagcctcagggccgccgggcccggcgcagcgtccggaattcctgcgatgtctggggcgcggcggtggctcctccccgcccccaccacggcctccgccggcattttccggctaggaggcccgccagcccttcgaagaaccggctccacgc

SEQ ID NO: 217589 - DNA, 867 bp, Homo sapiens
ttttgccttgtgttcaagactaaaacttttttcttgcttcattttttccttctggtcattcttgtattcctgtaatacatgtggtaatccgttgctgtgtcctacagtttatgatgctctgtttaaaacaaaaaaaaaatcgattttctgtttgtcggatcggataatttttactgatctatgttcatgcctactaacttttccttctgtcatatccaatctgctatttagcccattcagtgatttttaaaaatatttcagatactatattttctacttctaaattttccattgctttaaaaaaataatttctatttctctggtgtgatttcctatctgtttaatcattgccagcattttttttcacaattaataagttttatttttgatatttatgttcatcgttttatcactttttatgaccgaggtttagtgaatagttttaagtttttgttaagtaaattagtaggccctcctgtactctggccctcctttctgtgttagtggtgttcacatcagttttttaaatgaatgatttggtgctcctggtttctccagtgtattttttgttacggcttctgcttttgtttgtttgttttcagacaaggtcttactctgtcacccaggctggagtgcagtggcatgatcacacatcctcgacctcctgggctcaggtgatcctcccacctcatcccctcgaatagctgagattacaggcgtgcaccaccacacgcggctaatttttgtatttttagtacagatggggtttcaccattgttgcccaggctggtcttgaactcctgagctcaattgatccacctgcctcggcctcccaaagtgttaggatcacagacgtgagccaccact

SEQ ID NO: 217590 - DNA, 258 bp, Homo sapiens
catttccaagtgaggtacctgattcatctcattgggactggttgggaagtgggtgcagcccatggagggcaagctgaagaagggtggggcatcacctcacccaggaagtgcaaggggtcaggggatttccctttcctagtcaagggaagatgtgagcaactgtacctagaggagtggtacactcctgtccaaatactgctcttttcccatggtctttgcaacaggcagaccaggagatttcctcctgtgcctggtttg

SEQ ID NO: 217591 - DNA, 776 bp, Homo sapiens
tgataaggagaaatgggatgtatggaaggagaaagtgggtggaggtcttacttgtatatgagggagtcaccaagatgtccttcagtaggtgaattaataaacaatctgtattgtatctagaaaatggaatattagtcagcattaaaaataaatgtgccatcaagccatgaaaagactcaagaggaaacttaactgcatattgctaaggaaaaaaagccaatctgaaaaggatacagacttcattcatctgactatatgacattgtgacagtaaaaagatcagtagtttccaggaattagagggagacaggggatgaataggcagaacacagaggatttttaggatgtgttctgagacccccagtggatacctgaaacctcaaatagtattcagccctatacgtactatgcttttttctatacatacatacctatgataaaagtttaatttataagttaggcaatttataaattatggtaaaagattagcaacaatacctaataataaaatagaacaatcataaaaatatgccagcatcgctactcttgagctttagggctttaagtaaaacaagggttacttgaacacaagcactgtgataccaacaacagttgctttgataatcaagattgctattaagtggctaaatgggcaggcagcttatgtggtgtggatatgctggacaagggaagattcatgtccagggcagaacagagtggggtggctacagatttcatcatgctactcagaatgggatacaatttaaaacttaggag

SEQ ID NO: 217592 - DNA, 502 bp, Homo sapiens
cttgggtccctgagttaccagtctctccttctctcatgatcatattatctgggcattgcccacatgcccgcttcctttttagccctgtagacacagtctatgtctatactttctccctttgtctgagaactgaccttcctgactgaagttcacaagagccaacagttggctcttatagttttcagagacaaatctccagggttcaggcagctcctaggccactcggaatgacatcgttgcttaaaagcatcactttactctaaatgagcctcagaacacctcggagcgcggtagtacctgttactatttcagagaaggattgctaagagtacttttattgtaagacttaaaggtttaaaacgtcttgtgagcttttgctgtataatttcaataaaactcataaaaaaagaggaataaaaaagaaagatagttttttgttttaatttatttacatattgagcattttttaaatgtcaaagcaagaagccctcctaagtaccaa

SEQ ID NO: 217593 - DNA, 370 bp, Homo sapiens
atttgccttccaaatcctgctgcctttgtgctgatttttgtgacaagttctaacagcttcctgccttttcaaactctctgtgtacttttacaacaggcacttacaaaaattaatctggatcagtgtgtgatgaagagtgcctttagtaaacaagtggtttaaccttgagtgttggccaaaactggagaagtgaagacaaccaagaaaagcttgttacagaggagggagggagaaagaaagcaaagatgtctactgctgttcatgtgtagtgcatcagcttagccagacttgtgaactaagggcactgctacttttgaaattttcctgagagttaaacaagaaaaatgaataaaagaatgaaagaaccatt

SEQ ID NO: 217594 - DNA, 486 bp, Homo sapiens
gctgacattgtagaatgaattcatgaattttacaagtataatcaaagacaaccaaaaatttttactttttccttcaaaagctaagtgtagtgtagctcccccatagtctaagttaaagaagaacactaactgcctgtttttccttctgtgctcagcaagccttatctgtacttgctagtttcacattccttgaggctcagcgagttcctgcttcaccaccctagcgcagctgcaaagttacaaggttgatgcagaaacatggtttcccagggatgtggaacatgtagtatagataaatgtaaaagactgaacaactgcctttgctctcgcttctgtaagtacgcttcctgcctcgcgtactcccggccaccgactgcttaaaaggtggctgctttctttatccagggctcagactttcctggacgctagtcctactgagccaggtgatcaccttttaataaagacctttcctgaactcaaaaaatt

SEQ ID NO: 217595 - DNA, 630 bp, Homo sapiens
cgtggtggtgtgtgcctctagtcccagctactcgggaggctgaggcaggagaaacacttgaacctgggaggcggaggttgtgggagccgagatagcgccgactgcactccagcctaggcaacagagtgagactcagtctcaaaaaatttggtagcaacttcagcacagactatggaaggaacaggtcaagatacccacctccctttctccacatgtcactggtttatccatatagggagatggtggcgttaaactattataacttgacagcgaataacgatcatctaaccaacttttcatgctctaattcatgctcaccaatcatccttccatggatttgctgacaggaagagtgtttttctgatttgcaagtgtgtgcccagtctgcctgtctctctaatttctggcttgctttcaaattggatgccgtgattctgcctcccggaatctggtatataatagaaaagttgaatttccaagtattttaggctaaggaacatagctagtctagggtactgttcttagaagatcagatgaacttccccagtgggcactcctctgttccatgtagaagcagcttttctcagaattgatggctcatactctttgacatttattttggtacagagg

SEQ ID NO: 217596 - DNA, 424 bp, Homo sapiens
gctgtgaatgccattatttcattcctttttatggctgagtagtattccatggtgcgtgtgcgtgtgtgtgtgtgtgtgtgtatcacattttacttatctacttgctgattgatggacatttaggctggttccatatttctgcaattgcaaattgtgctgctataaatgtgtgtgtgcaagtatctttttcatataatgacttctatgaaagctagtttaaagtaaggaggctggctaatacaaaacaaaatatcctctctgctcttttcatagactgggaaggactaggatttgcttcagaaaacctatgtttgatgtcttttactatcctttacgggtacatgggcctggcatgtgcaacttaaaacttcaaaactcagggtactactctaagtttgaaataagttaacatgtacaaaggcac

SEQ ID NO: 217597 - DNA, 464 bp, Homo sapiens
caagaacacaggcttcagagaaacatgcaattgattgacagcagggaagaaggcaggccacaggtgagatatgaagactaaaataagacagcaaccaggtgtgttttaatcaccaactcagcagagctcagaaggcctgagagcattgttgtatcacagaaatgtgtacgatgagttctgccaagtaaagattagtcattatgagaagctcaaattatgtcccatatccttttattaagaaatgtttaaaaattattttaggaaaaaaatttccaaaatcttagttactagtgtcctcagataagcaaaagaaaaccaaaagcataaaagcaacaaacaacaaaaaatctatctattcagtgcttctcattttcttaagatttcatcgtgaatatagctttataatgttgtaaaagtcaacaactttgaacaacatatattaacagtatacatttttattttaa

SEQ ID NO: 217598 - DNA, 324 bp, Homo sapiens
aaacaaacaaaaccaaaccccagggctgggtatggtggttcatgcctgccatcccagcactttgggaggtctaggtaggtggatcgcttgaggctagctagttcaaaaccagcctgagcagcacggtagtagtgaggccccatctctaccaaaaaataaaaataagtgagcggtggatggtggtaagtggctgtagttctagctacttgggaggttgagctgggaggattgcttgagcccaggagttccagattacagtgcagtaaactatggttgcgccactgcattccagcctgtgtgacagagaccctgtctctaaaaagg

SEQ ID NO: 217599 - DNA, 314 bp, Homo sapiens
tttgctaagcatttctgtttagggagcacatattcatgggacagttgtttttgaatgctttgcctgaaattgcttttatctccaggctccccatgtgtcagtttgaaagagaaagcgcttagcatgcagcctgggcatcacatgtgttctgagatgctggcacatggaaggcttaggaggttccaaatcattgcctattggccacccacaggctaatgaaggaaatgtcttttcattttctctgcttctctcggacttaggtgccttatcagcagccagggagagctgggaatacgactctggtgccagggacc

SEQ ID NO: 217600 - DNA, 153 bp, Homo sapiens
acaggcatacatgtgcaactgtacgtgcactctaggaatccctaatgatcatggccatcgggtggctcgcagtgcactgagcaccatgctctgtccctggtgtcttcatgcctcagtccacttgatcccctcagcatcctcctggggaaggtg

SEQ ID NO: 217601 - DNA, 213 bp, Homo sapiens
atgattttcttgtattttttgagttctctgtagaagtgtgacaattttaggctcctttggaagcctcagaaccaagaaattttgaaagcagctatttatataggaaaatgcctctctgacattacatttagtttattaatatttaaaaatattaattgaacctcattgtgtccctgtaatttttctaattgtataagtaaaatgatgagcata

SEQ ID NO: 217602 - DNA, 545 bp, Homo sapiens
cccaccctgcttaagacccagattgcgcgtcttacatctgagctatgtggactccagctccgattgttaatacttgcccaagaaagcttgagggtaatggaaggttatttttctgttctcattgaacttcccaatagacatttgcaggagctttaatcaattaggtgatggccactttggcaataccacgttggagttttgcttcagaaatgctttcctaatccccttaggcaccacaccttctaaccactaatattccctaatacctcgtggctcctgagaaactaggtctcatcaaacctgttaaggataagtataataaattaatagtagagcaaactacttagagttaactgcttcatactttttcaaaaaatcttttgaatccttttgctcataggaaaattgcatatgtactaaattctcaaattgtttactttgagtatctgttgactaaattgatgtttgaaaatggttatctcttcacctatataagtagcctttcagttgtgtaatttttaattattaaattttaaagcatcagt

SEQ ID NO: 217603 - DNA, 408 bp, Homo sapiens
gagacagagtcttgctctgtcgcccaggctggagtgcagtggcacgatctcagctcactgcaacctctgcctcccgagttcaagtgattctgcagcctcagcctcccgagtagctgggactgcaggcatgcgccaccacacccagctgatttttgtatttttagtagagacggggtttcaccatgttggccaggctggtcttgaactcttgaccttaggtgatccaccctcctcagcctcccgaagtgctgggattacaggcgtgagccaccacgcccagccttagatggcaccttttgatgcactgtctgcacctcgcctcctccagtccaaggcccagcgcagcctccctggacacacagccacccacccttctcctccttctcctctgggacacacatctgtcca

SEQ ID NO: 217604 - DNA, 361 bp, Homo sapiens
ccctggtggcagatgctatcagctgatagcctctctgaaaatcctgttggacatgaaagttcacagtgagagagggtaggcaacatcatcttagaagagaatggccaaattattctgtaggccatgtattttctccttttgctccattctacctttcagatggaactattttactctgtgtaacacttgagtgcttgtttccttccattccttgagaacactggccacttcttgtccttctctgtatcttgagcacctaacacagtgctaggaagtaggtgcttaataagtgcttgtggaatgctaaaagattatttaacctctttcctagaaacgaagacccagattcataggagcttaa

SEQ ID NO: 217605 - DNA, 425 bp, Homo sapiens
gaattatcgttgtgctaagtactaataataatggagctgaatttattgaactcctatgcacatttaagcttatactaacgctgaagggtagttattcatattcccattttgcagatgagaaaactgaactcagagaaattaaatagtatattaaagccatggagcttgtaaaggcatgactaaaattcgaatttagttttaattccaagcttaggatgcagacttcagttatttgggatgatgaaaaggcaagagggaaattcaaatcattttttatgccagttagacctaagtatatgaccagtggtttagtggtaggtccaggttttacggtgtctaaagtatataaaaatttaagaaatttaggggcttatgcaagtgaggggtccactgaccttcctgataaattcatcttggagttggtt

SEQ ID NO: 217606 - DNA, 494 bp, Homo sapiens
tggaagagagaccagagttctttatctccaccgtgtaaggccacagcaagaaggaggccgtctccaagccaggaagagagccctcccagggaactcactcagctggcaccttgatcctgcacttccccacctccagaactgtgagagataaatgtctgttgtttaagccacccagtccatggtgttttgttatagtagcccagcctaagacagcctcctaccctgtttctctgcctcctgcctcatccttcatgtggaatactagtttctttcacatcacttatcactgattgtagtaatacgtttgttgtgtttatttgcttggtgtttatcttcataatcagatgacaggctccatgaagccacacttgtttggttcaccactctgtacccagggctgcacaccatgtccaacacataacaagtgcttcgtaatgttttttgacaaaatgaaatgctgactacaataaaagtctccagccaggtcaaaaaaa

SEQ ID NO: 217607 - DNA, 373 bp, Homo sapiens
ttcactgctgtctccctagcacttagaacatagtacgtgctcaataaatgaatgagtgcctgactgaatgaatgaggatacatagatgagattcctccaatctcacagccggttcagagtaggcactcaatgagtgactgacaggatagttgctgttttgaaagcgcccaagtccagtaagccaattggaagctaagcgtggcgctggtatagtaggggcagggggcgtgcctgacccaaggttgggtcctggagcatgcgcagtcttcacagaaggtgacggggagaaaaatgcggaggcagcgattgcgtaggagcaggttctgattggctactgttcgcgcgcgaggggccgtgcctattcgtagccaag

SEQ ID NO: 217608 - DNA, 259 bp, Homo sapiens
ttaggtgatccgcccgccacagcctcccaaagtgctagtattacaggcatcagccaccgtgcccagcctaatcttacttttaaagtaatcatttattgcttttctttacagtttaccacttggatgtgcatccatatgtaccatatacaaccatagagtttagtgttgtgtgtctggaaactttacagaatgaggtcatactttatatattcttttgtcttgtttctttcacttgttatctatgatgttgaatgtagat

SEQ ID NO: 217609 - DNA, 523 bp, Homo sapiens
ttctcctttctttctcgttaaataaaccctctccttaaaggattctaatttatttctatgactttaaataccctctttgatgccaatatactaaaaaaaaaatcgtatctccagccttgattgctatactgagctcccgttcgtatgtccagccatctactggtttcatcctcacttggatatttgaaaagcatctcaaactcaacatagccagagcagaactcttgattcctcggctccctctgccaccttcctttttctgcttctgtttttcccacctcaataattacccccagtcaagtgctcagtacaaaaatctagtcattactcttaattttttttctgtcacttacccccatcaccactgaattcattagcaagtcctattaacattttctttaaaatatgtctaaagtctgtttcccctgctttctttgccaccagtatagtctaacgtaacatcatatcttgcctgagcaatcatagtagtctcccttctgtccttcctcctcctccttccttt

SEQ ID NO: 217610 - DNA, 398 bp, Homo sapiens
catcacagccactaacaacaccaccatggaccacttgggacccagaagttatttctaccattattactgccattgccttcacttgcctactgcccaggggcctgaaaacccaccaaactgcctggcccacggctgaactactgaaatctgagcgagccacctggaggcccaaaaatcagcctgcctgaattcactaataccagtgccaacatacgccaccctggggcctaaggagaagcagacttgtccccctgctgctacttctggagcccaaggacaggcccacctgtgtcccatctgcagcataacttcaccacaacctccactaacaaccacaccttaagccactgaggaagtcacagacaggactggtgcagataacaaccaaaggaatgata

SEQ ID NO: 217611 - DNA, 898 bp, Homo sapiens
gcactaaccaaaacccaaaggggcttgcaagcttggtctataccagtggtttttaaccagaggtgatttttgccactcaggggacatttggcaattactattgatattttgaggtctcacaattggtggtgtgctactggcacaagacagccccctccccaacatctagaaatcatttggctcaaagtgtcaataatgctgaggttgagaaaccctactctatagtaacagagtttgtggctacactcccacatcataacccttggttatggtattgataaggtatttattggattccagtgtcaccacttttatttaattctattcatccagatagggctcagatattttgatctaagggatctctagtaaatacaatgcccttccaggctgattttacaagtggctggaaagagtaaaataacacatttcagactcattgtcaacctcccttgaaataatctaaactcatgagggcactgatctgagatatttaactagaaatcactccattcattagacatgttttatagctacatgaattaattgacacttcattggaagagcagcaccaccaccttcagtgaccaggttggggtgtgggtatatgtgtgagaaaatgagatagatggacaaagcacaagccccagattggcatataggactttgacacctaaggaccaaatcaatatgccggggggtggggaggtaaggaaagatgtattgctaacataggatgagataagtgggttacaaagttctccaaagattgccatggcaaccaggtatagaacaaaacatttccatgaaaatccagcaaagcaaggacatgctaccccctaaaaggagaaaataaatgttgaggtaataaatacccattgacaaaggacaaaggaaa

SEQ ID NO: 217612 - DNA, 1045 bp, Homo sapiens
actcaggcactgactgtgacgacgcgggtggggagagactgtgcacctacacgtgtcacttcacaaaggcctccaggggcttatgatcaggcaaaggagacaccaggaaagaggagcagagtggctagggcagtgcactgcagatgcatggacgaaagctcgcagcgacacaggcatggggtgtctaatcagggatgagtgtgagcagcagaatgaggagcatgctttcccagaggaagagaggaagccactggagagatgaaggatgccatggacaggaggtggtgtctctggagccgccgagcagcagcctcattgctcagaagatgaagatgctgacgaagacccagacaggaaaaaaggaagaaaaagcatcctgattgttccattagcaaagccacagtcccggagagcaaggggaggggcacagcaggcagccgcacccatgggatgcatctgcagcttgtgagcaatgcatgaaagatgaatcacacagcagcatgcttcagcttccgtgtgctatggctcactcagcaccagctctgcaggctgcctaagccagaagtcagtctctgcctttagacttgctcacttcttttaggaacggagatatcctctgatcccttgtcctacaacctcgattaatatctttccaacagccatctgccaaactcaagaagaccctggaacaacctaattggaaaagtttccatcttatcccttggaaaactatagaaaagtagtgtcacacaaatgtttaatttctgatttctacaatttcagataccagagtttatctgttaccatgacaactaacagctttataaatgttttctagcctctgctattttctggaacttatctacatttcagtatttgcttaataattttgagctgacactagcaacataattgtgtctggattgtgtatgtgtatgtcttgtgtgtgttggcagggggtgggtataacctatgtcagtgtttttcaatgtgagcaaattttaataaacttttatatttaatgtgaacattaactgtcacattc

SEQ ID NO: 217613 - DNA, 822 bp, Homo sapiens
  misc_feature (42)..(42): n is a, c, g, or t
  misc_feature (65)..(65): n is a, c, g, or t
gtttattgtatggtgttcggtgctcctgttttcttaaaaaanaaaatacttttcaggagacgagnctctggcttcgccgagcagcagcctcattgctcagaagatgaagatgctgacgaagacccagacaggaaaaaaggaagaaaaagcatcctgattgttccattagcaaagccacagtcccggagagcaaggggaggggcacagcaggcagccgcacccatgggatgcatctgcagcttgtgagcaatgcatgaaagatgaatcacacagcagcatgcttcagcttccgtgtgctatggctcactcagcaccagctctgcaggctgcctaagccagaagtcagtctctgcctttagacttgctcacttcttttaggaacggagatatcctctgatcccttgtcctacaacctcgattaatatctttccaacagccatctgccaaactcaagaagaccctggaacaacctaattggaaaagtttccatcttatcccttggaaaactatagaaaagtagtgtcacacaaatgtttaatttctgatttctacaatttcagataccagagtttatctgttaccatgacaactaacagctttataaatgttttctagcctctgctattttctggaacttatctacatttcagtatttgcttaataattttgagctgacactagcaacataattgtgtctggattgtgtatgtgtatgtcttgtgtgtgttggcagggggtgggtataacctatgtcagtgtttttcaatgtgagcaaattttaataaacttttatatttaatgtgaacattaactgtcacattc

SEQ ID NO: 217614 - DNA, 1613 bp, Homo sapiens
actcaggcactgactgtgacgacgcgggtggggagagactgtgcacctacacgtgtcacttcacaaaggcctccagattccaacaagttgacaaacggtgcaaatgtcagagattaaaatatctccttcattgctgataaggctgagttggcgaattcttcttggatccaatacaaaaatgagattgtttccatttctcacctgaattaaacttacagggcagaggtgacctgcttagtgagcaggccacgttcagcaatagcagatcaaagacccgtatgtcttgtgatcttcatgaagtggctggcaaggccagagattctgatcccatcaccacgtgttaatctcctgtcaagagaaataaggagctactgagagaaaagcagatcctgactcccctctacttgtgagtgactacaaaatcctattttgtggcgtgaggcaggagcctagagagattggagaaaaaagctgctcctctagaatatgaaaataccgtttaaagggaaagagattaattagtgattgagcgcattcagtgctgtctctcctcctatttatctggctgcctgttgtctgcatggcctcctgctactcattgtgggtaacatcggagaccttcatctgcaggaagatagaaaaaggggcttatgatcaggcaaaggagacaccaggaaagaggagcagagtggctagggcagtgcactgcagatgcatggacgaaagctcgcagcgacacaggcatggggtgtctaatcagggatgagtgtgagcagcagaatgaggagcatgctttcccagaggaagagaggaagccactggagagatgaaggatgccatggacaggaggtggtgtctctggagccgccgagcagcagcctcattgctcagaagatgaagatgctgacgaagacccagacaggaaaaaaggaagaaaaagcatcctgattgttccattagcaaagccacagtcccggagagcaaggggaggggcacagcaggcagccgcacccatgggatgcatctgcagcttgtgagcaatgcatgaaagatgaatcacacagcagcatgcttcagcttccgtgtgctatggctcactcagcaccagctctgcaggctgcctaagccagaagtcagtctctgcctttagacttgctcacttcttttaggaacggagatatcctctgatcccttgtcctacaacctcgattaatatctttccaacagccatctgccaaactcaagaagaccctggaacaacctaattggaaaagtttccatcttatcccttggaaaactatagaaaagtagtgtcacacaaatgtttaatttctgatttctacaatttcagataccagagtttatctgttaccatgacaactaacagctttataaatgttttctagcctctgctattttctggaacttatctacatttcagtatttgcttaataattttgagctgacactagcaacataattgtgtctggattgtgtatgtgtatgtcttgtgtgtgttggcagggggtgggtataacctatgtcagtgtttttcaatgtgagcaaattttaataaacttttatatttaatgtgaacattaactgtcacattc

SEQ ID NO: 217615 - DNA, 528 bp, Homo sapiens
gaaacaccaaatggcaagtaaaaatcttgagatgaatgtttaaagtgtggggtgtgtatatgtttgtatttttattcaaggtgaaataattaacttttaaaatatttatggctttcttaaattacaggctagagccaacaaatagtttgcctgttccttacatgtccctgatatatctttacaagtaatcatagcactgcttctgacaaggtcagatgcataattcgaacctttcttactccattcccaagctatttaataagcccattttgccagtaaatataggagagaaaaaataatgggccaaaattttcctgttgtttaacctaaatgaatattttcattttcatcttcctttcagaattattttctaatactagtatgaaaacatacataaagttcctaaaattgaataacatattacttagtatttacatacattacacacagcttaaataagtttgtggaaatgattattttaaaaattttagtattttgaaaattcatgtcatctcaaaaatagctttt

SEQ ID NO: 217616 - DNA, 579 bp, Homo sapiens
caggggtcttttccctcaaatgaaccagtattttgtgccatgaatcgtgctgcagatacttgcatacatcatctcattcaatctttccaacaaccttctcaggtacaaatggtactagtcctgttttgcaaattggagtggcctctctgtaaaggctcagaactaggtactaggaataaaaagaaattaaagaccctcgaggggctcaaagcctggacagggatttgcactttatttcagagttgatggtgagtaattgaagcctgtcaagcaggagagtggtgtactccttcatgcttttaaaagtattcagtccatcacttgaacccaggagggggaggttgctgtgagccaagactgcgccactgcactccagcctgggcaacagagtgagactctgtttcaaaaaaaaaaaaaaaaaaagaaaagaaaagaaaaagtttttcagcccagttgaccacaggggctcatgtctgtaatcccagcattttgaaaacccaagagggtaggatcgtttgaccccaaagtgttgaaaacaccctggtcaacatggcaaacctccatctctttaaaaaatac

SEQ ID NO: 217617 - DNA, 840 bp, Homo sapiens
caggggtcttttccctcaaatgaaccagtattttgtgccatgaatcgtgctgcagatacttgcatacatcatctcattcaatctttccaacaaccttctcaggtacaaatggtactagtcctgttttgcaaattggagtggcctctctgtaaaggctcagaactaggtactaggaataaaaagaaattaaagaccctcgaggggctcaaagcctggacagggagataggctgttaagcccatttaaaacctgggtgtgttgagtgctaggctggagacatgcatacaagaaggctggtctgtgggggtagataatgcctctgttgactcttaggatgaattagaggcacaagggtgagagcctggtgtgttcggcaaacaataatcagtgaggggttgacagcgagggagtgattggtaagaggtgaatgtggagggtggaccagagtcagatgctaaaaggccttttccactgtgcccagggatttgcactttatttcagagttgatggtgagtaattgaagcctgtcaagcaggagagtggtgtactccttcatgcttttaaaagtattcagtccatcacttgaacccaggagggggaggttgctgtgagccaagactgcgccactgcactccagcctgggcaacagagtgagactctgtttcaaaaaaaaaaaaaaaaaaagaaaagaaaagaaaaagtttttcagcccagttgaccacaggggctcatgtctgtaatcccagcattttgaaaacccaagagggtaggatcgtttgaccccaaagtgttgaaaacaccctggtcaacatggcaaacctccatctctttaaaaaatac

SEQ ID NO: 217618 - DNA, 385 bp, Homo sapiens
gcagaggcaggtggatcacttgagcccaggagatcaagaccagcctgggcagcatggagactccttaatctaaaatggccatgtctgtcccaacttcctacaatttcagctccctttcattgttcacttcatcactctctaaaattactttcattcatttattctttgttgactgattgatgattggttgattttatgtctcccttactagaatgtaagtaccttggcagcaggtactttatttgtatcatttactgtggatcaccctcctacaacagtgagctaggctaagtaaatatttatcaaatgaaaaaaaaagattggcattgaaaagaaagaaaagtaaatccacgtatgaaaaggtgccgattttttttattcagta

SEQ ID NO: 217619 - DNA, 331 bp, Homo sapiens
tggccaggggggacagagtttcactctctcacacaggctggagtgcaatggcataatctcggtgtactgcaacctccacctccagggttcaaatgattctcatgcctctgcctcccaagtagctgggattacaggtgcacgccaccacacctggctaatttttgtatttttagtagagaaggggtttcaccatgttgcccaggctggttgtgggagtccaccctcctcagactcccaaagtgctgggatgacaggtgtgagccaccgcacctagcccctttaacatttttagagtgtcaccttaggttctgtgaaaaatccagcacaccac

SEQ ID NO: 217620 - DNA, 329 bp, Homo sapiens
cagggagagatgttggttgccattgtcccaaatgtgctacatgaatattagcactttctacatgtgccagggcttggaaaaggttggaaattaccccaggaacaggttataaagagtgaagaaggcactactcctatctactggaaaaaggatttttattatttggttagctttgtgttttaaaaaaatgatgagtatgatatcattcatctgttataaaattcaggtaacttttactggtgaacttgttagttctcactttagctttagcttagccatgcctttatgatacaattgaatttataaatagcattcttatgttaacataa

SEQ ID NO: 217621 - DNA, 437 bp, Homo sapiens
ctggtctcaaactactgacctcaggtgatccgcccacctcggcctcccaaagtgctgggattataggtgtgagccactgtgcccagccaagtgttcagttttgatagtggagctcagaagagagggttcaaaatgagatataaatttgggagtcatagtatacagatggcatctgaagttacatgaatggttgtgattaatcgaggagagaagacagagagtactcaggactgaaccctaggtaatgacatttagagataaggtagagaaggaacagctagagggatggggaaaaaagccaaaaacaaaaatgaatgttccaagaggagttgtgcttcaggaaagaggtctaagtcaacatgtgaaatgctgccaagaagccaagcaaaatgaggacagaaaaacaaacacagggtttggccccatggcctagctgt

SEQ ID NO: 217622 - DNA, 559 bp, Homo sapiens
aaatgaaactgatgcaggagcatttcgatttactctaattatactgtgaatgctgtgcctaatgcaacaatgcctttgcatttaaaaaattgtctttaaaggtctccctccaaattgtaataggcttatatttctcccattctagctgcctgtaatatacataaaaatgagaattacaaagaattctcaactcatggatattataaaatatagatgacagaaacttggccctgaatgctcccacaagaacagtttgcagcaatcacactacaaagagttgtaaggatagcactttgatcaatctgcttcattcatctctatgcgcttgaaagaaatgtcttggaaagggctaagagccagcgttcctgaacctccgaatacaggcttgttcttgcaccagatatcgtgcctaccgcagtgcagagctcgctaagccttcaggaagcttttgtttcagaccacagtggtgtgcactcctctaaagcatatgctgcagtacatgactgagccttctgtcagctgatgaactgcatctgactcctggtgtttaaagggtctg

SEQ ID NO: 217623 - DNA, 451 bp, Homo sapiens
gtaagggagagagggaaggaaatgagaaacatgatcatcagggaaaggaagacgtacgacaaatcctgcacagctagtgccaggatgctaaagtattgtgatgagggaaatggtgcagaccaggcttctaaagtgaagttgttaatgaaatgaaaggtagacaatacgcagaagcagcctgtcatatatgctaaactgtctgttttctggagaatccaaaagcattggaaactgttttctctgatatccctagttggtttactcaaggataaaatgcccagacttccttcctaacagcaggctaattgatttaaccaaagaatgtgcaaacaagatatactgttcctaaattatgcagtttttccttccttctctatacagtctatttttgcttttgttggacaacatcccactgatcgatcgatctctgaataaaaacactgaaatggac

SEQ ID NO: 217624 - DNA, 445 bp, Homo sapiens
ggcttccaatccaagctctgccaccgacctctttggcttcccatctcctgtcagtggctctactgaaggggccctgagcatgtttagtaggaataaggtaaccaggggctctagcagtgccctgaatgcttttgagagtcagccaacatgttcatttttaagaggtttctaaatatagactctcataagaagtaccttgtacactatttgtgtcctctccaggaatcacgggagtgaatcacattccagacacttgcttggacttcatcacatcctcagtgactgggctggaagaaatatcacagagctctctttttatgggtaaagagaggaaggtggctgggcacagtggctcacatctgcaatcccagcaccttgggaggatagcttgaggctaggagttcgagaccagcctgggcaacatagtgagaccccatctcttaaa

SEQ ID NO: 217625 - DNA, 377 bp, Homo sapiens
tgtctcacacagatggaaactggaggccctggaccccagcctcaccctccatacacacccatctctagtgtgagtaagcatgttatgttaatctgagctgtcttcactacctgtaactagtcatttgggagtgacatcatggtaactgagtaatccttttgaaacttacatagtagagccaagatattaaaatggtcctggggctacctagatgaaagtagatacaaagtgtgcataaaattgtctactaaaagtagagtcagtctctatcagtaggaacttggtttttgtgataatgtggtacattttgtaactagatagatctcaaaagttcatacattgtagttctggtactgtccttatttccaggcagatag

SEQ ID NO: 217626 - DNA, 424 bp, Homo sapiens
ccacttttgcacaaatattttatttctaaagtatgtctgggctctggactagggtgaatgaagttcagatcccagccctactatttcctggctgtagaatcttggtcacttactatttgttccaaacctttttgtcatcgtctgtaaaatgagaatggtaatattagcgtgcactgtttgtgggaggaggactggcaaaaatatgagagtaggagtttgggctcttgagcttgggcctggccttcaaatttccactctttcactcactagctaaggggccttgggcaagtaccttatcatgactgtgcctgtttcctcaaagagagtcatggtagtagtagtactcaaccgataggactgaagtgactattgcatgagtcagtattggcaaagaattcagaatagttcctggcatacagcactg

SEQ ID NO: 217627 - DNA, 175 bp, Homo sapiens
gagatggagccttgctctatcacccaggctggagttcaatggtgcaatttcggctcactgcaacctcctcctcctgggttcaagcagttctcctgcctcagcccaattagttttaaagacgctgcatatattggcagggaaaacctagaacacaaagtcaaacttccaattatct

SEQ ID NO: 217628 - DNA, 158 bp, Homo sapiens
gaattatctcattcactgaacaatggcaacgggctcctttgtgtgaattgaacacgctttgtttagcgggtccctggtcatttgggttgttttcttctttctagtgaggagattcctttcatgaaccttgtggtctggagtaaaagaagagacctaca

SEQ ID NO: 217629 - DNA, 125 bp, Homo sapiens
ggctgcctctgttaaaatgacatgatattcatcagagaagggtttagaaattaacagccacagttaattttcatcttttgggaggtttcaggcctataaatgagaatttgacctagagtctcttg

SEQ ID NO: 217630 - DNA, 469 bp, Homo sapiens
gatcatcttcgaggcctgctgtggtggtgagtgctgatgtccttgagaacaccagacattctaatgctgtcctcatctgtatggatccagggtttttcagtttatgtctgtttattaatgtcaaagaaaacgtagtgtcatcactcaacatgtggcttctgtgaattgtatgactggttggtagatatttgtttcattttcaatcctgagactttgatgtttggttgtttttaaaatttgtttgagtgttagaagaaataagaattgttgaaaagattgttacttgaatgaatgtgtgcatgtgtacgtgaattaatgatacagcaaatatattgataaatatgattgaacagaggctaagaggagaacgttgtcctctcagccactggtagtagtaacaaaccaaattttgtctttccagagaaccatggtgtggtgttggtaaaagattcattatgagtctctgaaa

SEQ ID NO: 217631 - DNA, 627 bp, Homo sapiens
ctttttggttagagcgtgctctgaatgcaggaccttggtctgtgttcacagtaatgaagcggatctcagagtggccaacagtggcccatgaggcagccgaacacctgcagatccaggctctctctaattcctaactatgaggactgtttctaatgtatttgtttcttcattttttccatcccccaaatagaaatatcttgtcaaaaatgatttttaaaacagtatatatgcaccctataaacaattagaataatgcaaaagtatgtgaactaaaaagactgtctgctcctgtctactctctgtttcagtattcttacataaaaatgatacatcctggctgggtgcagtggctcacgcctgtaatccgaaatttgggaggccgaggtgggcggatcacttgaggtcaggagttcaagaccagcccagccaacatggtgaaaccccgtctctactaaaaatgcaaaaattagccaggcgtgttggtgggtgcctataatcccagctactcaggaggatgaggcaggagaattacttaaacccggggcgtggaggttgcagtgagccgagatcgcgccactgcactccagcctgggcaacagagtgaaactctgtctaaaaaaaaaaaaa

SEQ ID NO: 217632 - DNA, 296 bp, Homo sapiens
ttgcttagaagttggtagctaccaccaggtagccatatagacctatatcctggaggaaaaggttagctttagtgccttaaagatcatttattttccccaaagactttaatgtacctccattatctgagagaaaaaaaagcaagttaaatcgtcaagcaacaggcttttggtctatggcgaggtttgagtttcctcaaatatagtattagcaattgcaattgaacttgaaggtcaatcattgcatacattacatacagttgattacattacatatagttaagttaaatcttccttat

SEQ ID NO: 217633 - DNA, 493 bp, Homo sapiens
cccataattcatgaaagtttgcaaaaccatcagtgttaagtctgcattagtgtatgagagggaagagctggctaggattgattggtagacacttccactaggggtctgagtaaagtggtttcatatccgtaatgggctgatgagcaatttattgcctgcaaaaaacggagaaaatgaaatttttggttacgtaaaaacatgctgattatttttcagttgtataaatttgtgattattgtattatattagaaaatataaatgagaaaataaatacctgtaatgctttctgttaagattttggtatatctctttacagatctttaaaaatattacatatacatgtttttagatgtatgtgtgtgtattatatgcatacgtaaacaaataatgtatatagaaatattcctacacatgtgtatgtatatgtatatttagatgtcctttttaaaaatttttttgtatttaaagagatagggttttcctctgtcactca

SEQ ID NO: 217634 - DNA, 460 bp, Homo sapiens
gtgttctttcctcctctatttctattacgtagaattggtgttaattcttctttagacatttggtagaattctctagtgaaactatctgggcctggagatttcctttcctagggagtgggagaagttttacattatgaatttaatttccttaatagttacagagctatttaaattatatattttatattgtgttcattgtggtatttgtgttttttgatttggtccattttgtctaagctgtcaatttacgtgtatagatccatggtattcccttatccttttgatgtttgtagtgatatgttgtttcattcctgatattggtaatttgtatctttttgtttttcatcagttttgctagtggcctgccaattttaataatttttttccaaagaaacagttacttgttttattgattttgttcattgatttttaaaaaataaatctcattgatttcctgttc

SEQ ID NO: 217635 - DNA, 350 bp, Homo sapiens
attttttttgaatagctactctgagtgacatattgtgctgggtgttgtggccacatggatgaatggagttggccttgttaactattaaacacaaaagcatgtgatagttacctgagagatccatgcaggggagagtccaggggaaggtgactgatcactgcttcccagggggaggcagaaaatgcttcctggaggagatgatgggtggattaaggaagatgagttgagcaggagttgtagctaccagccagggaggaagggtattcagagcagaggaagcaaggtgagcaaaggcaccaagatgtgacactactggactgccaagctattcagtgtggcagagtagggca

SEQ ID NO: 217636 - DNA, 190 bp, Homo sapiens
gtgaggaagaaagcaaggtcagcattagctttgcattttcttcccaggttgttgttccttgaatggagtcagagttgggtcagggtcaaaaatactgactactactgctactactacttcttcttctttagctaaaatattgtagtagaatctacatatttttgataaaaaccccttctgtcgtcttctc

SEQ ID NO: 217637 - DNA, 478 bp, Homo sapiens
acagcattaaaaaattggtttatcaaattacattttgactattagagaaactgaaattgtaaaaattaaagctgaaaagcaaaggaacaaaaaggtaaaatggcctacgagcgttgcactctactagattctcttacataagagagttgccagctttaatggaagccttagtcctctcctcacccacaccaccgacacccagtgtagagaaagtacgtcacccacacttatttaaaccatgcttcctgccttttgcttcaaaccatccattgtcagatctctctggtctgtctgctggcttcatccctgtagaatccctgtgagacgattcatttgccccaaatgaccctcttctgacttagcaacgcctaactgtctgcatggtgccacctatcactgcccctatggggagtgtggtggtctggtctcagacacagtccatgatgttgaatatcacacccaaatccagccttcagaa

SEQ ID NO: 217638 - DNA, 392 bp, Homo sapiens
ccacaggcagaaagattacaaactctgcaataaatataaaggtattggttttataaggtggcctgcaggctacggaccagcacagagctctggcaaatgtggaatgccaggagatgtacaaaaaaatcaaggtgacaaaagaagaaaagacactccaaactgccaagggtttataatcatgctgtggatatttctgatcatcagtgtgttaatggttttcactatagttaaaactataccatttttgaatgggtaataggtatgaatatttatgcttaattagtagtttataaaatttatactatttattttcataatgttgattttatgattttcaacgagtgccatttgtccttaagtcatgaagtggatgagcccccatcaagtgattt

SEQ ID NO: 217639 - DNA, 262 bp, Homo sapiens
aagtagtcttttacgttctgttctctcccagaagttgacagtgcccaagattcattttccttgatctcagtgtcacagattaataatgtctcccatgaatgctctctaattctattttccaagagacagttggagacagaacttcatgattttcattttattcctgacagaataataataaataccatattttaccttattagaattgaagaaatcatttattacatttgtgatttaatgtaaaatagcgagactgatttag

SEQ ID NO: 217640 - DNA, 204 bp, Homo sapiens
cttccctctcttccattcactcttccctgctgcctctggcagacccactctgtactcctcttgcttgtcactgccactaccacgaccaccagttgtctctctgtcagcagatgtgccgtgttgcctctctgcacagtaccatccctgcattccacagaagacttgggcaagggtgcctgagaggtacccagagacaaatcacgt

SEQ ID NO: 217641 - DNA, 1059 bp, Homo sapiens
gcccgcagcaaggctccgcggcgctaggcccgagaaaccgaaactcccctagtcgcccctgccccccagcactcgcgccattgcctccagccccgagccaccattgtttccagtgccaaatcgggcagccccgctagcctccgaggccgaaccgccaggggccccataagccccgaggaggctcgtcgggaaccgcttccttatcctctcggtatgcgcatcgccaccaccctcgctgcagaggccgccgccctcccagcgcgccatcaccgcctcctctgcctcttcccctccctcagccccggcccctgcattgacttggctcgggctgcgcctcactgcgcctgccaactgtcacacgctctgaggctttcaacagcggggcgccagggacaaacaagccgcggcaagcgcaaacagcctgctcaaacagggacggccagggtgttgtttgaccagcactggaattggaaactaggtttcgaagaagtcaaatcgaagtacaatattgtattttaaactgcctgttgttattacatccctcacaacgcacgctctacttgaaacttccagtggataccaactgcacttagaataaaaaatgaaactccttgcctaactctgggacctcatcagcacatactcaccatattttggtaacaaaggccttcatgctgttcccggaagtcgccaagttccatccatcattgttaataattccttttgctcgctcctcgcacaagaactgtttcttctgcttagtgctttgcctactgattccatcttgtcatttaagtctcggctcaaatgtcacctctgcaaagaacccttgtctgaccatacatctaaaatagccacaaacactctataaagacttggccttgctttatttccttctcagcactcatcactgtctgaaacaatgttttggatttgttgcttattatcagtctcccttctcaagaatgcaagctttgtgagggcagagtcgtaatcttttttaaggctgtatccccaatgcctgggtaagtatacaataaataatttttgcatgaaaaa

SEQ ID NO: 217642 - DNA, 501 bp, Homo sapiens
agcactttgggaggctaaggcaggtgaaactcttgagctcagcagtttgagaccagcctgggcaacatagtgagaccctgtctcaagacaaaaacaataacaacaataaaaaaacacacagtatcggtgaatcacagtaaaatgagatatgcctgtactttatatattcatttaattctcagattctcatgttttagttgagaaaaccaaaggatggagaggtttcagtaacttgggcaaattcatagctaatacatggaagagacgcttactcagtatgattctaatcaaaatatgggctgtttgtacataagcattcctgaagtagctaaagcaatctcttccccacccatcttttcctatagaaatctcacctgtttttcttttcttttttttaatttgatatggagtttcgctcttgttgcccaggctggagttgcagtgagctgaggtcatgccactgcactcctgcctggcgacagagcaagactctgtctcaaa

SEQ ID NO: 217643 - DNA, 1090 bp, Homo sapiens
gtactgacaaatcccagaatgttctttcagcactgaaagggttaaatataaaaccacaatggaagtgacagtgtgaggggctagcttggccaggacagcagaaagccaagaaagaagtcattgtagcagatgaaactcttcaggaaactgctggatagagagggtggccacaaaacctgttttacacctgttgcctacaattatcataagcatcattttttattctcagagtccattttgacagcaaattatatggtcacactgtggatagagaaacccaagactttagagcaggagtcatttaaaggagtaatggtagtgtgtgactgtgtacatagttcaaagtcattcttagtttgtataaaccagaaaatgaagctgagaccatattgctgggaagaacaaagctcactacattatcttgtgactaccaaagaaaaagagctaagattccattagcttgaatccacataaagcttaaagccaaattcgggctaattaaagtcaggctctgggaaaacaaaagcataaaagcagtaatcatgtctgagtaagatgaagtaacctgtgggtatgaagaaaacaaagaccaacaacagccagaaggaaggcagaaaaagcactttgggaggataggagtagatacaggcatcatatcaagttgcctggatgagtgttgtcatccagtttctccattttgaggtttgggtgtgtgggattgaagttggggccatcagctgttgtttgtctgaatttaaatgttctttggtcctggaaacgttcatgtggtctaactcttcttttcacgtcatcatttgagatgtgttctatttcattgattcatttatttagcaactttaattcaacattaactatgtgccaggctttgtgtctacgagaaggtgattcacaatgaaaagactgagctctttctctcaggaaatggctgtgtactggaatagatatacacagacaaaaaccaagactttaaaaataaagctgttggaggaaagctaccaatagcttccaagaggagatctcaggtcttcagaggacattccttcctcagagaagtctttagtcattcagt

SEQ ID NO: 217644 - DNA, 256 bp, Homo sapiens
gattgcatattatgtgtgataaaatgcaaaataacttgtcagatgaattaagatattcagaccagaaagtcataagaaagagaaaacgttgagtttcctttacttgtaccccttatgcttctgtcttcttccctcaacaatgaatgctttccttcaaaaatggattttcccattccactgtgtggtcacacatgcatgagcagtgtcaatattccagagcactagagtttgcaggcataaatgttgatgtttgcac

SEQ ID NO: 217645 - DNA, 213 bp, Homo sapiens
caggtgatggcttttctgctgcacccctttttgagttgctgaatggcctgggaccccccccccccccacaccatggtcttctgcccctctgtgctgccaggatctgctgggagacagggtcacagtcgagggggatatgcatttggtctgcacagtgccgtggcaggtgagacaagtcaggatgaagcctgggataaccccttctagctgctc

SEQ ID NO: 217646 - DNA, 708 bp, Homo sapiens
cgtggtggctcacgcctgtaatcccagcactttgggaggccgaggcaggtggataacaaggtcaggagatcgagaccatcatggctaacacggtgaaaccccgtctctactaaaaatacaaaaaataaacaaaaattagccaagcatggtggtgcacgcctgtaatcccagctactcgggaggctgaggcaggagaattgcttgaacccaggaggcagagtgaaccgagatggtgctactgcactccagtctgggtgacagagcaagggtccagctcaaaaaataactcagttcatagaaaaaagatttcgtgttatcaacttcgtgcatctgaacggtcaattttgattaaccacagtttgtaagttccttaattgttctttatacagcaagctttatttcagaaaggaacagcagactcccaggggagaaattctttggaggataatatattcataacaaaaataaagtttttagatcaaattaagctcaagaccatatctaatacttgatgaagaatttcttcctcctttccctagagtattgtcaattatttttaaatgatctcatttttataaagtctttgaattaaaatggaaaacataattaatgcttttggagagaggaatgagaagatggataccacagaatatgacaattccaaaaaaggtatgactctctggactggataacaaatctgggacaatg

SEQ ID NO: 217647 - DNA, 887 bp, Homo sapiens
cgtggtggctcacgcctgtaatcccagcactttgggaggccgaggcaggtggataacaaggtcaggagatcgagaccatcatggctaacacggtgaaaccccgtctctactaaaaatacaaaaaataagccgggcgtggtggcgggcgcctgtagtcccagctactcgggaggctgaggcaggagaatggcgtgaacccgggaggcagagcttgcagtgagccgagatcacaccactgcagtccagactgggcgacagagcgagactccgtctcaaaaaaataaaaacaaaacaaaacaaaaaaaacacaaaaattagccaagcatggtggtgcacgcctgtaatcccagctactcgggaggctgaggcaggagaattgcttgaacccaggaggcagagtgaaccgagatggtgctactgcactccagtctgggtgacagagcaagggtccagctcaaaaaataactcagttcatagaaaaaagatttcgtgttatcaacttcgtgcatctgaacggtcaattttgattaaccacagtttgtaagttccttaattgttctttatacagcaagctttatttcagaaaggaacagcagactcccaggggagaaattctttggaggataatatattcataacaaaaataaagtttttagatcaaattaagctcaagaccatatctaatacttgatgaagaatttcttcctcctttccctagagtattgtcaattatttttaaatgatctcatttttataaagtctttgaattaaaatggaaaacataattaatgcttttggagagaggaatgagaagatggataccacagaatatgacaattccaaaaaaggtatgactctctggactggataacaaatctgggacaatg

SEQ ID NO: 217648 - DNA, 419 bp, Homo sapiens
ctccctgcaacattaggaatgcagatttaagcccatgcagaaaggaagtaaaggtttatcctcagacatatgaactcctctgcacagactgccctctggggtggaagctgccatccaaagcctggcaaatctgaagtccaccacactgaacattccacagaggtgagttattattggaatgagaatatttatgctcactccctctatgatttgatctttgcattttaagacttaatattgcagtaaggtagcttttggcttttaattgccccgaaattttgttaacattaaatgaaaggacaaaatggaaaggaaaatagaaccatatctgtatcacttttgagttgcataatttacatttttgccacttcattagttttcagctattccagcctgtaaatgtctcccccaccaccact

SEQ ID NO: 217649 - DNA, 600 bp, Homo sapiens
aatggttgaaaaaagtaaataagaatcacattggccgggtgaggtggctcacgcctgtaatcccagcctggctgatagtagcagtttctgaatcttgtctggggcccaaatctggctgaagagagaccctctgatcctctcccccttcactcagtgaatgaggtcacaaagagccaccacctggaaggcagctgtgaggtcacccacacccagtttggcatctctgagctgtgtgctgttggtaaggtaacctagcctctcggagctctctgtaagaaggcattccaatatccactcaacatgcagaaaactcctggcatgactttgtattattattatttgagccaagattttaaatcaggagatttcatacaaacaactgaattctgcagcttctcaagaacaatctagaaatctgctggcatggagcctgcattcccacctggcaggattggctgaaactgaataattgccttttttttttttttttttaaaggaaaaagggggttcacccggttaaaggggcgggtctcgtaatcctgaactcaggtgatccacctgccttggcctcccaaggtgcgggattgccatttgtgcccc

SEQ ID NO: 217650 - DNA, 703 bp, Homo sapiens
tactgggggttaggacttcaacatatgaattcaacaggggagacacaattccacccacttaaaatgaaacaggcctacagaggttatgctaactttttgaagtggaatagctagggccctcaggttcacgtggtaaccaggtagttctgaggtgggaggtgagggaggtagtgcaggtccccaagagccacggggatgctgcagtgaactggactgtgtgcagtcactcccataagttgtccagacatgaggtaacagagtgagctctggaattagtcaaatctgccactcactagctgcctgatcttaggaatgtttttcaagccctcagagcccccattgcttcatctgtaaaatgggataatagcacccacctcatgaagttgtggagattaaaggacataggacagtagttgagaaatgtagtgattatcaaaatggacacccatcctcttatcccaaccacacaaaagagagctttagtccacatccaaatttcctacacctaggcccattttaattaatttaatttatgtaactaagtgcaacccttgtccagaaacatcattcaagtggggatcatggtagggggtggtaaaagggtcagaaaggggagatgcaaaggagagctagagaaaaggataactccagttctctgcctgtcagtgtgtctcaaggtgggcattattggtatttggagctg

SEQ ID NO: 217651 - DNA, 230 bp, Homo sapiens
ggtactcatgtaaaacttgaggtagttggattagttgatgtctcatattcttttagcactagttgcccctgtttccaagctgtatattaaatggtcctcatatgcatgataggtatatatatgcttaatatatattaaaaagacaacacatgtttgatgaatgaatgaatgcatgattgaataaatgaaagtgatactgttccatatgtctgtaattcctttaccttact

SEQ ID NO: 217652 - DNA, 337 bp, Homo sapiens
gaagggaacagggcagattcagagactgcagcaccagtgtctgagtgtaagttacactgtatgttattatctcacctaaaacagctcctacaaatctcatagaaacctgtggctcaccaccctatgggctggaagtagagcttccaatattccggaaatgaggtttatcctcctcccgcgttcatgctgacaatccttttttctcttttgggaaaaaagtgggttcgctgggcgcggtggctcacgcctgtaatcccagcactttgggaggccgaggtgggtggatcacctgaggtcgggagttcgagaccagcctgatgaaaccccatgtctacta

SEQ ID NO: 217653 - DNA, 500 bp, Homo sapiens
aaataaaaggtaaggattaaaaaattggtatggagtggaaatggaaagccttgctttttgaaacatttggactcaagatccatcttccagccttccaaaatgttaagggctcctgtttgcaccttctcagaatgatgtgcttgctttcttcagaaagacaagtgttatttactactgtttacagcttttgtgatactgaatcccaggactcccacggacgtgtgctctgacttcttacgcagtgttctttcttaagccacagcaaaggaaataatggacattgagaggtcaagtgtgtgcctttcaccctgtgccctttaaatatcaataattattgtttttcttcctgaagaagcagcatctggttgtatggaatttggcagaagtgggcatcctgtgctagttcttttgatatttaaatatgagcaagataggtaaatggcaactaaatctgagccatctgaggaggaatgagagtaataaaaacaacgaaactgaaa

SEQ ID NO: 217654 - DNA, 581 bp, Homo sapiens
aggaaatctacttaaattgtctgtggttgggaaaagaaactagtggaaggaatatgttacaaaagcatctttcttaaaatgtattcaacatatttttctctacaatttaagagcattagcaaatacaacctaggatgaaactttaacagcctttgagagggacaagaaatgaaattaagggtgatatatgatgccagtatcatcggtgtattgggtctcataatacatacaatacatggtagttagtcatagggagaaaacaaacctggtggctgctttctaagaacaaatcagatttcttgtgtagctatgtggtttaactgttcttgcccttcttttacaaaactaaacaggtttagtatcataagtgctacagaaatagtcaagattgcaataattaggaatctagctcaaactaccttaagtcaaaaaagccaaaaatttattggcccacgtagccaatgagagaaagttgatgtttaaactcagggaaacgggaagaactgcaggaatcagaactcctgtcacttgactagtccctagattaaaacagaaaaacaaataaacaaatgtcacccatc

SEQ ID NO: 217655 - DNA, 576 bp, Homo sapiens
tgatgcaattgggttgtcccagttttcatggtgctgagagggagcagtgggttcaggtggtgtcaacacgatcccttccttataaacttctcccccaaactttcccttaatggttttgtccattgattaggatcatctaaatcacttatttaattccggctagtaagatggtgatttttctaattctatcatttcttccacatttagtggctaaaatttcctgtaaagaactttcctctaccaactaggcttttgtttaccttatccttcatgtctttcctcaagagttaccttggctaggaacagtggctcaggctgaggtgggaggatggcttgaggctggagtttgagactagcctgagcaacatagtgagacccaatctctacaaaaaatttaaaaattacccgggtacagtggcatgtgcctatagttccagctactctagaggctgatgttggaggatcgcttgggtccagcagtttgagcctgcagtgagctgtgattgcactactgcactctagcctggatgacagagtgaggccctgtcttaaaaaaaaaaaaaaaagaattaccaa

SEQ ID NO: 217656 - DNA, 466 bp, Homo sapiens
aaaaattaacacaatgtgtggaaaatataaaattagttagaagatatgtcttagaaattaaacttttagaagagttaatggtaagtggagaatgttaaatttaattttttattacatacttacagctcaacttaagtttttattcagaatcttttattttggtgtgaatgttaaatattcaaaaataatagaatgacacctgtggatttcacatgtgaaataaactttttcatattaatgttaaaatcttgaggaatttctcacacttgtataatgtacttttttattgggtgcagtttacaatttagaggttcagtctttagaggtttcactggtcaactccttggtcattttatctggaaaagttttaaagatcatggcatcttttgagttaaaaaatgtcttcagtgatctgggatgcaaactaatttactctcttcagagtggtttaatcatgtgaaacaca

SEQ ID NO: 217657 - DNA, 908 bp, Homo sapiens
tgcccttaatcctaaccctggttattccggttcattggtcccaaggctgctgaggtgtgcgcagggctggagcacatctgcccgcctgtctgtctctggaggcaggcagagaagggctttgtctgaggacgctgttgttccagcttggagatgtcaccggcctggaggtggggtgtggccaggccgtgccttcgcaagcctatgggggtcactctgagagccgtccttagggatggggccagctctgtgggcaccaccacatggggcatggggtgggcgctgcccatggttacatgggggttggtggcagcatagacgcatggcagcagcggccaccacatgcagaaccccccacggtgtccagggccttcctgagctgcttagtgaatcctgtaccagcctgagaggagcacagtgccctgtcatttgcagaggtgggaatgggcttggtgcaaccaacttgcttgacatccgactcagtctgaccccacagtatgcacctgctctctgcccccattcacttcttgatcccagggccctgtggccacagtctgaggcccagcggctatgggtgcacgggggctgggcggaggaagcagggtcatgtgcctgaccagcgccccctccctctgttgcagcttcacgtggtcggccgcgcggacggaccggaatgtgatctctgtgctgtctggccaggtggtggagatgtttgaccggcagttccaggagctgtacctcacgcgtagctcgtacctcacccgtagctgtactctcacccgtagctgtacactcacaccgatagctgtacctcaacacgtatgctgtacctcaccgagtaagctgtacctcagccgtagctgtgcatcacccgtacctgtcctcgcggggatacctctggagtcgactat

SEQ ID NO: 217658 - DNA, 542 bp, Homo sapiens
tctgttgcccatactggagtacagtggcataatcatagcttactgcagcctcaagctcatggacttaagcaatccttctaccttggcctcccaaattgctagtattataggtgtaagccaccacacccaggctgattttaaaaaatttacattgagttaaaaacactttttttttttgactcatgaaaatgatctctattctaaaatgactcttaacactgtgctatatataattcattgtgcagccgacacaggggaaatagaaatttgagttacagttagagaatttgagctcaagtcttgagtctataaccttaggtgtgtaatcttgcttctatagcctaatccatttgggttcagtttcttcttgtgtgtaacaggaattgctaatcctactcatatgatttctgcgagaattaaataagaaaatacaagtagaagagtcttgtaaaaagcaagggactctaggaaggtaatgttttacaaagttctctaattaatggactcactgagataattgaaggcatttctaatattgtaga

SEQ ID NO: 217659 - DNA, 472 bp, Homo sapiens
gagaaaagagaatacaataaatctatctctaagtataatcttagttttcttccttccttatatagttgaaatactcagatttacctcaaatatgtgtttttgtttttaaaagaaacttgataacaaaagtaggaataaatccagtagttggctaacttactgtgaaaccatcattgttgggaataggaaaagaagagagagatttgcaatcctggcttggttatctttcttgtcattttaatcacagaggcttcctatgaacattcaaaaatttttttcagtttttcttggtatttccagtagctaaaaggagataggtccagaaagtacagagaattagcaaacaaataactggagaatggaagattaccatgctaataaaataatatcttattttaaaatattattattttaaaaaattatttaaatttaaataaaattatttaaaaaataataatattaaaatgatttt

SEQ ID NO: 217660 - DNA, 312 bp, Homo sapiens
gcgtttgaccagctttatttatcaaaaatggtacatatataaatattcttagacatttttgcattttacaaggctgaggattctcgttgtggggttttttgggggccatgggtcctttttgttctcttgggaggaggagggtctcacccccagtcctgtggttgctgcctgggtccgaattcatacagcactttcgtttactcttaaaaaaaataataaaagaaagaaaacaaaagaaaagaagggaaagcagtgtttctagagccgatcacctgattcgttgcgtgagtcggagcctgagcgagcggccgc

SEQ ID NO: 217661 - DNA, 528 bp, Homo sapiens
tgtgtccctcagacacattcctttgatgctaactgggaggcagttaaagtgagtgaaaaaagcttggagttatgcagacctcagttagaattcctgtttccatccctgaatagctctgtgatctacagtaagttaatttccctgagccctgtgttctcacctgaaaagtggagaatcaaatcatatcttaccttgcaagtctgttgtataatatatggacatgtatatagtgtgtagaaaccctttaggacattcttggcagataatagatatccagtacacattggcttatattgctaacttttgacatgctggaactgtgagcagaagcgaacttaggagagaggaatcaggaagccaagatggagaacaaaggtaacattggggacagacgttgaggccatgtatgaagcactcttaagaggagcagtgagagactgtacaagcagctagtgaccagaggtcaaagtacagatgtggccactgactcacagtgctggaatcaaggaaaatatgcaccaggttttc

SEQ ID NO: 217662 - DNA, 475 bp, Homo sapiens
taggtcatgtggattcgctatatggaatatgattgaaggatgattataattacagaaattataggtactaactttccatatttttgggctttatacaaatttctgcaaagttccagagaattgcctttaccaatgaatgtttcctaaaatgtgttgtctattcattatctcttcctttcttctctacatctactattagtaagagttctaatataagagtgctgcaatgatgatatataaatgacaactcaattgaacaaaactattcaataaaatgaatttgcatttaaatatcatattttaagagataaaaaagtttatgataataaaatgggaatgcagtctactacagggaaaataactaggacttagaatctgtaacaaccagagactgaatcctgccaattactttatcagaggctttgggctaattacctcaactttctttcctgaacctcaggttagtcatctgtaa

SEQ ID NO: 217663 - DNA, 448 bp, Homo sapiens
cgtggtggctcacccctataatcacagcactttgggaggccgaggcgggcggatcacgaggtcgggagatcgagaccatcctggctaatacagtgaaaccctgtctctactaaaagtacaaaaaattagccggccatggtgacaggcgcctgtagtcccagcgactcgggaggctgaggcaggagaatggcatgaacctgggaggcggagcttgcagtgagccgagatcgcgccactgcactccagcctgggcgacagagcaagactccgtctctattattcgtttggtaaaatttcagtagtcacaggggctggggactgcgatatgagacagcagcctccaagggctcgagagccgcgtttttgggagatgctggtgcgctgcaacagccctgccgcgtggagcaggtcctcgggccagaggaggggagcggcgcagttcacatac

SEQ ID NO: 217664 - DNA, 443 bp, Homo sapiens
tttgttacaaaataagaggagtttcttaaagtatcctctgctatctactgtctagggttgggctgaggcaactgcattttaacaagatacaccctaaatgatttgtgtgtataattgaggtttattcatgattggatttagagtaaatagttattgcaatatgccctgcagacatagtatatgttttggggaacaagaaaatggggcatgaaactatgataggaagggggaggggaatagtaaaatataaacgtggtgtatgctgacctacaatataaaaagcaattgaaatgtaattttgggccatttgttaaataccactatgaatgtcacaccacatatcttccttttaatttacatcctaaagaaacacaaggctcttgggttctgtaggacccgttagtgatgctttggattgaagaaaagggaaaatttctcgtttg

SEQ ID NO: 217665 - DNA, 660 bp, Homo sapiens
acatggtgaaaccccatctctacaaacaatacaaaaattagctgggtgtggtggtgcatgcctgtagtcccagctcctcaggaggctgaggtggaaggaggcttgagcccgggaggtcaaggctgcagtgagctgtgatcttgccactgcactccagcctgggtaacagagtgagaccccatctcaaataataaataaataaatacaaagcaaatactctgcatgatactacaatgataaatacacaccattatacattttcccaaacccacagaatgtacaacagcaaaagtgaactcgaatataatctttggagtttgggtgataatgatgtgtcaaggtaggttcatcaattgtgacaaatgtatcactccggtagggatgttgataatggtggaggctatgacatgtgcaggcaaggggcatatgggatagctctgcaccttcctttcaattttgctgtgaaccaaaaactgctcaaaaaatattgtctttaatttttttaagtgtaccagtcaggtaggataggttatgctgctgtaacaaacaacccctcaatctccatgtttaaaataacaaatttatttcttgcttatgctgtatgtccaccgtgggtcaccagggggcctctgcttaccactggaggtggtgaccagactg

SEQ ID NO: 217666 - DNA, 1276 bp, Homo sapiens
gcctactactactaaattcgcggcctcgtcgaccacagagatgaggccagagagacagccacagaccagggaacaggacagagcccaccagacaggtgagactgtgactggatctggaactcagacccaggcaggtgccacccagactgtggagcaggacagcagccaccagacaggaagaaccagcaagcagacacaggaggccaccaatgaccagaacagagggactgagacccacggtcaaggcaggagccagaccagccaggctgtgacaggaggacatgctcagatacaggcagggacacacacccagacacccacccagaccgtggagcaggacagcagccaccagacaggaagcaccagcacccagacacaggagtccaccaatggccagaacagagggactgagatccacggtcaaggcaggagccagaccagccaggctgtgacaggaggacacactcagatacaggcagggtcacacaccgagactgtggagcaggacagaagccaaactgtaagccacggaggggctagagaacagggacagacccagacgcagccaggcagtggtcaaagatggatgcaagtgagcaaccctgaggcaggagagacagtaccgggaggacaggcccagactggggcaagcactgagtcaggaaggcaggagtggagcagcactcacccaaggcgctgtgtgacagaagggcagggagacagacagcccacagtggttggtgaggaatgggttgatgaccactcaagggagacagtgatcctcaggctggaccagggcaacttgcataccagtgtttcctcagcacagggccaggatgcagcccagtcagaagagaagcgaggcatcacagctagagagctgtattcctacttgagaagcaccaagccatgacttccccgactccaatgtccagtactggaagaagacagctggagagagtttggcttgtcctgcatggccaatccagtgggtgcatccctggacatcagctcttcattatgcagcttcccttttaggtctttctcaatgagataatttctgcaaggagctttctatcctgaactcttctttcttacctgctttgcggtgcagaccctctcaggagcaggaagactcagagcaagtcacccctttgtactgaattgtcctcatcttgtggggggtttcaggactatttttatctctgacatctctctattgccccatctaccctaatgcatcaataaaaccttaagccactggcctctgtgtctc

SEQ ID NO: 217667 - DNA, 1379 bp, Homo sapiens
gtactcctcacaccacttaacagccacttgtttcatcccacctgggcattaggttgacttcaaagatgcctcagttactgcaaaacattaatgggatcatcgaggccttcaggcgctatgcaaggacggagggcaactgcacagcgctcacccgaggggagctgaaaagactcttggagcaagagtttgccgatgtgattgtgaaaccccacgatccagcaactgtggatgaggtcctgcgtctgctggatgaagaccacacagggactgtggaattcaaggaattcctggtcttagtgtttaaagttgcccaggcctgtttcaagacactgagcgagagtgctgagggagcctgcggctctcaagagtctggaagcctccactctggggcctcgcaggagctgggcgaaggacagagaagtggcactgaagtgggaagggcggggaaagggcagcattatgaggggagcagccacagacagagccagcagggttccagagggcagaacaggcctggggttcagacccagggtcaggccactggctctgcgtgggtcagcagctatgacaggcaagctgagtcccagagccaggaaagaataagcccgcagatacaactctctgggcagacagagcagacccagaaagctggagaaggcaagaggaatcagacaacagagatgaggccagagagacagccacagaccagggaacaggacagagcccaccagacaggtgagactgtgactggatctggaactcagacccaggcaggtgccacccagactgtggagcaggacagcagccaccagacaggaagaaccagcaagcagacacaggaggccaccaatgaccagaacagagggactgagacccacggtcaaggcaggagccagaccagccaggctgtgacaggaggacatgctcagatacaggcagggacacacacccagacacccacccagaccgtggagcaggacagcagccaccagacaggaagcaccagcacccagacacaggagtccaccaatggccagaacagagggactgagatccacggtcaaggcaggagccagaccagccaggctgtgacaggaggacacactcagatacaggcagggtcacacaccgagactgtggagcaggacagaagccaaactgtaagccacggaggggctagagaacagggacagacccagacgcagccaggcagtggtcaaagatggatgcaagtgagcaaccctgaggcaggagagacagtaccgggaggacaggcccagactggggcaagcactgagtcaggaaggcaggagccagaccagccaggctgtgacaggaggacatgctcagatacaggcagggacacacaccacagccat

SEQ ID NO: 217668 - DNA, 1916 bp, Homo sapiens
gtactcctcacaccacttaacagccacttgtttcatcccacctgggcattaggttgacttcaaagatgcctcagttactgcaaaacattaatgggatcatcgaggccttcaggcgctatgcaaggacggagggcaactgcacagcgctcacccgaggggagctgaaaagactcttggagcaagagtttgccgatgtgattgtgaaaccccacgatccagcaactgtggatgaggtcctgcgtctgctggatgaagaccacacagggactgtggaattcaaggaattcctggtcttagtgtttaaagttgcccaggcctgtttcaagacactgagcgagagtgctgagggagcctgcggctctcaagagtctggaagcctccactctggggcctcgcaggagctgggcgaaggacagagaagtggcactgaagtgggaagggcggggaaagggcagcattatgaggggagcagccacagacagagccagcagggttccagagggcagaacaggcctggggttcagacccagggtcaggccactggctctgcgtgggtcagcagctatgacaggcaagctgagtcccagagccaggaaagaataagcccgcagatacaactctctgggcagacagagcagacccagaaagctggagaaggcaagaggaatcagacaacagagatgaggccagagagacagccacagaccagggaacaggacagagcccaccagacaggtgagactgtgactggatctggaactcagacccaggcaggtgccacccagactgtggagcaggacagcagccaccagacaggaagaaccagcaagcagacacaggaggccaccaatgaccagaacagagggactgagacccacggtcaaggcaggagccagaccagccaggctgtgacaggaggacatgctcagatacaggcagggacacacacccagacacccacccagaccgtggagcaggacagcagccaccagacaggaagcaccagcacccagacacaggagtccaccaatggccagaacagagggactgagatccacggtcaaggcaggagccagaccagccaggctgtgacaggaggacacactcagatacaggcagggtcacacaccgagactgtggagcaggacagaagccaaactgtaagccacggaggggctagagaacagggacagacccagacgcagccaggcagtggtcaaagatggatgcaagtgagcaaccctgaggcaggagagacagtaccgggaggacaggcccagactggggcaagcactgagtcaggaaggcaggagtggagcagcactcacccaaggcgctgtgtgacagaagggcagggagacagacagcccacagtggttggtgaggaatgggttgatgaccactcaagggagacagtgatcctcaggctggaccagggcaacttgcataccagtgtttcctcagcacagggccaggatgcagcccagtcagaagagaagcgaggcatcacagctagagagctgtattcctacttgagaagcaccaagccatgacttccccgactccaatgtccagtactggaagaagacagctggagagagtttggcttgtcctgcatggccaatccagtgggtgcatccctggacatcagctcttcattatgcagcttcccttttaggtctttctcaatgagataatttctgcaaggagctttctatcctgaactcttctttcttacctgctttgcggtgcagaccctctcaggagcaggaagactcagagcaagtcacccctttgtactgaattgtcctcatcttgtggggggtttcaggactatttttatctctgacatctctctattgccccatctaccctaatgcatcaataaaaccttaagccactggcctctgtgtctc

SEQ ID NO: 217669 - DNA, 1263 bp, Homo sapiens
tcgctacctcttatggcacgcacagagatgaggccagagagacagccacagaccagggaacaggacagagcccaccagacaggtgagactgtgactggatctggaactcagacccaggcaggtgccacccagactgtggagcaggacagcagccaccagacaggaagaaccagcaagcagacacaggaggccaccaatgaccagaacagagggactgagacccacggtcaaggcaggagccagaccagccaggctgtgacaggaggacatgctcagatacaggcagggacacacacccagacacccacccagaccgtggagcaggacagcagccaccagacaggaagcaccagcacccagacacaggagtccaccaatggccagaacagagggactgagatccacggtcaaggcaggagccagaccagccaggctgtgacaggaggacacactcagatacaggcagggtcacacaccgagactgtggagcaggacagaagccaaactgtaagccacggaggggctagagaacagggacagacccagacgcagccaggcagtggtcaaagatggatgcaagtgagcaaccctgaggcaggagagacagtaccgggaggacaggcccagactggggcaagcactgagtcaggaaggcaggagtggagcagcactcacccaaggcgctgtgtgacagaagggcagggagacagacagcccacagtggttggtgaggaatgggttgatgaccactcaagggagacagtgatcctcaggctggaccagggcaacttgcataccagtgtttcctcagcacagggccaggatgcagcccagtcagaagagaagcgaggcatcacagctagagagctgtattcctacttgagaagcaccaagccatgacttccccgactccaatgtccagtactggaagaagacagctggagagagtttggcttgtcctgcatggccaatccagtgggtgcatccctggacatcagctcttcattatgcagcttcccttttaggtctttctcaatgagataatttctgcaaggagctttctatcctgaactcttctttcttacctgctttgcggtgcagaccctctcaggagcaggaagactcagagcaagtcacccctttgtactgaattgtcctcatcttgtggggggtttcaggactatttttatctctgacatctctctattgccccatctaccctaatgcatcaataaaaccttaagccactggcctctgtgtctc

SEQ ID NO: 217670 - DNA, 606 bp, Homo sapiens
atagaattgtgtagttaagtggacagtacacggggtctcaattaatcaaatgcatttcttagccaggtgttaatttgaaagttgctaggtggcagttttagcacttgctggatgtcttcacgtggttcactgaatccagaaggtcttaattttccatcgagggcacaatgtgtttgttttaacttccctgaatgaagcccttacccctgactctgaggcaaggcttagaatgcacatcatttatgtgagaggtgattcttcccaaggagaacttggagagatgacacagggaagggagaaaagcctgtaaatcagtaaatggtatgttcaaaagcgggcacccttgcagaggacaagggtccagtgtcccaagagactggaacatgcctcaaagttgaccaagctgagggactacggagctgggatatgttatgccaactccagcagtcactggttgaggttcactggcaaactcactgcctggtgttgccaatctgtgcctcctggagtcagaaaatgcccacaaggagaagtgtctgttcatgtccttcgcccactttttgatggggttgtttgtttttttcttgtaaatttgtttgagttcat

SEQ ID NO: 217671 - DNA, 373 bp, Homo sapiens
cacacagtttcaattccattttaatgaaatgtccagaaaaggcaaatctgtgtagatagaaagcccagccctcccttccgcatggtggcggctgtggccctccagggaccggggctgcagctgttgggtttgggctacgtcccttcattcatgctgggagccactgcctgttagcctgggaacacccgggaccaggcctgtctcttccaactgcttctgtgtcctgcgtcaaggggccgggccctgaatagcgtacggcgatgtttagctgttgagagtgttttgggagtggggatcctgagaggcacgtggcattgtagttgagagctgagttcaaagcccggctcgcatatataccaggtgtgtgatcttg

SEQ ID NO: 217672 - DNA, 378 bp, Homo sapiens
tggaatacagcatggtgactatacttagtaatactatattgtacacttgaagcttactgaaagagtaaatctcaagtgttctcaccacacaaacccaaaggtaactatgttctcaccacacaaacccaaagggaactatgtattaattagcttgattgtggtaaccatttcacaatgtatacatttgccaaaacattatgttgtatacctggaatatataattttatttatcaattatacctcaataaagctgaaagaggggattactaattcccacaaaatacagatttaacaaaaacttttattcaacaaacagtgctatgaagttgtaaattggaaacaaaagaaataaaatttcatccacagtcttctcatcaa

SEQ ID NO: 217673 - DNA, 364 bp, Homo sapiens
tagagcaatgtggttttcattttaattaggaaagaccacagggatgagagagatgagaggatcagcttgtgaggtaattcactaaccaaataagttcaggagccaaagaggtctttctgaaatcgacaaattaaagctacagtgttgtctgacattataacaagaggtttttactgttattattattaattttatctgattcagttaccttgttagttctgacagacttggattgctagcttgattagttccctcttatttgtccagaaacaccaaaacaccaaaattataccattttatcaatgtatgcctttatatatggctatggtttaggcaaagtgaagagaaaaatgtctagactaaa

SEQ ID NO: 217674 - DNA, 413 bp, Homo sapiens
gtcaggtaatgaatgttcctgattagctttagcactggtgtatttcaaccaaatcaatttttaaacaaaagacaaaggccagtaacattaaaagagaagttgaacagaactttaactgggaacactaaaaacttaaatgtatgtatttagtaggtacatattaaatgtcattatggtaatattcagatctggtgttttctcagttactgcattaaaaaacttaagtgctcatttgtaaatggtgttctattgacaatactgcttactactggtaggcctagcagtaaagctgctctccatactttcaataaatcctcaatctccttttcctatttctcctggtacccacagaccttgtattagtccattttcatgctgctgataaagacatacccaagaccgagcaatttaca

SEQ ID NO: 217675 - DNA, 455 bp, Homo sapiens
cagctctaacctgggtactgcacatatgtgttgtgggtagaaaggtcagggaatgtttttgctcacaaattcacgtggttatgtgtatgtgcgtgcaatgagagggtgtatgaaagagtgtgagtacattgtccttccaaacctgattcatcccaaactctgtgaggtttttctccagtgccataattgcatttcatttactactgaattttattgctaagtaaatttgtacttgtttgaagagctctgcttgctcaacacttgctttatgtcatatagctctttttcatttcatatggattaattcattgtattgaaatattttatggttaccaattattattggttatcagtcttcacacttattaaccatcagcgtggaaacacatcttcacatttcccttatttaggatactaatgctgtcacaaataaaatcattaaatgcaatcagtca

SEQ ID NO: 217676 - DNA, 431 bp, Homo sapiens
tctctagttcttgcttcttctgtaacatcatggcccctgcctctttggatactctaagatgtcaaatcgactgaggatgactcctgaggaccctttgagatgattaccatcgttgtaggtggaaccagaaaagagaaaatttctgttcttctgatcatttgtcaaattcagctcgaaacaggatcttgagtacagaacatttttcctggttgctgcatagctcagttaatctgtatatcatgggagtgtgttattgagagcatttgcagaagggtggaaccaggagctcatggctcaagcaggaaaatgtttcattatttgcagagcaagagaatgaaactcctgagacctgaatttcagggctccttgaaatgatggatgcattcttttaacttggtggagaaaaagaacataataaattcgagaaaata

SEQ ID NO: 217677 - DNA, 318 bp, Homo sapiens
acaatgttgccataatgtgaatatttttcttttgaatatttcttttagtaatgctatggtattaacagtttttaaaataaatccttttcttttacagcccattccatttgacttgagatattaaaatcttatgacaatctataagccagaccagtagaaatgtgacaacctctttatagtctttaactctgcaacagctttacaattatagagattagagaaccattagaattgtgatacaagtaatataagtataggttttaacactgtcatctgtcactgccatgttcctaacatatatagataaagtatagtttt

SEQ ID NO: 217678 - DNA, 541 bp, Homo sapiens
tttagctcagttgttcttgaccaattttctgtcctagcaaatctgaggggacaaacgtatttctttctacctatattaatggctcactaatgaaaagaaacggtatgagagacatatataagtttgaaaaaactgcagggcagcttctggtacaaggagggcttcctctgatggaaaattgccactttatttaatttatttatttttattgagatgcagtctcactctggggcccagcctggaatatagtggagcgttctcggcccactgcaacctctgccttctgggctcaagcgattttcataccttagcctcccgagtagctaggactacaggtgcccactactacgcctggctaatttttgcatttttagtagagacagggtttcgccattttggccagtctggtctcgaactcctgacctcaagtgatctacctgccttggcctcccaaagtgctgggattacaggcatgcaccaccacacccagctaattttgtatttttagtagagacggggtttctctgtattggtcaggctg

SEQ ID NO: 217679 - DNA, 267 bp, Homo sapiens
agtaatctggaaatgtcctggttgcagtccagtcagtgtggactgttgctaggcatataggaagtaggtcttctctctccagctagcacaaaagcttccaaggaagccactgggtcttcttgtcccattgtctcctctctcaggcccacagggtacaggaggtactgagttgagtctcacagaaaccttcttactcttatagtcaaaactgcatttatttaaagacctgtccatttacatatatcatttttcctgttgactctcata

SEQ ID NO: 217680 - DNA, 170 bp, Homo sapiens
atagctgaagagaccacaacacacaaactcgtttttcagccagcctgtaatgttcctcctatacacactctggaaatcctcagctcccttcaactccggagcaagagccaccaatattccaggtcagccacctatataatatgctcaccacgagagaagactcaaggtaa

SEQ ID NO: 217681 - DNA, 971 bp, Homo sapiens
aattggttttaatttttggtacagtatccaatcaatgttcgtaaactgaatttggctaattcctttattttcttttaaatttaaaataatttttcattattttgaattttgggaatgtctagtctaaccattttattgaatattctagcatggtttaatttcttctaaagtaatttgggttaaacatttttggcacaaatactgtgtacataattgtttttttattaattagttaattgacacattaattagttaattgacagttttttgatgaggaatggaacttgttaatcctcctcacacagaacttcattttacagacaaatgctaattgctatatagtgagtctaacttttggctgtgtaactgtgtctgcattcgcttcctgacagtgactggcagagaaagctgaggccagtcacttcttcttggacttgttacaatggcccatgacctgcaagactgatgtgataaaatgatcaccatcatttgtatcatcatgagtgggactgacacatctttagatgacatcagtttctgtagatctggcaatagtctggagagctttttattttaacctaaaacatgcattcatttatttagtcactccacaaacatttttgagtccttataatttgtgaggtagcaccaaccttgacttcaaatggctttttataattcaataaaatatatgtattctaatacaatttttaagttgatggtagcaaggataacttaaaatagtttattaaacatcactataagtggtatatttgcctacaagtggtatatttacctacaagtggtatctttgccagaggggcacagactggagatctaatcagcctggagttgtcagagggaaaaatcatgcagagatgatattttatctcagtgagaaagttcacgtctgcagcctttaataaagttgcccttacatttctatgcactttcacaacatcattgggaag

SEQ ID NO: 217682 - DNA, 297 bp, Homo sapiens
acaattccaattattgtttccatattcttactgttttggaacccagcacaaataaattgtgatgacatgaggtgacactcatgctgcctgtggcagggcgcatatttaaactttaccacaatttttgagtcattatttcagtggaccaatttcagaatggtctactgataggcattatggtaccacaacctttagtcactcatgtgtgtcctgaattatgatgaagtgcacataatgctttctgggttcagcatttggtgtgattgtctgatttgcttgtttgtttattaaatcata

SEQ ID NO: 217683 - DNA, 481 bp, Homo sapiens
gtagatttgaaatttaaacccagttctttctgactctaatttacctatatgttcatcctccagtatcatgctacctgtatgcctggaaataaaccattttacatagtttctaatgggattacatttttaaaggaaattcatggtagtaaagatctcgttaacactcccttgatgtatggtatttgagtttaagtgtgaaaagaagacactagcaatggacttgtactgagattcaggaaccctggcttctgcttccagttctctcactgtctgatggtgtgatttgagggccttagtcttatcaaatataatcattggttggtctggttgatatctcagttaatttgggaaactaaaatagcatgacattttcaaagaatttttaaaaagattactgtggcagaagcaagttctgggggtggaggtgcatgaggagggcttgggatagtgggaggtggctggagtaggggctgggttatta

SEQ ID NO: 217684 - DNA, 342 bp, Homo sapiens
gggagagagtctttttctcattccagttgatattcatctgtctgcctaaaattattttttttcttcttttttcctttttcttctttgtcatttaccaccattttggctggtgggtgtagggtatgttttttttttttttttttttttttaacctctaagcacattgaacgtctttagcttgtacattagacaggagactgataggataatgatgatggaatgttaaatgctatctatgtaaatcagctccttcaatgggtacaagattcagctactttaggtctttttttatttgacatacattttcattttttttaaggagaataatcttggattgttatt

SEQ ID NO: 217685 - DNA, 279 bp, Homo sapiens
ttttaaaatgcctgggcccagccaggcgcagtggcttacgcctgtagtcccagcacttttggaggccaaggcaggaggatcacttgagctcaggattcaagaccagcctgggcaatatagtgagaccccatcttgattggatgggtggtggatggatggatggatggatggatggatggatggatggatagatagatagatagatagatagatggaaagaaagaaagaatagataaatgataggataggagaaagaaagggaaagaaagaaaagagaag

SEQ ID NO: 217686 - DNA, 1956 bp, Homo sapiens
gggattgcaggcgcccgccaacacacctggctaatttttgtattgttagtagagacagggtttcaccatgttggccaggctagtcttgaactcctgacctcaggtgatctacctgcctcagcttcccaaagtgctgggattacaggcatgagccactgcgccaggcctactgatgctttttgggaagtgttcccaacttggagtcctggtccctgtgtctgatctgcagatgtcttctaccccggcactgggggaacatcttatttttcctgggttaaacattgggatctttataaacctgattatgtcctttccctctaagtctcggttgctttcaggctggcagggttactctgttgggtattccaggaaatgcctgagctccttcaggctcccctagcgttctgttcttattaaacttttcttccccgtctggccggtccttggggaacccactcactattttattttattgaccgggttatccagggatgaagtatgaaactcaaaagatagagtaggttggccaggcatagtgattcatgcttgtagtcccagctgtttgggaggctgagacaggaggatcgcttgagccccagagttcgatgcttcctgagctgtgattgaatcactttactccagcctgggtgacagagtgagaccctgtctccagaatagacaaaagatgcagtggaatccacgtccagaaactgtatgctcactctgggctccagcacccacttcccctccctggaggcagcctgagttttctgtcccctggtatgctgcagatactctccacagaaacaagcagatgcacatgtcaacagttttgcaagtgttgctcttttcccccaccttcttttgacatagctggggcagtttccatctctggtataaggtgccatcttattccatctctggtgtaagagtgtgttgctggatttgagtagttctaagcagcactgcaggagtccccctgttctgctgcatcattttgcacacatatgtgtctgtggaagacatggcccggtggggccccaccttgctgggggagagggatgtgtgtgtgatggtggtgcatgcttcccccttgctactccaggtgtctgccccatcccttcaccctggaggttccagacagcccctcttcaccagcgattccccaactcatctccagctcagatcccacccctgatctccagactcatggccccagctgcctcctgggctccttccccaggatgtgcctcaggggccactaaaggagccagtgcctcccacctgcccggatcgggtgctcctccagggatctttgttccagtgagtggtgccatcacctgcccaacctcatggaccagagcactgccctgtcccaatcacgttctcctatgcaccaccatacctacccctaaagttcttcctggcctcatcccgtcacctctgtctccatggccttggtcccagctcaagcctcgtcctctgccacctggaccatcggcccagcctcctctttggcctcccagcccccaacatccccccctcagtccatccccctaatggagagcttcctgacactagagctgacctcactactcccctgctcacagccctccgcgtggcctctcacctcccccaggatagagtcccaacccatccttctgtgtctcctcctctctgtgtccactgtcctgaccctaactcaatcctcattctctgcctcctggaccctcatcctagcctcgtgacttctggtctaagatgtgagagcacctggcaaggtaaatgctccaggaggggttgctccctcccatttcctgccaccagaaaatgttatcggctgcgtggcattgcgaaagccttcctcttcccagcctagggtttcatgtgggcatttaggtgctcccagtacatagttgcatggcaaacaatcctaaaatatacaagactacattt

SEQ ID NO: 217687 - DNA, 1330 bp, Homo sapiens
gggattgcaggcgcccgccaacacacctggctaatttttgtattgttagtagagacagggtttcaccatgttggccaggctagtcttgaactcctgacctcaggtgatctacctgcctcagcttcccaaagtgctgggattacaggcatgagccactgcgccaggcctactgatgctttttgggaagtgttcccaacttggagtcctggtccctgtgtctgatctgcagatgtcttctaccccggcactgggggaacatcttatttttcctgggttaaacattgggatctttataaacctgattatgtcctttccctctaagtctcggttgctttcaggctggcagggttactctgttgggtattccaggaaatgcctgagctccttcaggctcccctagcgttctgttcttattaaacttttcttccccgtctggccggtccttggggaacccactcactattttattttattgaccgggttatccagggatgaagtatgaaactcaaaagatagagtaggttggccaggcatagtgattcatgcttgtagtcccagctgtttgggaggctgagacaggaggatcgcttgagccccagagttcgatgcttcctgagctgtgattgaatcactttactccagcctgggtgacagagtgagaccctgtctccagaatagacaaaagatgcagtggaatccacgtccagaaactgtatgctcactctgggctccagcacccacttcccctccctggaggcagcctgagttttctgtcccctggtatgctgcagatactctccacagaaacaagcagatgcacatgtcaacagttttgcaagtgttgctcttttcccccaccttcttttgacatagctggggcagtttccatctctggtataaggtgccatcttattccatctctggtgtaagagtgtgttgctggatttgagtagttctaagcagcactgcaggagtccccctgttctgctgcatcattttgcacacatatgtgtctgtggaagacatggcccggtggggccccaccttgctgggggagagggatgtgtgtgtgatggtggtgcatgcttcccccttgctactccaggtgtctgccccatcccttcaccctggaggttccagacagcccctcttcaccagcgattccccaactcatctccagctcagatcccacccctgatctccagactgggaattgcaatttgacatgagatttggttggggatacagagctgaaccatatcaagggtagttcaccactgagattgattgattgactgagatggctcgggatcctcgggaacagcacaca

SEQ ID NO: 217688 - DNA, 490 bp, Homo sapiens
acactaaggacaaacaaagtcacaggacttgacactatgcaacttactgtaaagctataataatcaaaacagtacagtgctggcaaagaacagataaacaggttaacagaacagaataaagagcccaggaataaaaccacaaaatacagtcaactgatctctgacaaaggtgcaaaggcaatttaatggagagaggacagtctcttcaactggacatccagatgtgaaacaatgaatcctggtacacaccttacccctttcagaaaaattaactccaaatggatcatagatctaaatgtaaatgcaaaactgaaaaaaaaaacttttaacataggagaaaatctaggtgatattgggtttggtgacaagtttttaaatacaataccaaaaacacaatctattaatgtaaaacttggtaagttggacctcattaaaattaaaaatttttagtctcaaaaaatgacgttgagagtaaaaaaaaaacaaaaaa

SEQ ID NO: 217689 - DNA, 665 bp, Homo sapiens
tgacccgattttccaggtgccgtctgtcacagctttgcttggctaggaaagggaattccctgaccccttgcacttcccgggtgaggtgatgccttgccctgcttcggctcatacttggtgcgctgcacctactgtcctacacccactgtccaacaagccccagttagatgaacccaatacctcggttgggaatgcagaaatcacctgtcttctgagtcactgatgctgggagatgtagactggagttgttactatttggccatcttggaaccgcccaatgcagtttcttcatggtgtctttggtgtttatattttggtttgtttttgcagtggctggtaccagtttttcctttccataagccagcctggtggtaacaatatccctcagcatttgcctgtctggaatggattttatttctcttttgcttatgaagcttaatttggctggatatgaaattctgggttgaaaattttcttctttaagaatgtttaatattggccccacactctcttctagcttgtagggtttctgcagaatgattcactgttagtctgatgggcttccatttgtaggtaacctgacctttctttccagctgcccttaacatttttgccttcatttcaaccttggagaatctgacaattatgtgtcttggggttggtct

SEQ ID NO: 217690 - DNA, 365 bp, Homo sapiens
ggcaccagggaacaagcatttctaacaactagcaaaattaggacatatctaattgaaggataatgaacatattaccaagcggactggtgagacacagttaaactggtacttaaaggtaaatttatagcattaaatacaagagaaacaaaaaagtttacaagcaaacgaggtaggcatttttctccaaaagttgtaatgagaagtaacagaacaagcctatgaagtcacgaaggaagaaaataacagaatggaagaaatagataaaatagataagaaaataacattatagattaattaaaccaaaagcgatttacccgccccccaaaaagattgctaaaatagacttttggcagaattggtcaatt

SEQ ID NO: 217691 - DNA, 607 bp, Homo sapiens
gtgcagtgactcacacttgtaatcccagaactttgggaggccgaagtagggggatcgcctgaggtcaggagttcaagaccagcctggccaatgtggtgaaaccctgtctctactaaaaatacaaaaacattagctgagcgtggtggtgtgtgcctgtaatcccagctactcaggaggctgaggcaggagaatctcttgaacccagtaggcggaagttgcagtgagctaagattgtgcctgggcaacaagagcgaaaactccatcttcaaaaaaaaaaaaaaaaagaaaaaagaaagaaaatgtggaattacaaataatcattcaataatcatggaaacacaaaaaagtatatagacatattatcaggaagcaactagtggatcatgttagaagatacaaaacagtttaaatagacatggattatacttttaagaaactgccaacataaaatgagagagaggaaaggtgtgaatcttgactctgccagttactggttctgtgaccccagacaagtcacttaaccctccctgaacctcagcttggtcatctggaataaggatataattaataacaactttacctagctatgtatgaaaataaaagagta

SEQ ID NO: 217692 - DNA, 682 bp, Homo sapiens
cccaggaggcggagcttgcagtgagctgagatcacaccactgcactccaccctgggtgatagagcgagacgccatctcaaaaaacacaaccaaaaaaacaactaaccctgggaaataaaacaagctcatggaacaagcagaaggctttaaatgaactgtagtaacttcagagggcaaggagaatattgctgctatgaaataataacagactatttttaaaataattggatgttaagaaaatatgaaattttcccaaaattaaaacctcagtagataggctgaatagcagaacaaacacagctgaaatacaaaataagtttgaagacaaggccaaggaattctccaaagaaagttgaacaaagaacaaatatatatattttaaaattctttaaagaaacatggagaacacaggagtttcacaatgctgatactgcatctaacaggaatcccaggaggagaagacacaggggatctttgtgatggaatgtctgtctcttgactgtatcaatgtcactgtatcctggttgtgattatcctagagtattgtaagatgttattattggagaaaaatgggtaaagattctctgtgatgtagttcttaatgatggcatgcaaatttacagtgatatcagatacaaaagtttaattaaaaaatgagttgtctgctccctaaaaaaaaaaa

SEQ ID NO: 217693 - DNA, 207 bp, Homo sapiens
gggagggaaaagattgacctgacctgatgttcctgttaactcagcagctcccttttgagacctttgcagttgtgattccatagatttcccccaggcagccttttgatctttactcagtttcaaggcctgcctcaaatgtcacatggtttgtgatacttcctgatatcctcctgaaggagatttatcttccctcaacatcctgcctct

SEQ ID NO: 217694 - DNA, 619 bp, Homo sapiens
gcacatgctcgtgagtatagcaattcagagcatggactttggagccaaactcaacggagttcaaatctggaccttgctacttactagctgggtgcaactcagaggaagttactccacttccctgatcctccattttctcttctgtaaaatgggaataatagtagtgtctatgttgtaacattaaagaagacctaggatatgcttttagcacctatcatacattagctattaactcagtattatatttgctgtatcattgtgggaaaatcacggaatctctccgagccccagtttcctcatctgtaaaatgggggtaatgctgcatcctcgagagtgttgggaacattctgtgagccaatgtatacaaattgcttagcccaaaatatggcaactagtgagagctcaattcatgaaggtgattattactttcctgccttttcctttccacagcttctctcctaattcaggcctactttccttttgtctggccaccaaaatagcttatctggccaccctgagtctctctccctctttctgctgtagctcatcctgcatacagtcgccagaacaattttacatcaacacggcttttatcacttcccacacctgctgaggagcc

SEQ ID NO: 217695 - DNA, 423 bp, Homo sapiens
ctgataggctccttccagctttctactctgctgtctctagggtatgggatcttgaactaatcatggtccaggatggcaactagaagtccagccatcatgtccacattccaggctggcagcaggaagaaaggcagaaagaaggacatttgctcttgccttttaaggagtctttttagaaatcttatgtagccgtccagatgtaaggccacacctagctgcaaaggaggcagagaattgcagtcttttacctgggtggcaatgtgccctgctaaaatttgaggttcttttcctgagggagaaggggagaatggatattggggtaggccacctgtagattctgcctatcaattcattcatctattgtatcctgtctctctctttctgtctccttctccctctctccctccctcccttctgttttcc

SEQ ID NO: 217696 - DNA, 252 bp, Homo sapiens
ccctgctactgctgatcagcattttgggggtatgtttcaaagaggaactgccttgagaagcatttctgttgtgatggttattgctatagctcaaatatgtttgctttttggatgtgaccatagaaatctgcaggtgttatcagtgaccttggctcaaaatgtagcattgtttatttgtcatgaacagctagtaataaacatagccagaagaatgagcagtcatctatctgtcttctggtaataacaggagtt

SEQ ID NO: 217697 - DNA, 450 bp, Homo sapiens
ataactgaagccacagaaaatgaactcttggataagggagagctactgtatttctttttttttttttgagatggagtcttgctctgctgcccaggctggagtgtagtggtgccatcgtggctcactgcaacctccacctccctccctcaggctcaagcgattgttctgtctcaccctcaccctcccgagtagctgggattacaggtgcacgccaccatgcccgtccaattttttgtattttagtagagatggggtttcactgtgttgcccaggctggtcttgaactcctgagctcaggtaatccacctgcctcagcctcccaaagtgctgggattacagatgtgagccaccgtgcctggcaggaattactgtagttaccttttgtgtagttgctgaaatttattatggaacccaaacaaaaataatcatgagattaaatttttatgttag

SEQ ID NO: 217698 - DNA, 594 bp, Homo sapiens
tgttattttagtatcctcatgatttcagacttatttctagttgtcagcacttggttgccaaaaataagttactgtcctaaaaatacagtatatttgcaaattaatgctataattttgtcttcttaaaatctgatataaataaaaactgtacagatagatactatagattttgttcttattattgagagtcatgaaattttaaattgatatctcaatataagtaaataaatagtgattagcaaatttagcaaccaccacataggcctgagatgtaacgtctgcaccacatcagaagccaagtgctcactgagttatacgagaatccaaatgctaagcagactgatctacagttgtatatttaaggagatatgtttaaataatgcaaatttcctaggcaagatacaggaaagaacagaaatgagagtagttactttagcatttcaataagaaatatgcaataagaggtttgaaacatgaaaaacagccaagagccagtggtacaaatgaaactacatggaataaagtcttgatgaatctgcagccgactctgcagaaatttttagctaattgtatctctgctaagctttcagaagg

SEQ ID NO: 217699 - DNA, 453 bp, Homo sapiens
cagtgggacatgtgatgaaactgcaaaaatgtaggatctatttatgtttactaagatggaacgtggggaattgagagacatgggctatagaaaaaaagagtattccaaatttattcttaccagatagcattatgctcttttgtgttttgaaataaaaattttgaaagcaaagataatgtttttaaagtattggctaaattctactccagtgctaaaaagaaaaaaaaaattcatttatcagcatatgcatgaatgtgtctgtataaacatgtttgtgtatagttctgttagtcccgttacttaaagacacttttcctccttgtttggaaagtgttacagctctattacctgttgtatattcagctgctttttttttttttctcagaaaacaagtttttaaaaaattctaaaaataaatctggcagaagacaaatctgtgtcctgtcaaaactt

SEQ ID NO: 217700 - DNA, 361 bp, Homo sapiens
gcaaatgtctggctgcccttcccccacatttagcctgctgctctaaaagtcacccagctgcccgcttctctctggggtctctgaactcagatgtccttgctatttaaatcacctgtattctgcattatcttttcatttatttgtcagatatgtcttagcgcttaaccagggccacacgactcccaggaagctgtccaccctgaatcccatggcacagcctccctggagcacctctctacttcgttccctcctactgccactgccctggttcaggccaccttcgcctcttccttgacatcttcatgtctaccagctagtctcctgctttctttcttgccaacctctgatccattctccacat

SEQ ID NO: 217701 - DNA, 709 bp, Homo sapiens
gtgtcgattctagagtatcccaatctacctctatccgaagcatggtcctttagattgagaacaaaatcgtggaacagcgcttcatttttcccgtctcaagaagtcacaaggcccagaatgcaagaaaatcatggcttttcgatgaccaggccttgttggaatggctgagaagctcctcagccccgaccaggtgcagtgactgcattcggctctcacggagcaggtctgagtggagccaggatttgctctgttcaaagataaaaaccactggagagggaagcagcagatcacagggagcgatctcaatcctataggggcctgctccggggtgttttgcacgaggctccatgttaaataagcctccattcgagcgcagcctcaggacggccatccttcattcctctcagtcacacaccttccacttcaggatggccatccttcattcctcccagtcatgcaccttccactgcctggttctctgagcgcttccgtctagcgggagagacgccttcgaccaataattgcacataggtctggatgatgcccagccacagtcactcctctaaaagcaaggaacttgcttctgcagagtcaaacggagctcacgtgaggttcctggaggcactgaggtttctttctagtctcctgttttgcacagacctttttcttactgagcaattcactatctgctggcttcggaagaggtgga

SEQ ID NO: 217702 - DNA, 866 bp, Homo sapiens
atccctcctcccttcccagcactttcgccctccattgaatccctcaagcctcattctggccccactcctcccctcaccctctatccctgccctcctcagatctgccaaacacctcaggcctggctgcctctgtcctgttcctaccaaccttctgaccatgcctctgtgctccttgggacctgggctcacattttcaatctcttctctcctattagtacagctctgtctagagccatggttcttctctacctttcacagctgtcttctttcccacttatatgagtttctttaagtgtgaaaattaaaaagtgccacttaaatacaatgattaagtcataataaacagtacaagttgtacttatgtgagacataccacccatacacgtttgatcttcgagaaccacatctcaatctgcccatggcccattgcctgacactaaaagatgctcacaagaagttgactataaactaacttcttggtctaagatcctaaactcttgagagggaaggtttcaatacatatgaaaccttcttggcagtgcagggatgaggagagtaaaactgaaatgaaagtcagcaaatagtgaaggtgtgaaataggcagtgactctcacactgagacctccaggggatgttaaattttcatttcgaagctgatagtcttatctgggaagcctagagagtaacaaaagttgtaggcatatacttatattagagtggtgcaaaagtaattgctgtttttgccatttaaaaaaaaaatgcaaaaaccacaattacttttgcaccaacctaatagcaagcaaggggaggaatatggagagaaaatcaatttctaaaatgaaaaataaaaaattttttgcaagtag

SEQ ID NO: 217703 - DNA, 431 bp, Homo sapiens
atatgtttgcctttccatctgctgaatttgtattgctttttgtatccactgatgtgttccatcttacccctaattggaacttggagtaactgccaattctaaatcaacttatttgctgcctaactatgctgagctgagtgagcttttgtctctggaccctttagtccatctctctggcaccatgctgggcatggggcttcttgccataatttactgctctctgggaaaagaaaccctgcaggcgcacgccaccatgcccagctaatttttgtgtttttaatagagacagggtttcaccatgttggccaggatggtcttgatctcttgatctcatgatccgcctacctcagcctccgaaagtgttgggattacaggcgtgagccactgcgcctggcctgcaatgttcttaatgccatatgtgaagtagtgaa

SEQ ID NO: 217704 - DNA, 882 bp, Homo sapiens
agtaataagtttgtgtatttgcagctgtgtatgtgtgtttgtgtataaagttttaatgatttctggagaccagtcagcaaatattatatgagaggatagagccagagattctttgaatagaaagtaaaactattaaacttacacagtagctttttaaaaatgtaaatgccagttttatgaaataaataaataaatggttgtcaggatttaaacaatctttatttggagggccctaattcactaacttctcatgtttactctgcgttctttcagagatgtctaaaataggaagatcgttagaaacagtggaagggtgccatgataacagcataagcagggcctataaaatcacagaaatggggcaaccaaccatggaggtatcagtctagagagacataaagcaatgtcatatattccatcattattcagtaaaaaaagttattttttaataaaattcttagaccgggtaacaaattttcagtttcacagttttttcaggcaaaataaccttcgttatcattgcctgttctataaaacagagattttcttctatttatcaccttatgcccttgagatgattttggaaatagatctagtggccaggtaactctgcctaatatttccctcctcagtgtagcattgggccattcaaccaattgctttattcctgcagctgtttctagttagaagggaggtagtcaagaatctgcatgcaggccgggcgtggtggctcacgcctgtaatctcagcattttaagaggccaaagtgctttaagcacctgtagtcccagctacttggggggctgaggtggtggaggttgcagtgagctgtgatcatgccactgtacttcagcctgggtgacagagccagaccctgtctcc

SEQ ID NO: 217705 - DNA, 568 bp, Homo sapiens
agtgtgggggttataggtgtgagccaccacgcctggcctactatgagaaatctgtatggtcagcacattcttgccccatgggcaagcctataatgggaaccaaatcatttgcttagtgagcatgcatttgatgaatcagttgtttaattgcagtaggccaagagaatgtggcatatccctcccccagtagggatggccttgcaggtgacctcacaggggaaatagaaggcatacgatgacaactccttcaacttcctgatgccacacttccaacatctgtccccttccatgattacttccttccttctggttaaaaagattatctgttcctcctggccaaggacagtccttctacctatgctttagatcccaacccctcctccttttccccaaattgctgggattacaggtgtgagccaccgtgcctggccatccaccacttcttatcttacattttagtatcacctttattttagtatgccttcaactatcagttactgttttatgtagttaacaatagttactatccatttctttactattccttcttctgcctcactctttctcc

SEQ ID NO: 217706 - DNA, 439 bp, Homo sapiens
agtgtgggggttataggtgtgagccaccacgcctggcctactatgagaaatctgtatggtcagcacattcttgccccatgggcaagcctataatgggaaccaaatcatttgcttagtgagcatgcatttgatgaatcagttgtttaattgcagtaggccaagagaatgtggcatatccctcccccagtagggatggccttgcaggtgacctcacaggggaaatagaaggcatacgatgacaactccttcaacttcctgatgccacacttccaacatctgtccccttccatgattacttccttccttctggttaaaaagattatctgttcctcctggccaaggacagtccttctacctatgctttagatcccaacccctcctccttttccccaaatcttatactatccaatggcaccaaggatagggcagtgagagcagt

SEQ ID NO: 217707 - DNA, 1761 bp, Homo sapiens
gacttttcgcctctcgctggcctctaccgagcgcgtctatgagcgcagcgttcccgccgtcgctgatgatgatgcagcgcccgctggggagtagcaccgccttcagcatagactcgctgatcggcagcccgccgcagcccagccccggccatttcgtctacaccggctaccccatgttcatgccctaccggccggtagtgctgccgccgccgccgccgccgccgcccgcgctgccccaggccgcgctgcagccagcctgccgcccgcacaccctcaccaccagatccccagcctgcccacaggcttctgctccagcctggcgcagggcatggcgctcacctctacgctcatggccacgctccccggcggcttctccgcgtcgccccagcaccaggaggcggcagcggcccgcaagttcgcgccgcagccgctgcccggcggcggtaacttcgacaaggcggaggcgctgcaggctgacgcggaggacggcaaaggcttcctggccaaagagggctcgctgctcgccttctccgcggccgagacggtgcaggcttcgctcgtcggggctgtccgagggcaagggaaagacgagtcaaaggtggaagacgacccgaagggcaaggaggagagcttctcgctggagagcgatgtggactacagctcggatgacaatctgactggccaggcagctcacaaggaggaagacccgggccacgcgctggaggagaccccgccgagcagcggcgccgcgggcagcaccacgtctacgggcaagaaccggcggcggcggactgccttcaccagcgagcagctgctggagctagagaaggagttccactgcaaaaagtacctctccttgaccgagcgctcgcagatcgcccacgccctcaaactcagcgaggtgcaggtgaaaatctggttccagaaccgacgggccaagtggaaacgggtgaaggcaggcaatgccaattccaagacaggggagccctcccggaaccctaagatcgtcgtccccatccctgtccacgtcagcaggttcgctatcagaagtcagcatcagcagctagaacaggcccggccctgagggtccagaagggccagggcctggcacccacctggagaagcccccgcacccgagggaacccatggtggactccactgtgtttgaagcaacaaagtcacagcccagctgtggccatcccaagcaaattgagaatatattcactaaatgggcttaaaagactgcttttgaaggggcttacagccacaccagaagacacgctaaatatttattatactatcctactttgtacataaatatctctatagactggatctcagctgcagtattttgaaagttataggacttaattacccagtaatttctccactcattccagaagaaaacaaaacctctgctgtaatctgcgcggttagcagccacctttccatacttttccaaaggtaaacgtgaaacccaagaacaagcactggggtttaaactgattttggtttgcgttctggctttttgagttgactgaaaagcagacattgttaggcagcctggaaattcgctttgctttgctttgcttttgcctggctttggtttcccctggggttgcctatcctatctgagccatgtgaagcacgtctccgttgtgttaatttatttcaatgtagcttattttcttataagttatgacatttaaacaatttcagtcttgtgaataataaaaaggagagagggggggaaaaagacca

SEQ ID NO: 217708 - DNA, 1389 bp, Homo sapiens
gtggaggatgaggcccggctgtgccgctgggcctccgggggacattcagagccacccaacaagcggggtctcgtggagggggggcgtttagcgcccggcgaccagctgctgccctgggccacatatctatctgacgatgcgtttggccgaggccgcctctgccgctccgcggtgacctggggttccggtcggggctgtccgagggcaagggaaagacgagtcaaaggtggaagacgacccgaagggcaaggaggagagcttctcgctggagagcgatgtggactacagctcggatgacaatctgactggccaggcagctcacaaggaggaagacccgggccacgcgctggaggagaccccgccgagcagcggcgccgcgggcagcaccacgtctacgggcaagaaccggcggcggcggactgccttcaccagcgagcagctgctggagctagagaaggagttccactgcaaaaagtacctctccttgaccgagcgctcgcagatcgcccacgccctcaaactcagcgaggtgcaggtgaaaatctggttccagaaccgacgggccaagtggaaacgggtgaaggcaggcaatgccaattccaagacaggggagccctcccggaaccctaagatcgtcgtccccatccctgtccacgtcagcaggttcgctatcagaagtcagcatcagcagctagaacaggcccggccctgagggtccagaagggccagggcctggcacccacctggagaagcccccgcacccgagggaacccatggtggactccactgtgtttgaagcaacaaagtcacagcccagctgtggccatcccaagcaaattgagaatatattcactaaatgggcttaaaagactgcttttgaaggggcttacagccacaccagaagacacgctaaatatttattatactatcctactttgtacataaatatctctatagactggatctcagctgcagtattttgaaagttataggacttaattacccagtaatttctccactcattccagaagaaaacaaaacctctgctgtaatctgcgcggttagcagccacctttccatacttttccaaaggtaaacgtgaaacccaagaacaagcactggggtttaaactgattttggtttgcgttctggctttttgagttgactgaaaagcagacattgttaggcagcctggaaattcgctttgctttgctttgcttttgcctggctttggtttcccctggggttgcctatcctatctgagccatgtgaagcacgtctccgttgtgttaatttatttcaatgtagcttattttcttataagttatgacatttaaacaatttcagtcttgtgaataataaaaaggagagagggggggaaaaagacca

SEQ ID NO: 217709 - DNA, 385 bp, Homo sapiens
gatacttcctactccttgctggctttatatgaaggatctcatagttcccctcttctcctctctcctttcggaggtacctcgtgttaataaatgctaagtaaaagagatttaaaatgtacagtacctcatgtaatatctatcctatctcaaatagaaatgtttcagaaggtgcaacatgctttctctggaccgacttttcctattaccagcgaatgtggaagcttaaaaagtaacgtatacttgtgtgtcatttggactttggtattaccataagggaatatatacttatgataacatgaaactccaaatggtacagaagtataaaggaaaagcagaagttttctcttgccctactgcgcccctcactcctccagcttctgaccac

SEQ ID NO: 217710 - DNA, 357 bp, Homo sapiens
agttggttcattgaaagagtaaaccaaattgacagctagattaaccaataatgagtaaataaatcaaattggtaataaaacatcttccaaaacaacaaaaagcccaggatcagatggattcacagcgaaattctaccagacatacaaagagctagtatcaatcttattgaaactattccaaaaaaactgaagaggaaggatgcctcccaaactcattctataaatacagtgtcaccctgataccaacaatcagtgaaggatacaagaaaaaaagagaactgcaggccagtcttcctgatgaacatagatgtgaaaatcctcagcaaaatactagcaaaccaaatccaacagcacatc

SEQ ID NO: 217711 - DNA, 324 bp, Homo sapiens
taccaaaaaaacagcatagtcttggagctaacatttttacactgtatcatagttatttgtgtcttaggtgaagggactgtgtcttccttgtttttttagcctcagactcccaaagaaagcccaacacacagacacagaaatgagtacgtgcataactcttgaccttacagtgcagtccaataggcaagaggaatacatatgaaaagcaattacttcgctttaacagtaatactagtggtagaaagccatttacccaatctcttgcccccaactccaaccatcagaagagtgcaagtgtctatttcacacattacatgaagaaca

SEQ ID NO: 217712 - DNA, 265 bp, Homo sapiens
agggtcatggaagccaggggagaagaagtttccaggaggaagagtgatgagtcagtgccccgcagaggttattaagacacaatagaagtgtccattagacttggaaattcagcagtaaccagtgtgataagagctggttaatggacatgtggtgggtcccaacaccagcctacaggaggttagtaagtaggacagtgaaagtacttttagaaaatttggcaaagaggggcagaagttagagggaatgccaaagctgcgtcgacgc

SEQ ID NO: 217713 - DNA, 705 bp, Homo sapiens
taagaaaggttttaattacttaatgttgcagggataggtcaaacagctgacttcaaattactcattcaaaccaggaatagctatgttggatatttgcagtggtttggtgtgcaattgagtttagttcaataaacactgaatataaatgcactacggctaggtgttatgagactctgaagaccgttaaggcatagtcctttactaagaattcaaaatctttcctatagtataattattttatggttgttttattaatagtgtgatttatatctatcatttattgagcacctactcatgccagcactgtattagtacatttgcataaagctattttatttaattctcacaaaaaccttagggggcaggtattttccatattttacagggtaggaatcttacagaagttaagtaatttgcccaagatctttcagctgtaaatagctgggatatgaatcctgggctgtctgaggtatttcttccctacttaacaagaagtgcagaaatacctacagtattatttatgctctttacatcactgctaattattgttcttggcattaccaaacaagtttgtgtaccaggatgattttaatttaatctggtgttttcagtactgttatatttggagaaaaccattaatttcttttttaagtttcttctggtttattccccatccccagaagttctgatattaaaatttttaaa

SEQ ID NO: 217714 - DNA, 864 bp, Homo sapiens
ggccggagatggattcactgccctccctgcagacacgcaggctcacacacggagcactgggaagtacacatttactgtactgcatgccgactgccttgaagaaactgtagctaaccaccttattagtattcttgcctccaccgtgtctcacttgcagcatcagagggctgagcaaatgcagtagaacagggacagacacagctctggcaatcatctcaatgcaggctgccgaatgttgggggtgggggatgcagcacttcgagattaataaccttgccataatccggggcaccctgcaagcagacacctctgctgattgacctgctactggcttgatgcatctgcctgggggagagggatccggaatctacctagtcctggggcccccctgattttggatgttcatttgatccttcacagatctgggaaggtaacagcgagccgtaccatctgcagcacacagcagctcttggaggttactactgacagttttcattacactggtttgtgtgagtgcgtgtgtttgtgtgtgtttgtgagtgtgggtgcctgctttgcatgaaagagaatgtgtgagtgtccgtgtgtgtgtatgtgttagtgtgacaaccaaagcaggtatttcgtacagtaggagatttcaacaacgtgacaatattctctaggcacttgggctcactgtctgtagcccccaccccccgcctttcgccacctccttgcttccctactcccccttctgcttttgcctttgatgagtttttggcttactttttggcggagtctcttggacacgtttttgctggtgctggaagatcagatacatggaacctttgaaaactgattatttttctccgatatgactta

SEQ ID NO: 217715 - DNA, 555 bp, Homo sapiens
ggacagaactagcctgaaattgccatgtgggatgttctgttctcaccgttcatgtcgtgtgttgtgctgctgtgtgaccgtcatcatttgcatggctccaccacgtcctcctgaacacctccaagacgtaactgccaatttttcacaccactcatcacatgaccattttgtatatgaatatatggttatatgtggatattttcatacctagagttttgccatctaatctgagctcagcataaatttaattggagtttttcaagggctggtatcttttctatggaaatgttccaaagtactttttaaggaagtttcaaaactataaataaccttagatttgactgggagtttggtatcaacccaaagccatcagttgcaagcataccatgaatatttttcttatagacagagctataaaaaaagatacagtagaccaaaatagaaagcaaataaaccatataaagagttctatagtatatgccacttatacacatgtatatgcatttatgcagagacacatatttatatataaaataaatggacataaagagcttt

SEQ ID NO: 217716 - DNA, 433 bp, Homo sapiens
agttgtgttagctctaagcccagttgatggttttggttatgcaattacttgagccctggtttcttcatcaatcaagcaagcctcaaatttcctcctctttctcagttttgtgatttttgacattagcagaatttaaaatacaggatggttgctaagcagtttcataaatggaaaccacatttgtcaaatgagctccacaccaggaaattcagcgagaggattcctgggtatcctcagtcctagcctgcctagcatctcacgtgaattggagtctgtaatgtcctcccagagggaactggatctagccagtaggcacaaacattcttttggtctttccaaaaattttctgcagaaaatgcctatgggacaactcactgtgaagttgaaattatatgcaagtgtgtatacaattaaatttcaaaataaatgcctt

SEQ ID NO: 217717 - DNA, 1567 bp, Homo sapiens
ataattttaatacaattttttttttttgagacggagtctcactctgtctcccaggctggagtgcagtggcaccatcttggctcactgcaagctccacctcccaggttcacgccattctcctgcctcagccttccaagtacctgggactacaggcgcccgccatcacgccaggctaattttttttttttgtatttttagtaggaatggggtttcaccatgttagccaggatggtctcgatcttctgacctcatgatccacccacctcggcctcccaaagtgctaggattacaggcgtggaccaccgcacctggccaaaacaaagtttttaaaagattcctttaataaacatttacaataacatcaagaaatataaacgacatagcaaatatgtgaaagccagccagactctcaatggcatccagaaacataaactacatagaaaagacatgaaagccagccaggcttggcttcgaatcccagcactttggaaggctgtggcaggagggttgcttgatctcagaagcttgaaactagcctaggcaacatagtgagccctcatctctactgaaaatcagaaaaattatccgggtttggtggtgtgagcctgtagtcccaggaatcagtggatgaggccctaggatgtcataggcctgagaattccatgctgcagtgagctgtgattgtgccactgtactccagcctgggtgaaagagtgagatcctgtgcagaaacaaaagaagaaaaaaagagatatgaaagcctatatattgaagactaccaagtactgcttagagcagttaaagacctttggaatagaaaatgtttcttcttgcatttcaagattgcttttgttttggggggacacactattttttaggaatatgaagttcttcttaggcattcctgtaaaaaaggccacttcttgataggattgtattgaatctgtgggttgctttgagttgtatttttatcttaaccatgttacaacttccaacccatggacacaagatgtctgtccattgatttaggtcttcctgaatctcctcgagcaatgttctgtagttgtctgtgtacaagtacggcaccttcttgaacaaatttattctcaggcatattattcttacaagtgctattataaatgaaatcattgtgtcaattttcttctcagattgttcattgctaacacaactgattgtttgctgaaagtttgctgaattcacttattaactctagtagtgtgtgtatgtgagtgtgtgtgtgtgtgtgtgtgtgtgtgtgtctggcctctgtatgcatgtatgtgtgtttgcatctgtaggtattatttgggattttctatgtataggatcacaacatctgcaaattgagatcattttgttttctgttcaaaaatactttttctcatgtttatttttaaaagataatttggccaggtgtagaattgtaggtgacagtttttctttttttaagttctttattgcaaacttcttgtttgtatgagaaatcttatgccatccttatatttagtgctctgtatgtaacatgttctttccctttttattcctt

SEQ ID NO: 217718 - DNA, 375 bp, Homo sapiens
gaatgactcagccttgggggtggctcaggacaccccccctgagcagggggcaggtggtcagctaggacgcagccctgggctcatttgttctctgccctcctccccacctcccccagcttggattggaagcttgtccccaaataggctctgctttgcacgctctaagaaaagggaggcagatctggccaccagccaaggtgaggcagcatccctgggggtgagaagatggggggactgacagttgctgggctaggattcacttcaaggtctcagcctgtcagggaggggcgtaagtcccagggggccagaaagtggccataaagaggacaatctaggtctctggagaaactacctgtacccagcttccctgtgtta

SEQ ID NO: 217719 - DNA, 429 bp, Homo sapiens
aggaaagcactgggagatgcacataaatacattcatcaaataccatcatctaggttatttttgcattcaaatgaatatacttcccaggcaagtaattaaaataaaatctgtcagagaatgtaaaactctaaatcataaaatgttcgttaaaaaaaaagaagcaatggagaaagactaagatctatagtaatgtactttgctgtaaaatattttagcattgatttccatttttatgaaattcatagttgatttgaatacaaacagtaagtctcatcacaggtgaaacctatctttttcttgtttgctttccgaggaattgttgaggaaataattaggtgtttctttatctataggagggatccaaatattccttaaggtctttacagctctactaatttaagatatctgtatttgacaatttttgccttg

SEQ ID NO: 217720 - DNA, 136 bp, Homo sapiens
gagagggggcggagcgtggaggcggcagctggaaccgcgcagcgcacgggaacgcgtcccgctgcttgggtcaggttcgccggtcgcgggagccccgccgtgcagtcggaggaacacgtggccatcagtaatcatg

SEQ ID NO: 217721 - DNA, 522 bp, Homo sapiens
actttctgacatcgaggcaggtggatcacctgaggtcaggagtgccagaccagcctggccaacataatgaaaccctgtctgtactagaaatacaaaaattagccaggcatggtgatgcacgccggtaatactagctactcctaggctgaggcaggagaatcacttgagcccgggaggcagaggtttcagtgagccaagatcatgccgttgcactccagcctgggagacaagagcgaaactctgtctcaaaaaaagaaagagaaaagaaagaaagaaagaaagagagaaagagagaaagagagaaggagagacagagagagagagagagagagagaaagaaaggaaagaaagaaagaaagaaagaaagaaagaaagaaagaaagaaagaaagaaagaaagaaagagaaagaaagaaagacgactatttttatttattcaataaatatttgttgagacatgagacactactttatgccaggctcatgagtaacactgagaggagccctaccttatttcaggtac

SEQ ID NO: 217722 - DNA, 431 bp, Homo sapiens
tgagacgcagcccttggccccagcttcccatgggcagggagccagccgagcccctcagaggcgttccccaaggctctgcagatgcggcccaggaagatgcaggaaaagaaggacagcccagtgtctggggcccctcccagggcgaagaaccggcattcctaccgcagcccagcagggctggtcactcgtcttagtgcccaaggctccaggttaagaggagccacgtgagccacgatggtcatcaccagatgctgggtgccgtgctcgaagccaggaccggctgaggctttcgggggttgcatgttttgcatgcatcagtgaaggagacatttgtgacccactactggggcaggtggtttcactttcccaccattatgtccagaattggtaggttcttggtctcactaacctcaagaatgaagccgtggaaa

SEQ ID NO: 217723 - DNA, 331 bp, Homo sapiens
atgagacgagatcacgccactgcactccagcctgggccacagagagaggctccatctcaaaaaaaaaagaaagagagagagaaagaaagaaagaaaaagaaagaaagaaagagaaagaaaaagaaagaaagagagaaagagaaaggaagaaagaaagaaagagagaaagaagaaagaagagagagaaagaaagaaagaaagaaagaaagaaagaaagaaagaaagaaagaaagggaaaaaagaagaaataaaggaaaagaaagaaaagaaaatctaatgccccgctccatggtccatggaaaaattgtcttccattaaaccggtctctggt

SEQ ID NO: 217724 - DNA, 859 bp, Homo sapiens
agcggggctcgagcattcttgtagcacaactggatgagaggacattctcagtggtgcaacacgtcaataccacgtaccctaaatccaaggctggcaacgccttcattgcccgaggaatcctctatgtcacagacaccaaagatatgagggtcacatttgcctttgatttgttaggagggaaacagatcaatgcaaactttgatttaagaacttcccagtctgttcttgccatgttagcatacaacatgagagatcagcatttatattcatgggaagatggccatttaatgctttatcctgtgcagtttttgtcaactaccttaaatcagtgatgtgctgcattcggctcccttcagcaaatttcaggggttttctgggaccagttctcccccaacaggaaacttgtttttttaacgtcagccagatatttagaaaataacctcaaaagtgtttatatggtcagtgagccccgcttagtgaaatagcaacagattggaagttgaaatggctgagattttctgtacctgtaggtaatttggtgattcttggtggctgctcttctcacaacttttatgtatctgcttctgtcgtttagcttttttagccacatgctgaccaaatttacctttgagttgataagtccagtggcttgagtagtgaatccctcagtgctgacttatatcttgttctttgaaaaaatgcattgactctttaagacatctaaagtatcacattatccataatttattgcttttctttgcatctgcacctgccaccacagaataaccattaccctcagctgctgattgggcagctctgagattagcaaaagccagggacagctacatgttcaggtttt

SEQ ID NO: 217725 - DNA, 959 bp, Homo sapiens
agcggggctcgagcattcttgtagcacaactggatgagaggacattctcagtggtgcaacacgtcaataccacgtaccctaaatccaaggctggcaacgccttcattgcccgaggaatcctctatgtcacagacaccaaagatatgagggtcacatttgcctttgatttgttaggagggaaacagatcaatgcaaactttgatttaagaacttcccagtctgttcttgccatgttagcatacaacatgagagatcagcatttatattcatgggaagatggccatttaatgctttatcctgtgcagtttttgtcaactaccttaaatcagtgatgtgctgcattcggctcccttcagcaaatttcaggggttttctgggaccagttctcccccaacaggaaacttgtttttttaacgtcagccagatatttagaaaataacctcaaaagtgtttatatggtcagtgagccccgcttagtgaaatagcaacagattggaagttgaaatggctgagatttggtgatctccccacagctggctctgcaagttacctctttctccttgggccttagtttccccattggtaatctgaattggctaagatgattggggagattttctgtacctgtaggtaatttggtgattcttggtggctgctcttctcacaacttttatgtatctgcttctgtcgtttagcttttttagccacatgctgaccaaatttacctttgagttgataagtccagtggcttgagtagtgaatccctcagtgctgacttatatcttgttctttgaaaaaatgcattgactctttaagacatctaaagtatcacattatccataatttattgcttttctttgcatctgcacctgccaccacagaataaccattaccctcagctgctgattgggcagctctgagattagcaaaagccagggacagctacatgttcaggtttt

SEQ ID NO: 217726 - DNA, 685 bp, Homo sapiens
atcgttaacctggaggaaggaggagactgttatcgttgcctgagcactcctctgctggaaaaagcaatgagcctgaatatggttctactaattgttacggtcagaaacctaaagaaacaagaggtggaaactaaaagaggaaaaagccagtggaaattaacgtttgctctgattttaatagcgcccgtgaggcaagcatgctacgtcagtgggaagtggtgacaatccacctgagctgtgtgctataactcaataacatttgtaactaatttaacctcacatatatttagtgtttatgtataaccatggttgtgctgcttggtaatgaggcattaaaaatgagccagtccaagaattgagtttaaatagtactccttctctcagccaaatcaagcatttcttgctgaggggctgaagggctgggtggagagaagggaattgggtagagttagtgagcagctctgcatcgtctctgaaaacccctcatttcctctcaccctttcctaaggcgaggaggaggactttctctcaaactgtaaaatccaggctgtgctaaccacactcagtttaaaggaagggattataaaagtgcttgaggtggagactaatcccatgaaaccctctcccacctgaggaatgggaaagatgctctgaagcctctggattcccacaccttactgttgtt

SEQ ID NO: 217727 - DNA, 588 bp, Homo sapiens
tgcttcttacatcctgttggtccctcctcattaggtggccacatctggctgcaaatgaggctgggaaatgttatctctagatgggcacctttgcacctagctaaactgggtggtgatggtggcaggtgtatgttactaaataatgattttgggggcacacttagtagttatcatagaaatggaagactattttgattaaaaagtcaacttgggaggaaatgagtgattaaaaaacatctgggcctaccctataagcttcagtacttgccatatgtaagtaacaggactcaatacttctttcttttttccttctagaaaagtatgccatgcagagttaagagtatgtaaatttaaaagacagtttgtagctcttactctcaaccagtgcatttgtggtgaaaatgggtggcataggatacatgtgcatattacaaacaaatgcttgcaacatggaattctctctacacttttttgtctcattacttatattttcagattcagtacaacttgtggtatcagtttatcaccatcttcgaaatattttctgaaagatgatatattttctaagtggaagaattattcctttcc

SEQ ID NO: 217728 - DNA, 307 bp, Homo sapiens
tgcctcccgccgcccgccgcggaccaggcgctccctcccggcggctggcgagccagctccggacatccgtccccacctttccgctaagcgcggcgcccgcggggcctgcctcggcggtcaggtcagcggcctccagcctcactctccggccccagcccgcagccgccgccgagcggagcgcacctgacccaggcgggcggggcggggcggcgggcggggcgcggggctgacgtggcccgcggcatggagcgggcgtgattcatcagcatccgcgccggggcggcatgggggcgcgcgcggcggccgc

SEQ ID NO: 217729 - DNA, 376 bp, Homo sapiens
ccgagatggcgccactgcactccagcctgggtgacagagcaagactctgtctcaaaaaaaaaaaaaattcagggaagaggctgggcatggtgagaactctgagtaattcagaatgctcagggttaaaaggatgaggagaaggaagcccaccaagaggccattagaactccactttggggcaaggaggcaaaggaggtgaaatgcaaacccaccctgctcaggctgtcccccaacaacaaaaaaaaatcacaaccacaatgagtccctgtttccaaggaggtggttgctagggtaggaaatggactgaagaagctctttgtcatggagagaatggcaggcgcagtcacagaaggcacggctacgggataatgccata

SEQ ID NO: 217730 - DNA, 343 bp, Homo sapiens
acgccattctcctgcctcagcctcccaagacgctgggactacaggcgcctgccaccacgcccagctaattttttgtatttttagtagagacggggtttcaccgtgttagccaggatggtctcgatctcctgacatcgtgatccgcctgcctccgcctcccaaagtgctgggattacaggcgtgagccaccgtgcccgggccagatcaactgatgttttgagttcagatacagagtaaatgtagcttgtaaagtactggtcattagaaccagagaatgaactctgtccctcttttaaatctggttggtttagtctttttagacacataccgttcggggacaaag

SEQ ID NO: 217731 - DNA, 320 bp, Homo sapiens
ttctccaagacagaccatatgataggccacaaaacaagtttcagtacatttaaggaaaatgaaattatatcaagtactctttcagaccacagtggaataaaattgaaaatcaattccaaaaggaaccctcaataccatgcaaatacatggaaattaaataacctacccttgaatgatccttgggtcaacaataaaatcaagatggaaatttaaaaaactatttgaactgaattataatagtgacacaacctatcaaaacctcttggatacagcaaaaggtggtgctaacaggaaagttcatagcattaaatgcctacatc

SEQ ID NO: 217732 - DNA, 467 bp, Homo sapiens
tttggttgaatattttatgaacacttgtgataataaatttgtgccagtgagtactatattctttaaaaaatatttctgaaagtttggtgaagatgtgagagagactaaaaataatttttctattgagcctagattttcatgctttatgtctgaacaccaaaatttttttaacttttaaattcaggggtacaactgcaggtttgttaaataggtaaacttgtagcatgggaatttgttgtatggattattttatcacccaggtattaagtcttgtacccactagttatttttcctgatcctctccctctaccttctgaaaggccctagtgtgtgttgttcccttgtatgtgtccatgtgttctcatcatttagctcccacttataagtgagaacatgtagtattcggttttttgttcctgtgttagttttctaaggataatggcctccagctccatccatgttgctgc

SEQ ID NO: 217733 - DNA, 814 bp, Homo sapiens
caagcatcagaaccagactcagatttgacacaaatttggaaattatcagatagagaatttaaaataactgttttagattttaaagactctaatggaggaaacagtcaacatgcaaaaatagatgtgtaatgtaagaagagtgatggaaactctaggaaacaatcaaaaggaaatgctagaaataataaaaatcactgacataaataaagaatgtcttcaataggttcatcaacagaacaagtttgaggaaagaatgagtaagcttgaagataagtcaacagaaataatttcgaaagtataatatacatctatttggaataccagaaggagaagaacaagaacaagaaactaaagaaatatttgaagtaacactgtcagaggattttcccaaattaaccacagcaaatcacaagtcaagaagtagagaacagtaaacaggagaaataccaaaacaattatacacaaacttcagaaaaccaaagacaaaaagaaaatcttcaaaggagtcagagaaaaagtaacctgacttacagcaaaacaggacaagaattaaattagacttcccatcagaaacacagaagcaagaagactggagtgaagtatttaaatgctaaaataaagaaaaaaaatacaaacttgagaaataaagacttcctcagacaaatgctgagggaaataatcaccatcagaccttccctgtaagaaaatattaaaagaagttcctcacggaaaaggaaggtgataaagttcagaaactcaaatctgcgtaacaaaggaagagtgccaaagaaggaataaataaaggtaaaagaaa

SEQ ID NO: 217734 - DNA, 425 bp, Homo sapiens
caggcccatggtggaaagcagcagctctccatagacccaacagtccgtcttgttctagagagaggccacagtctgcgcccagtcagtgaagaggttctctgcctaacatctaaccagatgacacccaagcacctgaccaaaacgcttgaaccttggaccctctctgcatcaaccatccatcctccatttgcctagtgggacaacaaggtgggggctgcagcctccaggctggaaaaagacttagaaaccagcatatcattaatgcaatggaaaataggtaccccctccattccataaccatctattgttgttataggccctttgaactgatgaatgttaccatatatgagagtgtattccactctagtatccactagggcaagcacagcctattcttatttgtccaatatatagttagttctaca

SEQ ID NO: 217735 - DNA, 249 bp, Homo sapiens
gtcttcaagctctgaaattctctcttctccttgttctagtctattgttgaaaccttctactgcattttctatttctctaagtgtgtctttcatttccagaagttgtgattgttttttctttacgatatttatttctctggataattttttaaatccatatcctatattgttttttaaaatttgtttaggctggtcttgaactctggccctcaactgatctgcccgcctcagcctcccaactgctgggat

SEQ ID NO: 217736 - DNA, 300 bp, Homo sapiens
taccaagcaagcagtcttcagcgtagcttaaactacaggagcacgcccgtgcttggtgaattttttattttatttttatttatttattttttgagacgcagtctctgtcacccaggctagagtacagtggtgagatatcggctcactgcagcctccgcttcttgggttcttaaaagtttttcgttttaaaaccaaaaggaaaagaaagtgtattagcacagttgtcatgagctttgatgcctacaagatctagtgaaaaatgtgtttttgtatgttgaaatccctgtaaaagtattttgt

SEQ ID NO: 217737 - DNA, 624 bp, Homo sapiens
aaagacaacaattcctgttctcacagagcttatattctatattccatattttagttaatatttatagttatttttacatattccttaagggaaactgttttttcttatataatcaccacatatcctaataatgtacaatacatataataatggttcaataaataagcataaatatccctgtttaatgtcttcttgtgcaggagcctatgctctataattacgtacaaagaacactcatacattatttaagttagccatagtttaaatgtaaaacctgtcccctgtttgatgtctatgaaggcaggttttgagctcttcaggaaatcttaaatattggccaggggcggtggcttacgcctgtaatcccagcactttgggaggccgaagcaggcagatcacctgaggccaggagttcaagaccagcctggccaacatggcaaaaccccgtctctactaaaaaatacaaaaattagccagacgtggtggtgggcacctgttatcccagctacttgggaggctgaggcagggataattgcttaaacccgggaggcggaggttgcagtgagctgagatcatgtcactgcactccagcctgggcgacacagcgagactctgtcttgggga

SEQ ID NO: 217738 - DNA, 609 bp, Homo sapiens
tcggctgcagcagcagctggtgtatctgtagcctttggagcacctataggtggagtattattcagccttgaagaggtaacaacttttcattgtacagcatgtgcatgcttttgtgtcaggaattttgtacattgcagcgcaataattttgtacataatgtacaatatctgtgtatatcccagtccctgagtgctctccccaacttggtgctttaccatgtgactagaaatccagtcggcagttttcatccattagttgactctcatgcctgcagcacaacatttcacctgaaatagtttctgcgtattgactgagtttgctttctcaccttctttcttctaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgtt

SEQ ID NO: 217739 - DNA, 207 bp, Homo sapiens
ccagctactcagaagactgaggtggaagaatgacttgaacctgggaggtggaggttgcagtgagctaagatcacaccactgtactccagtctgggcaacagagcgagactccatctctaaaaaagaatggctctggaggcagacagacagacctggtttgagtccttttattgctaccacctagctatgtgaccttgggcaaattat

SEQ ID NO: 217740 - DNA, 439 bp, Homo sapiens
tagatagacagatgagatccaagaaaggacaaagacctggagatggactggagatgagactgagaggtgagactgcagtgagagagatgagaaagagaggatcagagagagagagagaggcagcacagagaggttaagtaacttgccctaggtcacacagctgggaagtggtggagctgagatttgaacccagaccacctggttcctgagcccatgctctgaacccccaaggggcagttccgagagagtccaggagggtgtgtggggtatggtggtgtggtgacctgcctgcctgctctggccccgaacttggttgggtactagagggaggagacacttccagccagatgctggtgcctgggaagctgcgggcagccctcgggacccaagccctgctcataggtgaggagaggtgggctgcccagcagtgccttgccca

SEQ ID NO: 217741 - DNA, 363 bp, Homo sapiens
ttatgatacattatcagataaggaaagggaggaccaggggctctgcacttgcctcagggtttgtggctggtgaaggctggaaccaaggctgtgagctctgcctgttgactgcagagaagctaccgacctactcaggcctggggaaggaggagggagggatggtgggagaggaatatttgaaagcaagatgggggccaggcatgatggctcattcctataatcccagcactaagggaggctgagacaggaggattgcctgaggccaggagttcaagaccagcctgcccaacataggagaccccgtctctaccagaaaaaaaaaaaaaagagggtgggaggattacttgagcctaggagtttgag

SEQ ID NO: 217742 - DNA, 234 bp, Homo sapiens
tctgtcttacttggttttgtctccacaggcctgggctatggtagatgcttagccaataacattgttggacagttctcattattagaaatttctctatactgattcaaaacctgcctgttataacctttgcttattggtcataatcatgagggcatgattatggtagagggagacaaaatgattttattgccatatcagccctatcatgtaccccaataaatttttctttatccc

SEQ ID NO: 217743 - DNA, 264 bp, Homo sapiens
agatgatgatggcacatagcccatgtcctgctgtgggattaaaggacagcattaccatacttcaaaaccaaaataccaaattataaagatgcatccaaaagggatatctatcagacattctacctggcgtctgctgctccatcatcactgcatccatcatcaccagaggagtctcctctccttctgtggtctcatgaccagaaaatggaagaagttaaaagcttattggattgacaaaaaaaaaaataaataataataataaca

SEQ ID NO: 217744 - DNA, 521 bp, Homo sapiens
gctcacaggaagaagggcccagatgagactttgggcttggacttttgagttaatgctggaatgaggggcttccccctttgctgggcactcattcttctccttcctgctgccatgtgaagaaggatgtgtttgcttctccctctgccatgattgtgctgctgctgagccaggagaatagaagcgtccaagtcagtgccttcagagatccagctgacttcaagagggctgaggtccacccagggccaccagcatcaggaaggagacagctttgcagtgactccacccgctatgtgctgggaggcattggctgactccaaagcacacagcaatttcggcttggcccacggcagcaaacagctgtgccaatgcccatcctaacgagaataaggcaaggcttagcctgtaatccacccctctgcagaaaccaatcattcctcctcattaccgagtgaagaaatgcctctcaaggctccttttcctccttacaaacaaaataaaacaaatccttcctatggatttca

SEQ ID NO: 217745 - DNA, 506 bp, Homo sapiens
gctcccagctagtctttgtattttcagtgcagacagggtttcaagaccagcctgaccaacatggtgaaaccccatctccactaaaaatacaaaagtagctgggcatggcggcgcacgcctatagtactagctacttgggaggcagaggcaggagaatcgcttgaacccgggaggcagaggttgcaatgagcctgagatcgcgccactgcactccagcctggcaacaagagcgaaactccatctcaaaaaagaaaaaagaaaagttctgtggggacacgggagaagggattatcatttctaaagtctttgcttattgggggacacctgagccttgttggctttgaaagaataaaccttgacagacccacgtctggggacttgtggaaggaaagaacccggaagggatgttgcctgcagcaggaagtgaatcctgagacaacttgttcatagaggatcttgattgtcatcctcaaagagttggaatttttttcatggggcggtggaat

SEQ ID NO: 217746 - DNA, 520 bp, Homo sapiens
ccaacttcatgttcattaaattagtggactcagaaaggccagtttctgtgaaagtatagctgtgaaaatgcaggtaacacaaaatcttgtctagacccctgtgccctaccccctctttatcaagcctgtttataaaaacccaaaaggggttggtattcagttgttttctaaatactctgtgtattttaaaattgtttgcattgaatagttagctaatacaaaataatatataggggggcgcgatggctcacacctgcaatcccagcactttgagagaccaaggcgggtggattgcttgagcccaggagttcaagaacagcctgggcaacacagcgaaaccccatctctacaaaaaataaaaataaaaataaattagctgggcatggtggtgcgtgtctgcaatcccagctattcaggaagctgaggtgggtgaatcactggagcccaggaggtggaggctgcagtgagccgtgatcatgctactgcactccagcctgggcaacagagtgagaccctgtca

SEQ ID NO: 217747 - DNA, 483 bp, Homo sapiens
gtatctatcatgtgtggttgagcactctttagccatatctgttacatagctaaaatgaagcagcctccgtcagttttctgttctacaatttgataaatggattatactcacacgtaggataaggaattggttgtaaatcagataaggggccaaatctcccacttttctgacttcagtatcataatctccaaatatggacttcagccttcaactttgagtcctgcaaaggtatattacctatgcaaaatagattaaatatcagtttttcagaatgcacacatttttttctgctttcttctctcaccctcagaaattcatgccaagatctgccgtctatggttgtgatctgttcctaaaatggccagcgtcatttttcttcacacttctcattctgctgatagacaatttgaggttaaaaatacatagtcattgtgttttcacatttcttaacttctttgtgttacaggaaaggggttctgatcc

SEQ ID NO: 217748 - DNA, 561 bp, Homo sapiens
cctttttctgtttcatgctccctttctccctcaagccagctctgaatgtgtgagcctttgtgccatttctgaatttacaaatccccccagaaggcactcatcatggactctctttctagatctttgttgccagttatggagaaaagaatggacttaactttccctagggctattataaaacaatgatcatctgtcccaggtggttaagcttctataaattctcacaagtagcagaagccaggttctcacccaccagggaaagctgagcattggccttaccactgccaagtgtatttggagccgttgtttttctcttgtgctaactattccttccagccaaaacttaagttgagagaaggggaacaattatcctcattctttgagaattacaaattgtattttaaactggcatattttcaccagttttacacacttttttctctttttcttttttttcagtttggataatagttcttggaattaaaccttggccttggggatatccgagctggggggttaattgttgaattgtcctgagctaacaaaattgttaccaaaaaa

SEQ ID NO: 217749 - DNA, 438 bp, Homo sapiens
cttagtggtcaggatcaattatcccagccagcttagcaattcctttctttgcctgttgattcaaaggaatgaggagcccaaagtggctgcacggcagtcacttccaattcaatggaataactgttgtgtctcctggtagagcacaatgtttggaaacccggtacttatttaaataaggtggtcagagaaggcttttctgaaagaatgacatttgagaaaagatgactacagattcttacaagctaaagagtttggattttgcagtaagtttaatgagatgccaaagggtgttctcagtaggggagtgacatgaacaatttacatttttgaaaaaaacattctggcctctgtgtggagaatgaataaacataaatgtgtttctcagggttccccagagaaacagaaccaaaaaattttaagttacaggatatcaaaaag

SEQ ID NO: 217750 - DNA, 426 bp, Homo sapiens
ctaaaggaagacatttagaaaatttagaatataaatttctgttagtagaaactaatttctcttgctgttctctaaagtatacttgatttgaaatatgtgccctgaagttttgctatgttgaaaaaaatgatgagccgggcgcagtggctcacgcctgtaatcccagcactttggaaggccaaggcgggtggatcacctgaggtcaggagtttgagaccagcctgaccaacatgttgaaaccgtttctctactgaaaatacaaaaattagccaggaatggtggtacacagctgtagtcccagctacttgggaggctgaggcaggagaatcgcttgaacccgggaagtggaggttgcagtgagccgagatcttgccattgttctccagcctgggcgacaagagtgaaactccatctcaaaaaaaaaaa

SEQ ID NO: 217751 - DNA, 585 bp, Homo sapiens
aggtctgcattcctctaggtctctctaacgcatatgcacacacacgtgcacacacacatgcctgcacagacacacgtgcacacacttgcacacacttttcataagggacgcattcatcccttcatcttgcccgcccgctgaggcctgggctgtagctctggctgtgggtggctggcacaggagttttctgggctgggcacttctgctgcagtttgtgcatctcagacctgacttcagagttgcatgtgggcgccgtgctgctggccccttcgctttgtcatagctgcgcccccttgatgtgcctcacgcatcagtgcttggtgtcatttcttgttgaattaatgcatgaaatttgcgtgtgtgtatgtgcatgcttgcacactgctgctactagggaatacagtgtgttaaaagcatattaatacagttatttctattatgagttttctccccttcgctctataaggttattcttagaaaagccatactatttcttttatttctgtttttttgactaggctacatggcagaaatgaagtccttactctgtcgcccaggctggagtgcagtggtgtgatctcagct

SEQ ID NO: 217752 - DNA, 363 bp, Homo sapiens
catggacagctcctccagtggggtctcagactggagagacgccagcgggcgggggtcgttccctggagctcccgcatttgttatggtcgatgccccactacgttgtcaccttctccggaggacctcctgctctgtccttgacagatgggccccagtgggcccacccaggctggagatgaatctcaaagggactccatgcctgggagacctcagccaagcagggcagagaaataatcagacaacagtcagcgcatggcgcctgcagagttttgcacagggtccttcagaaggagggttagggaagacttcttgggggttagggcagttaagcaagatggataaagaaagcaaccacttatgtct

SEQ ID NO: 217753 - DNA, 266 bp, Homo sapiens
aaactttagcttgaaaagtgattattatttgacttaaagatgctttctggagcattcacaagcagaaaaacagcctgtgaccagccgtcaacacagctcttcaccacagcatttcttttcccaaagagagtgaaaatcattagcccatcactgaatgtcagatcatcaaggaacctaacaactttgtttatctctgaggcggcattcaggaatgagttttcaacacttgttgtctgtgggttggaagctttacaaattcacatccc

SEQ ID NO: 217754 - DNA, 297 bp, Homo sapiens
tctgaagtccagacagtttgcctcttggatgaggttattccagccctacctactgctccattgtgccttggcatctttggggattgtccatttggaggggccagattagaaaaggaagagcatgattacagcaatgttttaccagcaaactaggatcatcttgtcctgtatttttgccttgccagaattacctgttttgtctgagaagcaacattaagcacaggagtttggataccgtggaatccagagggcaaatgacccgggtcgtggtgtgtctggctcaagaaataacatttt

SEQ ID NO: 217755 - DNA, 539 bp, Homo sapiens
aaaggtggaaaaaaaaaaaagcaaatggtgaccttgatttgaattacttcataataaactttatacagcataattttaccatccagtatgtctgatgacaggcagccaggactatcaaagctgcaaataatgagtgctttataatacttgaattaattgttaggcactaaacagagaagcctcaaactttgtatttgtcacctaatgcagtggaagcatggataagtctgtgtgtgtgtgtgtgtgtgtgtgtgtgtgtgtgtgtgtgtgtgtgtaagacagagagagagataggggagggagagagagagagagatacagagagacagagtgagagagagagaactctatatctaagagtgatgtattggaaaagaaaggatcttgtgctacatagcgtgggtacataacgcacttgtacagagtgggtacacagacgctcagtgctaagtgtgcaattctaagctattccctgttgtatccctataaaaatgtttgagaggccgggtgtggtagttcatgcctgtaatcccagcact

SEQ ID NO: 217756 - DNA, 242 bp, Homo sapiens
tctatattgacaaaaattaaatcaatttctttgggtatgggagggtcaactaagggagggtctgtggtgaagagtgagaaagggattatgaaaaggcatgaggaaattttgggcagtgagcatatgtttactattttcattataatttcatgggtgtatacatatgtcaaaatgtatcaaactacatttaaatatatgcagttaattttatatcaaacatagctcaataaaacattatttta

SEQ ID NO: 217757 - DNA, 309 bp, Homo sapiens
caaatgggcaaggcaggagctgtttattcaaggacagcttttatggaaaattctttagaactacagcctgaaggaaggtcagtaagatgatttcctgcaagactgtcctctttctgagacgagacagaattaaaaccctgtgcccgtgtctcggcctccatagtctttttcatttaggactgaagtaggttaagggacccatgagcaaccaaattttgatttgggtttttgaaagctagagaaaatattcagtgattaatgttgcacagcagcaaaaatgtgttagaaatagagacaacggcaggaagg

SEQ ID NO: 217758 - DNA, 201 bp, Homo sapiens
gcctactcaatctttggaattacttgaagttttctgaatgttttgtgctctttcataactctaagatcctgcaagctctattagctttcctggtaaatacaatttcccagttcttcaacaattcaggccctgccataagcatttgctgagcatcttcctatgtgccaaagactgcgttcatttcttttttttttttttttt

SEQ ID NO: 217759 - DNA, 407 bp, Homo sapiens
gtgatctgcccgcctcagccttccaaagtgctgggattacaggtgtgagccacaagtactggttttaaataattcctttatctttttatatgactgaaaaattctattgaatatcataggaaaaaaatcacaacaacataggatttaatgtgactctctgatgactatcttgaaaagctaatctaatatcatatcactcatagagatggtttttttgttcctccaactcctttaacatacataatctatctagtagttttcaaccatttgcagcttccatctcaacaagtatactattaaagaatctaggtgccatgcagaataaaatgatttttaaaaccctagtatctttctccagaaaatacatttatatatatttcacacataaaattttaggagattcgttt

SEQ ID NO: 217760 - DNA, 698 bp, Homo sapiens
atcgggaggtggtgggggggaccggagtgtcgctcatcacccaggctggagtgcagtggtgtgatctcagctcattgcaacatccgcctcccaggttcaagcgattctcctggctcagcctgagtagctgggattacaggcgcccgctaccatgcctggctaattttttttttgtaattttggtagagacggggatttcaccatgttggccaggctggtctagaactcctgacctcaggtgatccacctgcctcagactcccaaggtgctagtattacaggcgtgagccaccactcccgtaccagggcgtctccctttgtctcccaggctggagtgcagtggtgcgatctcagctcactgtaacctctgcttcccaggttcaggttcaggagattctcctgcctcagcttcccaagtagctgggactacaggcgcccaccactatgcccggctaatttttggtatttttattagaaacggggtttcaccgtgttagccaggatggtctccatctcctgacttcatgatctgccagccttggcttcccaaagtgctgggattacaggtgtgagccaccgcacctggcctgtgtactttttatcctatccgtttcctccccaacaagaagattgttcttgcaatcacactcctttttctttttctttttttttttttttttttttttttgttatgagaca

SEQ ID NO: 217761 - DNA, 1138 bp, Homo sapiens
tcttgaattagatagtattcattggatgcacaactctgtgagtactactaaatagcactgaattgtgtacttctacaatatggtatataaatttatgatatcaaacattttttaacttttaggttcaggggtacatgtgaaggtttgttacataggtaaacacatgtcatggggctttgttgttcagattatttcatcacctaggtattaagctcagtacccaatagttatcccttctctctccaccctccagataatttttaaggttgagtctaagtaaggctgcttgggaaatggtcagctaagtaaatcacctttcatttcacataaggcccttaatatagataagtaaatttggcctttggtgtctcgtgactctcagaggcgtaggtagaggagcaaattaatatttgcagcatgggaattccttatcagaattttgaggggaataaatcctcatcagagacaaaaggacttaatcatctggccacctatcacttcagttctctgtataaatgaaatttaattctaacaaccttataaaaagaaggtccagacagcagaggaaacatcctgtccaattctaggttttcctcccttggcctcctttccccagcattgtctaccctggcccacttcctgcattctccccatgccctgctatttctgattctttgcttctcctagcgagatactttccttatatgatagctgctgagaagtttcccagaactgctagaggaaaagaagtggggaatttaggaaatatccctcactgacctaactccattatcttcactctttccttcttcctgccacctcatgcccattctctttactgtctagcatgctgaaagaaggaagtgatctaaatgccagcgtgttcagtggtaaatattagttggtgcaaaagaaaaaccatgattacttttgcactaacctaatagctttgcaaattttaagaacttgctttatgaagatattcggatatggattctccccaccccacatacttagacattgttcaaatatactacttttaaaaaaacaccttttcaaacagaattagcgttttgccaagtctggtattaatggaattgtacaggagctttgaaagttttcaaactttattaaacta

SEQ ID NO: 217762 - DNA, 738 bp, Homo sapiens
gtgtatggaggttattatttgaagggtacaatcactacaacatgctctgccacccactccttttccagtgacactacttgagccacacactttcctttacaggccagcctctggcgcttgctgcacctcattgccaccttcctgtctctctgtgctaaacattcaggacagtgttccacaggcagatctggcctatttcattagtcaccatggcttggctgtgaagtacgttgaaggtggatcttgtcacatgccccttcagtgttcacctggccctctggtttaagttctgtctgccttacgtgactgagtttgactgtccaggttgctttgctcggtgaagagaggagggtaaatcggattctcgtttagcactgggttatacagatctggcaccctaacctaaaccaaggcatcttcactccaagagcagttggagagtctgggttagccttacgtggacctcgccgctcgctggcggtcacgattgtgagccctccagataatttttaaggttgagtctaagtaaggctgcttgggaaatggtcagctaagtaaatcacctttcatttcacataaggcccttaatatagataagtaaatttggcctttggtgtctcgtgactctcagaggcgtaggtagaggagcaaattaatatttgcagcatgggaattccttatcagaattttgaggggaataaatcctcatcagagacaaaaggacttaatcatctggcc

SEQ ID NO: 217763 - DNA, 661 bp, Homo sapiens
ggctggaggtggtaaatccatgtctaagcagaacagctgtgtacgaggaggtccctccttaagcacagtttgcctaaacagctctgaaccgggatggtgccctaaaagggcgtttccggagtttagggtgagaacttaccactgtgcctgctagtgggggccttgagcctgttacatgaagaggagaatcatttgggagcctgcagcagtgattctgttctttcagagcgtctgtggattccctctgcttttctgcctgccttgccattgtcaacaaatggacctgattacacttgtacggttcaactctagttgaaaagaaaataagcctctgaacaaataagcatttgttcctccaggtagcctgtgatgccactgcagtggtggatgttccctgaacacgctgtgcattttctcacctcagggtcttcagtcaagctgctgcatctatgtggaattccctgtctgtctccaccaactgccaaatgcttgctgatctttcaagatggaagtgaaaggacactacctctcctaagctttccctagtgccttcatgtaccaccaacccccaagtcaaaatttacctccaccacctcagcactttcataacctctgcctgacctctactttaggacgaaataaaacttatcttgttctatta

SEQ ID NO: 217764 - DNA, 419 bp, Homo sapiens
atactctcccacccaactccaggccacatcaggaacacctgctaacatttcctgaacactctttttgagccaggccctgtgtattttagatgcggtttcatttgatcttcacaggagccctatgaggtaggcatccccaaccccactttatagatgcaaacaactaaggcacagagaagttatttgttcaaggtcacatggctactaagcaacaaaactaggatgcaaaagcagatttgttcgaccccacatgctgtgtgctttgctacaatccacactgtctcccaggccccacagagccccaaatgcatgtgtctcaccagtttcacctgtggccactgtgctcagctatcctcatcctaagacaattgtagttatggttaaggaaagccttttattaaattgccaaacaccaggga

SEQ ID NO: 217765 - DNA, 145 bp, Homo sapiens
acagctaactggagacaggactcatgcaggaagcaacgacacatttgacaaacagtaatcatcattgcatttacagagttctgtatgcaccttttaaactttgtcatctttgaaagaagcagtatggcctttattagtgggtagc

SEQ ID NO: 217766 - DNA, 421 bp, Homo sapiens
tgtatttaggggaagctggccacattgtaagaagtcggactatgctgagactgtcatgatgacagaaaacccaagctagccaggtggagagatcacacagaaagagatgcctggccagctgttacctgatatgccatcatgcaagaagataaaggaaggacagaggttaaactaagagatgcagaaattatagtatatcagccaggtgtggtggctcatgcctgtaaacccagccctttgggaagccgatgcgggcggatcacgagatattaatccaaggaacaatactgacgaatttcacggacaaaatactaagaaggaaatcaagtgaatcaagcggagaagaaagacagtggaaaaagaaaactgaaaataaaaatattttctagaccccttgaaataaagtttgaaaaaccacagt

SEQ ID NO: 217767 - DNA, 529 bp, Homo sapiens
cagcaggatttcaagtctacgaatatttaaaaatcaaacctccagtgcaggagttttgcaatttaaatgggtgttattattgagcgtattttcacagttacaaatcctaagagatgtataaaaatgctggcctcattaaaagaaaaagtacagtttagaaaatgtttgtgaaaactctgaggatggtggctctgcattctgccccataaagcactcagtgcgtgtggattgggtagtgccttggactgattagaaggggtcattttcccctgatggcaattgttgcctatgaccaattggattcccactttgcaaaggataaggccacccaaacagctcctttgactctggtgggctcatgggaacgaggcttttccccctggagatctgtttcctttgcagggtagcttagcagaaagagctccaaatttgggcgtgattccttgcttcagcgcattctagctatggcccttgggctagctgctacactactttctgagtcccagcttgcttcacttcctcggttgta

SEQ ID NO: 217768 - DNA, 772 bp, Homo sapiens
cacgtaacaacaacacccacatagttaagaaaaaaaaatgttaatgtatgaatatcttaattttccccgctaccgaggttttggcaaacgtctaatgacacagagccaccattgccaatttcaccactgtctttcaccaagttgattcattttgaactggctccagcaatctactcagagttgacctcagagcaaaaaattgaacaacagctccatatgttgatgtgaactgtgactccaggagaacggtggaaaagtgtcttgatccaggaaggaaggggtatagagaaaatatgagtctcaccacactagaagcaacatatgcaaaatccatcaaacacaccataaaatcaatgtgggagtaacaacaccttggcctactgctccctgaaaagtttttctctcgtcaagtgatgacaggcgtacatttgtaaataaattaccaagttgcttttgatttgatggagaaggaagaaaaggattgtctcctggaagtatttttattgtcttaataggtaggataatatctctgttcagcaaactgagatcttttgagaatcttaacaaatgtatacccctccctctcaccttttcctctctggtgtatttcataggcagctttgctaactgactgcactactacaaatagattctgtcactttagaaataggatttttccttttataggcagattgatggactaagtgtcaaggttttagaacagtagcatgactggggcagacactataaaccataaatccagtattgacaa

SEQ ID NO: 217769 - DNA, 636 bp, Homo sapiens
  misc_feature (28)..(28): n is a, c, g, or t
cctagttgtaacaggctggaagtcctgnatcaggtgctatcagggttggtttcggctgtggcctctcttcccggcttgtagacagctatcttctcgcagtgtcctcacgtggcctctttgtgtgaagttaaaaatgaacagatcaaccttttactcttctctggaaaatatagtgaaattaataatcaagagcgattttctgaaatgaaaacatccgaacagcatactgcaaagacattcaggggaaaataaaataggttttggcaaacgtctaatgacacagagccaccattgccaatttcaccactgtctttcaccaagttgattcattttgaactggctccagcaatctactcagagttgacctcagagcaaaaaattgaagaagctgctaaagaatgtgcttgactaaaacaaggcaataagcaaaaggaagtcatagcatccagaaaatgggatccatcatgcgcacaaagaaaaggtgaagaaaatttccaggatgttcagaacccaccaaaaacgaaagattctggtccagatcagaagagagggaaacactctgaaaaagtccctcaaatacaaaattaaacagagtttaaatgatgtgcttgaccacaataaaaggcttcttgctct

SEQ ID NO: 217770 - DNA, 506 bp, Homo sapiens
  misc_feature (28)..(28): n is a, c, g, or t
cctagttgtaacaggctggaagtcctgnatcaggtgctatcagggttggtttcggctgtggcctctcttcccggcttgtagacagctatcttctcgcagtgtcctcacgtggcctctttgtgtgaaggttttggcaaacgtctaatgacacagagccaccattgccaatttcaccactgtctttcaccaagttgattcattttgaactggctccagcaatctactcagagttgacctcagagcaaaaaattgaagaagctgctaaagaatgtgcttgactaaaacaaggcaataagcaaaaggaagtcatagcatccagaaaatgggatccatcatgcgcacaaagaaaaggtgaagaaaatttccaggatgttcagaacccaccaaaaacgaaagattctggtccagatcagaagagagggaaacactctgaaaaagtccctcaaatacaaaattaaacagagtttaaatgatgtgcttgaccacaataaaaggcttcttgctct

SEQ ID NO: 217771 - DNA, 430 bp, Homo sapiens
cgagatcacaccactgcattccagcctggatgaaagagtgagactctgtctcaaataaaaaagtaaaaataaaatatacccacaaagcttcacaatgaagtcctaaattggctatcataaaatgatgaaaagtgtgatgctgtgggctgtcagggaaggggagccagaggtcattattgatcagagcgaacagggaaggtttaatggaagacaccctgaatgatctatcaggttggaattgctgaaatggagtgccaggcttcaggttgcaatacttcttgactgttaccaaagaataatgagttgggtatcttattggcatggtgtatattgcctcttaatttgataaagttttgtttatgttgtattgtgtcctagtctttgatttaataatccagattgagttcaataaagtatccaagttctacca

SEQ ID NO: 217772 - DNA, 429 bp, Homo sapiens
ttatattttctctttgtgaagttaactgggccataagaagatcaattccatgcatgaccttggcctcattgccactacactacaattaactgagccaattaggcagaagagttctcattatattttcttataagttattcctagtaatttgatatcattatttatatttttaaaactaggaccagtaatttctttgccagttccaccagcttagctatatctcatactttactttctccctccttacagtagaagcctcctcctgcatctgtattagacaaacattgcagccctgaattgcatggcctctggccccttcgaaggcttacctgtggtattacccttcatctcctgtatcatcagtgttgtcttctccacttgatcattgtcattaagtcacttgtcttaatgtctgtcacctacttttaa

SEQ ID NO: 217773 - DNA, 442 bp, Homo sapiens
tgcagtggcgcaatcttggctcactgcaagctccacctcctgagttcacaccattctcctgcctcagcctcccaagtagctgggactacaggcacccaccaccatgcctggctaatttttcgatattttttagtggagatggggtttcaccatgttttgccaggatgatctcgatctcctgacctcgtgatccacccacctcggcctcccaaagtgctgggattacaggcatgagccactgcgcccggccaacttaaaacttataatcagaggttcaactcctcttcttaacagtatgcctataattaaccttctcctactcatcattcctactctaatcactatagcattccttacactcactgaacggaaaatcttaggctatatacaactacgcaaaggacctgacattgtaggtccctatggactgcttcaaccattc

SEQ ID NO: 217774 - DNA, 376 bp, Homo sapiens
aggactgtagggacagagaaggtggggtgcctttcctccccatcataaggatcacagctgacatgcctgtagaaaaaggttagcaagagaaaagcataacgatttatttaattaaagttttctgtgacatgagagtcttcagaaatgaagacccaaagactcaaggaaaactctatttttaggcttagattctatgaagaccatggaaatgcgcagaaatgtgagtggggaaaaagggaatggtctaatagtaataaactgagtgggaaacccagcaaggcttgtctgttcgtattcttcttggcctatctgtggccaaaccacctggcttagaagcagaaaataaatttgctccctgtgtagtctttaacatgtt

SEQ ID NO: 217775 - DNA, 799 bp, Homo sapiens
taggacaaattaagcacatgaaattagaggctttatgttttgagggaaacttaccaatttttacaattgatagaatatctttttatagtacttcagtggctagcgaatgttgaaaaataaggaacaaccttgttctaggtttttcttaatactattgacaatttttatgttttaaaaaccagggcaacaaaaacaaaaccagagcaacactgcaaaagacaagtattacaggattgattctaagtgggtagggcaggcatgtccacctcaggaagtatgttaatctcctaagttttcttgtttttatgcctttaacacaggtcttccctcacctatacttactccccccaaaagactaagatctaacaaggctataattgggtcaactgccttcttagttctgaagaaatgagcaaattgcctttctttaaagcggcttcttacgcctgcagacattcccgcctttctttaaagctgctgcttacgcctgcaaacattccctgagtagcagttttgtgtcctgtcatggtgctaggtcctggggactacaaaagtaaacatgactcatttatctccagaagttcacaggccagagtagcatttctaacctcatcttccttagctatttgctatctcaagaaatgttaatacattttcgtgataaaaggggttacatgttttcttgactctagtaacactgaatgctttatctccgtctcgttgactgcaccaagaagtctttcaataaagaatgcagcctaactttttttaatccaataattccctagcttatttgaga

SEQ ID NO: 217776 - DNA, 623 bp, Homo sapiens
atcctcaatgagattatcagcagacttcacatcagacactctggaggtcatatggcagtgggtggaaatactcactgctaaaataagacgaaaaaaacccaaacctgtcaactaagaatcctatatccagcaagacagtccctcaaaattaagggggaaattaagatgttctctgatgaacaaaagctgagggagtttgttatcactagaactgccctgaaagatgtgctaaaggtagcagttcaggttgaaatgaaagaaaactagacagcaactcaaagtcatatgaagaaataaagatctcagtaaaggtaaatacataggtaataataaacactagttagtaatattgtaacaatggttatgtaaatctgcttttggttttccacatgattgaagagaccattacattttcaaatttaaaaaaaaaaaaaacttagcctagccaggcatggtggctcacacctgtaatcccagcacttcaggtggccgaggcaggcagagatggcttgagcccaggagttcaagaccagcctgtggaacatggtgaaaccccatctctacaaacaaaacaaaacagcaacaacaacaaaaattaaccaggtgtggtaggcacatgcctg

SEQ ID NO: 217777 - DNA, 335 bp, Homo sapiens
accagcagcatcaaaatcatctccgatgttagatgttacaaatacagtcttcaccccagactctgaatcaaaaactgtggatagagtcaggcacagaaagacaaacttcacatgttctcacatatttgtgggagctaaaaatcaaaacagttgaattcctggaaatagtaaaaggatggttatgagaggctgggaaggggtagtaagggggtgaggggtaggtagggatggttaatgggtccaaaaaagaataaaatatagtatgtgatagcacacagggtgactatagtctgtaatttaattgtacattttaaaataaagactatataactgga

SEQ ID NO: 217778 - DNA, 279 bp, Homo sapiens
tgcccttaatcctaaccctggttattccggttcattggtcccaaggctgctgaggtgtgcgcagggctggagcacatctgcccgcctgtctgtctctggaggcaggcagagaagggctttgtctgaggacgctgttgttccagcttggagatgtcaccggcctggaggtggggtgtggccaggccgtgccttcgcaagcctatgggggtcactctgagagccgtccttagggatggggccagctctgtgggcaccaccacatggggcatggggtgggcg

SEQ ID NO: 217779 - DNA, 486 bp, Homo sapiens
catccttgaaaacccttctgactccagcctgtcaattaccattgttccattttacctcgtgatttcctaattatttattgagtctgtctcttttactctttctggtactattgccacccctcttccagtcttggatcccctaaatccattgtacttatttactatttgcagggtgaagtttcctactttattcttctgcgtaaagccttctgatatctacattccctatacaaagccaggcattaacaaagcctgtaagatccttctaaactggcccctgcctacttcccctctctcttcttcactggctggttcttaccctctaaattctagcaacttcaaatggcttttcattctctgattccacaacactgcctcccacctcttaggagaaccccttttttccttttttctctttgactaatttctgctcatctgtcattcagctcaggcatcactccctttaggaagctgtggatttgaatg

SEQ ID NO: 217780 - DNA, 620 bp, Homo sapiens
tttaaaaatgtgagccagttccataaataaatccaaacccctcatcatgggttacaccttcaatgcttactccatgccagactttgtctagctacagggagcttgcaaaaaataaaaaaaaaaaaacataaaattcaaaagaaagaaaatgaaaatagagcactccaggcaagggaacagcaagtgcaggaggaaggtctttaagtaaaaacaatgaatccccagcagtctgcaccaggatgcaatccatgcactggttccagagagacttacaaaaacaattagtaatttaaggtgtctgaaaattttggtgcaaatatatgttatcttcatcaaaactacgtacagtacacttaggaaaaaagtttagtggcaagcaacttcacattcaaaaatttgtacatgtatgaatacaaaacatgtcccaattcacgggggttgcacttctggtctgactccttccagcctccgaggaagcttggaggacatgatgcaattatgttttcattccttggccactgctctggtccagaagtcgtcttctggaaacaagtgttcttggttccaatttacccatatcttccttcctaaagtaaatccctacaacaacccatgctgat

SEQ ID NO: 217781 - DNA, 347 bp, Homo sapiens
tgtaatcaaagagcaatgccacatagctttgtagggaagggattgacatctcctgaaaaatgcagacagtcccggctgggcactcgtggctcacgcctgtaatcccagcattttaggaggccgaggtgagtggatcacctgaggtcaggagtttgagaccagcctggccaacatggtgaaaccccgtctctaccgaaaatacaaaattatccgggcgtggtggtgcatgcctgtaatcccagctactctgaaggctgatgcaggagaatcatttagaacccgggaagcggaggttacagttagccgagattgcatcactgtactccagcctgggcaacacggcagca

SEQ ID NO: 217782 - DNA, 486 bp, Homo sapiens
caaactcctggcctcaagcgatcctcctgccttggcctcccaaagtgctgagattacaggcatgaaccaccatacttggccccagattctttttcttttggtgaagaaactgaggctcaaggaagttaattaacatacacaagattaccttgagtaaataaatcgttatgtcaagatttccgagtagcacggtgctttggggatgaaaattttaaatttgagtttcctattttacaacttgtttagaacccagcgtctttagtctcgaggccctgcggacacagattacttttcttggctgggtggtacgggctagctcattgtcttcatccatacctatcataggtggagctcttcagcctgggtggttttatttggaatccacccacttgctctggggcaggagtgaaggaggcagtattgtactgaatgtgacgttagttatccacactgtgaaactacctccttttaaagccctgggagagg

SEQ ID NO: 217783 - DNA, 470 bp, Homo sapiens
ataaaataaaataaaaagaaaaagtcaatcttcctcagtggtgtgctggtaaattggcactgtaagaaaaaaaagtcttgattggtagagttggccagtttcatattgtaaatacattgcccctggccaatttcaggcacccatataaggtcactgaaggaggagttggaaagagatgtgcatcgtcagcatggagtcctgataagtaagcaacaatgaggaagggaccttaggtaggggagaaccccaggtggggaagaacaatgaacagttgttctgagagatggctaatcacaaataacctgtgggcacaatgacttgtcctgtccgcaagtggccccaagagcagaaccttataaaacttccctccagcccctgcctcattgtagacagcccatttcctgctgtgctgcctgttgcaactttgcaacatatttttatactttctgtaataaatctgtctttcttta

SEQ ID NO: 217784 - DNA, 651 bp, Homo sapiens
tgtggaaatagatatcatttagccatagtctgtttcccttagatattttatctaacattgcctgtttctccaagactattacttcaggaggggaggagggagccaaattatttcttttttgatatattattgaccattggtctctgagaatatccgagattgttaacatctaatagtgccttggcaataattagaggaagttcgacggttgtgttttgtatttttctctgaaggagtgtgcaagagtatgatgttgatgtaaacattgtgatgagcaggttaggagtatgtcaggaacatggaatgcaatcctatgtctgtattgcttgcagccttgaacaaaatcttcaacatcttgatgcttccaaaatcgcatttaaaaaatgaagcctcccggccgggtgtggtggcttacgcctgtaatcccagcactttgggaggcccaggcgggtggatcacaaggtcaggagatcgagaccatcctggctaacacggtgaaatcctgtctctactaaaaatacaaaaaattagctgggcgtggtggtgggcgcctgtagtcccaactactcaggaagctgaggcaggagaatggcgtgaaccctgggaggtggagcttgcagtgagccgagatcgtgccactgcactccagac

SEQ ID NO: 217785 - DNA, 434 bp, Homo sapiens
gtggaggctgcagtgcatagtgctatcccagagatctttttattcttattttttattttcggagacagggtcttgctctgtcacccaggctagagtgcagtggagtgatcatagcttgctgcaaccttgaactcctgggctcaagagatcctcctgccttagcctccccagtggctgcgactataggcgcattgcaccgcacctggctcagagatctttctgaagctcactctacttttcctgtggttctagccctttccttcctgtttgaggctcccttagggtataaaagtcactctgcagcgtctcctctagagtaaataaacaattctcttgaggtccttttctgccccaaccatttcaccttctctgtgtctttatgagcttgacttaacaggaagttcaccttctggcttctgttaaatagtattgtc

SEQ ID NO: 217786 - DNA, 628 bp, Homo sapiens
ataataattaccacattatgaaaggttgaatagcttttatcatcttttctgatggagatagcttcttagtagatgttccatgtagctataagcctgcgtataaatgagttcatctcaggttgtgaaaaacagtttactaaaatcagaatctaatcaaaacagatgtaagcttttagggtcattaatttccattaaatttccatggagacctatgtaaaagctaaaaataccatcagtgaattacatgaaatgccttcttcagtgatgtgcaatgtggtaagagaaaactatgaagctaaatacttatccctaatctgcaagcttgtctaaatgaaaaagtggataatctcattagttggaattgttaacaaaggcataggtggttttctcccatccaagtactaagcaggcctgaccctgcttagcttccaagatcagaggagatctggtgcattcagggtggtgtgaccgcagacagcataggtagttttatatacacttcctgtagaaccaaccagagccgtgattaaatagcaaccgttagatgtactttgaaaaataattgaatactgtaggaggcttaccttgatactggtttttgagcatgaatgaaaaaggtaaattaggg

SEQ ID NO: 217787 - DNA, 595 bp, Homo sapiens
ccagcccttggctttctccttgggtgcccagacaactggtggagaccacgccagatgctgatctttgctttctcactacacacactgtcaggaggaccagttgtgagacttccgcaagtggcatcaggtaggagatggaggaggagaggcagaactggcaggtactatgctgtgaccacatacaacagctcccacctaacttgaggatgccaagaaatatggggctctgcgagagactggttccctgctgggtcaggtgggcagcagcatgatgtactcacctaatggcttcttcctgcccactacacaaaatcaattcactgagaccatggtgttgcaatagagaaggagtttaaatgacctgaggccagcccacacaggacaactagagttatcactcaaatcagttctctcatttactactcttaaaggttacattaggtatgttttattattcttcccattttgaagcttcggatttaacatcctgcatgtgattacacagctcataaacagtaaagcaaagtttcaaacacaggtcatcctaagtaaaatattaaaatacttaattgatcaataaaaattgtatatatcc

SEQ ID NO: 217788 - DNA, 421 bp, Homo sapiens
agttattgtttgagcatgtctattctttagcaaagttcaagcctctaccataattctaatcttgtcttatgaatgtagcttcaatctccatacaaggagttggggtggggggtcacttttccttgcctcaaagtttaactataaaccaaattcctggcatagttattttagcctccacactagaataagcaaaaaacaaactaacaataaaacgacaacaacaaaaaactagtttagcctgtgaggttttgagcaaaatggagtcagtcatgttagatttctctcattagttataattctgcaaaggtagtttaagtgcccctagatggagtttcaccacttgtggtttggtgctgcccaattcatgaatcactgtctgctcaactgaactgtttaatactttaatgtgtgttgtctttta

SEQ ID NO: 217789 - DNA, 528 bp, Homo sapiens
aaaatgtcaccaggatcttgaatctgaaaatttgggcattacacgaaaatcttcattttacattagctttaaagttaaggaaatgctactaggtttttagtctcagctggttcacacaacacaattcagaataatgtaaagagaatcagtcactgaaactgagtatctactttcactgagtaaaaaatccaatacaaccacagacagcatccctaataatatttctgaacagttttgttgagatataattcatctaccacagaatttgtccatctaaaacacataattcgatggtttttagtatactcagagttgtgcaaccagcaccacaatccattttagaacactttcgtcaccccaaatagaaacccatactcattagcagtcactccccatcttcctgccttgctctcagcctcaggaaaccatgaatctattttctgaatctatagatttgcctattctggacatttcatacaaatggaattaaatagtaggcggtcttttgtaactggtctcttccactca

SEQ ID NO: 217790 - DNA, 422 bp, Homo sapiens
agttggtattttatggggtctgattcagcaaggaaagtttgctgcaacaaagaatgacctccaaggccacttcaacttctagaatactggcttctcaacaagagtggcctggaaaagctaaagggggagtctttatcatcaaggaactaaagggggtatggagggatatagagcaaaagagtgtttgtcaccagtcaaagccgatgtgttaaaacccacttatccccatagccacacttccattacagtttatctatggatgccagtgacctgcaagaggctccttctccttgttcaagtcactttgggcttgttagctctatctcgaagaaggggcaaggataaacctctacccatgcagaagctgattttaccttttgctcttcctttctgactgcttaaaataaatgtatcattacctg

SEQ ID NO: 217791 - DNA, 270 bp, Homo sapiens
gcactgtgctggggaaaaaatatgattactcaattactttttaaggagtgaaggaaaagtttgtggatcctagtaattttccagaaacattttttagaggcatagcacattcatatcgatgctgcctcctccctcttccccttcaaaaagtttgcattctttaatcaccgtatgttggactctcacaataacccttatagtttacattttatataacaggtattttgaaggttgcttctgggagctgaatgacaggaagtacctgaaagt

SEQ ID NO: 217792 - DNA, 675 bp, Homo sapiens
attgtgatagtgctgcagtaaacatgggagtgcagatatactgatttccttcaatatactgatttcctttcttttgggtttatatctaggagtgggatccctgaatcatatggtagctctatttttagtttttcggggaaactccaaactgttctccatagtgattgtactaatttacattctcaacaacagtgtacgagggtccccttttctccacattcttgccagtatttgtggttgctgttttatgtgtccggttttggggttttttgtttggagacagattttgtttatgttgcccaggctgaaccatactttatacttctacttctattttatagtttgtggtattcttctgaccttcattttaactctgtccttcctttcaggctggttcaaactacactgagccttccctggtcactaaaacttgtggcccttcctatcctacacctcatttactatgggctctccatcttttggtccttaaggttcttctcaggttcttctcagcatgtcctttgtggtgcaacagcattaggcatttctccaaaagaacctaggcatagtgctatatatagtaggtactaatacttgttgaattgaattgaatttctgggcctgttttcttatctgtaaaataaaaggtatagactagacagaacaaagatctct

SEQ ID NO: 217793 - DNA, 467 bp, Homo sapiens
gctgttattgttacttaatgtacttcctggttatattctggcaacaagtgggttccaccttccctcagaagcctttttaaaaaactgtcttgtttatacatattaaaggaagaacaagtttactattccaagtagctcctttcgattattgattcattctgcctttaattccttcaacaaatactgacgttttgcagaggtgatacgggatgttccaatacagacgtggtctctgtcctcagggatctttcaatctagcaaaggagatagtatgagacaaataattttgcaaataaatatatagttaccaattgtgataagtgatatttaggaaaggcacaagatgccttggggtcataaggtggaaaggtggatctaatttagatcgggagttcaaggacagcctctcagacagctgaaactgagaactaaaggatgaatttgcaattaacaagacctgaaagcat

SEQ ID NO: 217794 - DNA, 390 bp, Homo sapiens
tctatctcctgacctcgtgatctgtccgcctcggccttccaaagtgctgggattacaggcatgagccactgtgcccggccgtaagttctttgatttcacagatgatacattaattttttctgttataaagtgcttaacatactattacaacaaagttcttagtaaatttctattgttttctttgatttgattatttttgtttcccttcaagttagtggttctcttttctatgatgtatgaaatggagttcattgttaattggggtgctttttcccattatttcaatttggaataatttggagttgttctctcgcaattttagatctccgtgtcttactacctgacatgtgtcaaggcaatccaacttaatttcattttactagtgacaag

SEQ ID NO: 217795 - DNA, 472 bp, Homo sapiens
tccctggggactgcgcttctagctgcctctcccgacactagcagctccaatccatctcctttctttactgctttcaaatactcagttcctcttagtacaaaacatacccactcactctaattcctacatattttttggctctatgcttgcttgagtcgcccatgccttctaggtttcatcaaatattttttgtggaccaatatcgccaccaaaatgaagtttatatcactcaaagcggttttaatttacttacaggacacattttttttcctccagattacgaaaatcacctaatattctgatgctgttttctcagctattcagttaaaggtatatattttgtatatatatgaaatcatactatatatggaatttatatacacttctatatatggctttgctctatctcaaaaaatctgtccttatgactaggtctgggccctcggcgtgtgcaggggatcactctagagtc

SEQ ID NO: 217796 - DNA, 858 bp, Homo sapiens
aggaccatcagcactggcttcttaaaaacacagaacttcaggtcccacccttgacccacagaattagattttgccatttaactttatactattactgtttccccattaagattttcttctctttttttttttttttttttggagatggagtttcactcttgttgcctaggctggagtgcaatggcgcaatctcggctgaacacaacctccgactcctgggttcaagcgattctcctttctttactgctttcaaatactcagttcctcttagtacaaaacatacccactcactctaattcctacatattttttggctctatgcttgcttgagtcgcccatgccttctaggtttcatcaaatattttttgtggaccaatatcgccaccaaaatgaagtttatatcactcaaagcggttttaatttacttacaggacacattttttttcctccagattacgaaaatcacctaatattctgatgctgttttctcagctattcagttaaaggtatatattttgtatatatatgaaatcatactatatatggaatttatatacacttctatatatggctttgctctatctcaaaaaatctgtccttatgactaggtgtgatggctcaagcctgtaatcccagcactttgggaggctgaagtagatcacttgagcccaagagttcaagcccagcacaggcaacatggggagaccccatctctaaaaacaaattttaaaaaacacacattagccaggctaggcatggtggctcacacctgtaatcccaggactttgggaggctgaggtgggcagatcccttgagtccaggagttcgagaccagcttgggcaacatggtgaaacacc

SEQ ID NO: 217797 - DNA, 475 bp, Homo sapiens
tggtagtttcccatgaattaataactttccttcttgcccccgtgttatctccctcacctgacccccgccaataaaacatccttaaaaggctcctctcaaattccttgcaaatattaggctcctctcaaattgcttgcacatgcttggagaagctcacagtggttagtacactcatacacaactgaacttgagcgacacaaagcttacaagacagcaaagacaacagcaaagctgggcccagcagccatcacctaaagaactcttcactcgttacattggagcaggtgatctctctggaaccaggaaccacagaacactgaaggacacggagctggtggctaaggattcaaggcctgcagtgaaaatgtaacatttccctccaagtgcttatttctgctataaactggtttagttttgcaatgaacaactagatttctaactgatattcacgttaataaacttttcttttttaaga

SEQ ID NO: 217798 - DNA, 841 bp, Homo sapiens
aatgtatttaaaggcaggaggttaataacaccagttctcagtggttcctaccaggatggctgaccatgtttggagacgttactggttatcacagtggggaaaagggtattactgacacccagtgggtagaggccagggccgctgctaaacatcctacactgcacaagacagcctttcccaccctcaaaaaatcttctagcccaaaatggcagtagtgttaatgctaaaaatccttgacctaaagaaaagcaagcagagcagagctgactgagaagtatataaaatggcacttagccaaaaagaaaaagatcactaaaagtttataatatgtgcaaatatcaacataagaacacaggaacacaaaaacatggaaaaaaaactttataaagaacatttccaatcaaattcctcctccatgccctagaaaataaagtcgttgagctaggttactaagcattcccctagagaacgtgtactgtggggaaaacactggtgattctcacctgtctcccagagtggctgccctgtgtctcatccccaacacctacctctaaactgcaagtcacagttacagctttgtggaatgaaaaaactaattaactttattttttttcaggcagagacttgctctgttgtccaggctggagtgcaatagcgtgacttcagctcactgtaacctccgcctctcagttcaagcaattctcctgcatcagccacctgagtagacatgaggaatataacaagcaaccacaccagaaagaaagaaatgaatatccatagtcgacaacacagagtacactaagttccccctgtctactgcagagggaatagtactctcgag

SEQ ID NO: 217799 - DNA, 804 bp, Homo sapiens
cctagtggctcccgcctgtaatcccagcactttgggaggccgaggcaggcagatcatgaggtcaggagatcaagaccagcctgggcaacatggtgaaaccccgtctctactaaaatacacaaaaaaagtcaggtatggtggcgcgccggtattcccaggaactcacaagaggctaaggcaggaggatcccttgaaaccgggaggcaaaaggtgcagtgagctgagatcgtgccactgcactcctgcctcagcaatagagcaagatcctgtctcaaaaaaacaaaaaacatgcaaaaaacacagctattgtgcctgtgatgaacgtgaatttggaggtgaaatcatatgcctgctgtaaggacatcacaaataccagtttatttctacagatgactttctcctatttactctttcaacattcgctctacaactgcagtctgggttatttccttcctgaagagtaggctttagtcattacatttcttataacttacacaactctagacttattctacccagtaaaactgatttttgcagcattctagacctgcactatccaattctatagtcactagtcacatgtggccactgaacttaaatgttctactgaacagcaagcaatgttctagtttgttgcctccacaaacttccatctaccgcttatatgtaattaccagagtccagtaatctataatttactgtctattacaaaacccataatccttaaaaactctacaaaacgacttagcacaaatggatagttacatatctcctataactacagagcaggatggtggaattata

SEQ ID NO: 217800 - DNA, 598 bp, Homo sapiens
attctcagcaaccaatccaaagccaccaagtcaacctgagctgacataacatgaaaggccctctgctttaacccatacaaggaaagttaactgaagccatctgatgttaaccaacccacttttggcatgacaccatttccttcttgcttaagctaccttacagaaatcgactgttctgccaaccctggaggaatgtctttccattttatgaatgggatgctgaccaactcataattgctaataaaagctaatgagatctttaaattcaatttgttgaaatattgttctctgtcatcctctaccccatcacctgtgctcagcaccacacctctgcttcactgtgcccctttattatttttctaaagctgaacaaatcacatgggccccacagttagtgtttaccttatgcaacgacctgtgtggcccctatcagagcaaacagagaaacagaaagatactcttccccccatattaattcctcctctgctcaaaaatggcttaaatttcttgaatttcttcaagccagccaaatgacaatcacagtcattatctaaatgcaaacccttctgagatagtgctttaattcacagtaagattc

SEQ ID NO: 217801 - DNA, 374 bp, Homo sapiens
ttgtagagttcagagctttgggaagtatgaccagaggggaacagaaaggaaaataggaataggctcaggaaatgccaatggtttttattcatttatttttaattttcattttaattatttttttagggacagggcctctctgttgcccgggttgaagtgtagtggcctcattatagctcactgcagccttggcctcccaaagtgatgggattataggcacgaatcaatgtgcccaaccccaccagtggtttgtgtttgttttttgtgacggaatctcactccatcgcccaggcttgacccaggaagtggaggctgccgtcacccaagatggtaccactgcacaccagcctgggtgacaaagtgaggccctctct

SEQ ID NO: 217802 - DNA, 404 bp, Homo sapiens
cctcactccccagtttcttcaaaattaatattttatattctgcatacacaaattccaatttggaattttaaaaatagaaatattataataatgaagacattaaaaaaccctttgacaaactattaggtcatttccagatatgttacttaagaacactttacatttcaaaaagatgatgtatgcacatggtgaattcaagtgttcaaaagggtaaacattggaaagcaaatctttccactcgtattcctcatttcttctctctggagtcaactgtcgatactacttttattcatttctattttatccttccggagatagtctatgcatatacaagcagataaatctatttttataagatttaaaatgtatgttttagcactctgtggggtacgttttatatcttt

SEQ ID NO: 217803 - DNA, 499 bp, Homo sapiens
ggcagataaccaacatcagcttcccacgtgactatctcctgatggtagtttctgtaccagactgagtttgtggttgctgacaatagaaactaactctaattaagtttaaacagaaaaaaaggtttgttgagaagatatgagatacttgatagaattgacaaaagaaaaaaaatctacaggatctcattaggttgaaataaaagtaaattaggtagctgctatcgactggattgtgtatccccacaattcatatattgaaggttaaccctaatacgactatgtttgtaaatagggtttttaggaggtaattaaggttaaatgaagtcataagggtaggatctctaattggtggccttattagaaaaagaagagagagagagagagagagatctttctccctgtgtgtgtgttcaccgaggaaaggccatgtgaggacacagcaagaaggcagctgtctgcgagccagaaagagagctttcaccagaaaatgaactggctg

SEQ ID NO: 217804 - DNA, 628 bp, Homo sapiens
gctgattctctaaatcccactctccaagcccactctaagaggaagtttgtactcaaattctaaattatgtcagaaattacaaggtcattataaatttcagaaatgtgtgtttttttaagaactattgctctttgacatagaggtggttgacactagggtttttaaaaaagcgctacaaagaaaatgactgttttcttggggaaaaagttaattatcatatcagtcatacaaatagctactactaaaatcctgatttttaaaaatggcataatcaggatcttaaaaatggtatattcgttaaagtatttaaagcatttctttaaaaatgttttctttttcaaattaaaatgtggctgaacaaaatattcacaaaatattcacaattagaagttggtggagagagcacaagtaactaaaagcttctaaaaactatcaagccttatagtagaatctatcctttaatatgacttcaggccaggcgcagtggctcacgcttgtaatctcagcactttgggaggccgaggcgggcggaccacctgaggtcaggagttcaagaccagcctggccaacatggtaaaaccctgtctctactaaaattacaaaaattaggcaggtgtggtgacgcaaa

SEQ ID NO: 217805 - DNA, 456 bp, Homo sapiens
cctaagaacaagcatgttatcaaatatgtgggatatgaagatattggaaatagggtccaggtctcatctcatctgtagaaatgagtaggcggtaaaaggggatgggaaggactacaattatgtggtcaggagcaaaatctgttaccctggacattgtcagatttaaatcccagcttttatgcacactagcattgtgattcagagaaagcgttttaccttacttgtcttacctgtaaaataaggacagtagtagcagtactcattttatagaattactgtgaggattaaataaagtaattcaaatgaagtatgtaacagagtgcttggcacataataagcacttgaatggaacttaagtgttagctattattatattacttcctttcctcataccaacactctggcaactttattattctaatttgtagtaaatatttgttgtattactattactta

SEQ ID NO: 217806 - DNA, 252 bp, Homo sapiens
tcgtgaactcctgacctcatgatctgcccgcctcaacctcccaaagtgctgggattataggcgtgagccaccgcccccagctgattccaggcgaattcttctctgatgggcgggcgagggtgtgttcgtgtgatgggttggagtgtgtgtgtctgagtacacagatgatgtgttttcccttcagcttcttacgttttctgagcatccattgtgcctctgcctcccttgtgcctctgggcagatcctctagat

SEQ ID NO: 217807 - DNA, 319 bp, Homo sapiens
tcgtgaactcctgacctcatgatctgcccgcctcaacctcccaaagtgctgggattataggcgtgagccaccgcccccagctgattccaggcgaattcttctctgatgggcgggcgagggtgtgttcgtgtgatgggttggagtgtgtgtgtctgagtacacagatgatgtgttttcccttcagcttcttacgttttctgagcatccattgtgccttaacattttctgcttgtcctttgggacaaagcagtattttactcattctttgaatgttctcattcttttgtatcatgtgacttattaaaatcagtttctaaca

SEQ ID NO: 217808 - DNA, 553 bp, Homo sapiens
aacgaaacttgagctatttcataacccattgcttttccatttttaccttattctcctcttcccttataccagaatcaaaatgaatacactaaaaacccctcaagccagtaatataggtatacttccagaattttgtcccccaagtactatgaacttgaagcaacacaactcaaaaaatataagccacaatgattatggcaacaacaagaaaacctaaaagaaaatttgccacaagtttctactagcctatgaggtagagccctgggacacccatcagtccttgaatgtcagataacctattcctatcacagctcttaaactgtaagttcatgagtttttcaagtgctcaagttcctaagtacaggatgatacaagcagttgttttctgtgatgtgactcatttcctttattttgatgctatgctaccttttacctttcatattgactgatgacgctgatattttggctgatcttacaatgggctaaaccttaattattgtcccctacttaagtatccacttctgtagatgatcatgtccaagtttgagctcca

SEQ ID NO: 217809 - DNA, 506 bp, Homo sapiens
ggtattgggcattacaagagaaactgggaacagagttaggtaagcatgtaatatatgtatatgtgtatgtgtgagatacacacacacacatacacttatatatatttgcttatcctgggacactcttgagactaattataccagaatgacagaaatgaaccaggaccgtccccaggaaaccaagagaactaaagtcatccaagactttggcttgctgcctctgatgtccacaggccaattagccaggatttagggtagtgtctacttgggacagttgtgggtgttgcttctggcaggaggaatatgaggaagaagatggtagggaaaggccatctatggtgaatcattaatgccatgcagttcttgagacagcatttgagaaattattctctggttttccttattgaaattgccaatgcctgttctctaggttctaagagcagccctcacacttgccatcacacagctatgtaaacacctatgtctctgctgggaggtccccacct

SEQ ID NO: 217810 - DNA, 641 bp, Homo sapiens
catggtagctcacgcctgtaatcccagcactttgggaggctgaggcaggcggatcacctgaggtcaggagtttgagatcaccccgactaaaatggagaaacccagtctctattaaaaacacaaaattagccgggtatggtggtgcatgcctgtaatcccagctacttgggagattgcttgaacctgggaggcggaggttgcggtgagccaagattgtgccattgcactccagcctgggcaacaagaacgaaactccatctcaaaaaaaaaaaaaaaaaaaccaaaaaaaaaaaaaaaattgggctagtgaatgagatacctagagtaatagaattcatagaaagaatggtggttgctggccaggtgcggtggctcacgcctgtaatcccaacactttgggaggctgaggcgggtggatcaccggaggtctgaagtttgagaccagcctgaccaacatggtgaaaccctgtttctactaaaaatataaaaaattagccgggcatggtggcagatgcctgtaagcccagctactcgggaggcagagggaggaaaattgcttgaacctgggaggtggaggttgcagtgagccaagagagcgccattgcactccagcctgggagacagagcgagactgtgtctcc

SEQ ID NO: 217811 - DNA, 450 bp, Homo sapiens
tattcttcatttctgtctgatttatattttaataattaaaaactaggcagttacatcagaacagcatgaaaaatagatgtgtgaaataacatggcatatttagggggcttagaaaacttcactgattctcaagggtaaagatctgtggcagggtttttcagtgttggcactgttgacattttaggccatataacactttgttatgcatagctgtctagtggaatacagcatgctcagcggcatccctgacctctacccattaggtaccaatagacacccttcctccttccagttgtgacaaccaaaattatttccaggcactggagagcaaaatcattccttaatatgaaccactagtcagtgagaagatcttgttcatcctgttggaaatatggctcaaaataatcagatcagttcaaagaggattttataagattttgtgtctcaaaa

SEQ ID NO: 217812 - DNA, 567 bp, Homo sapiens
aagaaggtttagataagagaagctttcactcttgttcatatcatggaatagtgtgaagggcagagttgtgtctagaaacctggtctgtcagcactgtgttttcttccactgtatcccagtatttccttaattagccttgttattagaaatgtaaaccaagtatccaagaaggtcctgtcaccaccactcagctgtagaataagttaaatccagcttaacttttgcatttgtgaaagtctgagacctttaaaaaatgcttagtcgtcattgtattcagaaagtttaagacttctatagtggttcagggaaattgtactgctgagaactagtaggttattacagccatgtttttctgtgattactttttatttttcattttgaaagaaaaaaactacctggcatagtctcaatgctttaaaaagacaggatttttctgtgagaccattgacatctaaattagtgttctcttgaactgttatcatgcatattaagacatatcatatatctaataaatggaagtaaaatggagttaattgaatcatctggttgggttcagctataccattt

SEQ ID NO: 217813 - DNA, 467 bp, Homo sapiens
aaagaccggatgttaaaggtgagcttgttgagtggaagggaacattctcaggttgtggaatttggttagaagctgtagaatttaaaagggggagggaagtgtaaaacacgaaggttggtggagtaagggaggcttctgctccgcagcagacagccagcaggcacacagggtccgtctgtttaggaaggggaggggacgaaactcccttggaaacttcccaccagggaagctgtttttctctccaggcaaaatatttgccagcacaataaaggtctccacatttgggaaaaagaaggctcattaccaaactcagcttgttaaaagtatttggctttgggcaaattcactcctgcaagaatagttattaagcacttactgtgtgcctgccctgccagatgctgacgttgcagtgagctgagatcgcgccactgctctccagcctgggcgacagagcgagcctctgtctt

SEQ ID NO: 217814 - DNA, 527 bp, Homo sapiens
atttaatgatgctatcctaacaggtgtgcagtaatatctcattgtagatttgatttgcgtttctctgataattagtgatgttgaacatcttttcatatacctgttggccatttgtatgtcttctttggagaaatggttattcagtcctttgcccaatttttttaaaaaatgggttatcagttatttttgctattgagttgtaagagtctcttatatattttggatattaatcccttatcagatatatggtttgcaaatattttctcccattccataagttgactctgttgatggcttcctttgctacacagaagcattttagtttgatggtgtctcactcgtctatttttacttttgttgcctgtggttttagggtcatatccaagaaatcaatgtcaagaccaatgttatcaaggtttttccctatgtctccttctagagtttttgtagtttcaggtcatatatatatgtctttaatccattttgagttgatttttgtgtatggtataagataagggtctaattac

SEQ ID NO: 217815 - DNA, 295 bp, Homo sapiens
taattgtctaatccatggagaattatggaaaatctgtccgtaccactgtggaaatcagaaagaatcagtgtctgtgaatatcagtcttgtaaaaagcatttgatttactaacattaggctataagcattctagggtactgtgactattaaaattgccatttaaactttaaattcatggctgggcgtggtggctcacgtctgtaatcctagcactttgggaggctgaggctggtggatcacttgaggtcaggagttcgagaccagcctggccaacatggtgaaaccccatttctac

SEQ ID NO: 217816 - DNA, 420 bp, Homo sapiens
ccctcctcaaacctagagatttctttaaaggaaggaaaaggagagagtaggggagagtacattgtagctgttagaagggatagttctacaaggtatccaaatttcctaagtatatttctttaaattttccttttattgaattttctgtttactggcattagtctcatatcagttttggctacctttagctgcttttgttgaattctatttaataaaggcactgcaagtataaaattattaaaaatagacaagcacaatcctttctctgctaaacaagcttatgaaaaacctggtgatacccaaagagctacaaaggaaactctcacacttggaaagattagactgataattagcctactcatgggttaaaaaagaacacaaaaattaaaatatagtaagtcctcattcatcaagacgtct

SEQ ID NO: 217817 - DNA, 621 bp, Homo sapiens
atgttttgtagtattcttgagaatatggaggctatcagatgttctttcacctgaacttaagtttgagaaccatacttgtaggccaaggacacagcatgaatgctggtgaaagtgtatggaagtgtttggaagcagtacatagctagagcaggaatgtgcagaggggaggaatgggagatgcagtttggaaagtaggtaaaggaatgaattcattatcaagctgagggtttatactcactttggagaaattgtaaagataaaaggtttttgaactggcagtagagaagaaaaggtagtgatgatttatgcgttaggtaagttaataatctggttgtgatattgtggttttaaagatgtgtcctatctatggattctttgatacctctcccctcaactaatgaggcttcgtttccctccccttgagtatacactgaacttagtggcttgcttctatgaaacaatatggcagaagtgatgctatatcacttctgagattaggttataaaacgactgtagtttcatggccgggcgaggtggctcatgcctgtaatcccagcactttgggaggccgaggtgggcggatcacaaggttaggagatcgataccatcctggctaacatg

SEQ ID NO: 217818 - DNA, 497 bp, Homo sapiens
taaggataaattcaggtgctttaaatgaacaaataacttagcagaatacactgattcctgaagcctgcccaattccttctgtgctctgacgtagacatggctgtgcattgtcgtaagaagtcgacaccacctatctctatagaaagcagaggggaaaagtgcaggattcagcagcttttcttaacaaattgtaacattttgagttggcttccatatataaacaaggagtagataagtttattttagcattttagcaaaaacacttagtaatttagtatatttccgtgacatttacctttaagactctttttaattacctaattgatcttatccatgatgggttcaacacaaagaacaaatattcagagaacagtcccaattccatttccaaattatgtatacttaaacataacatacctactaaaatattgctggcttctaggggtgacttttggtctgtcactggtaagagtgcatggatacacatggaaagtcag

SEQ ID NO: 217819 - DNA, 378 bp, Homo sapiens
actaaatcatatcaggtccttactaaaattccatactgcctatgaaactttatgatttactgtttaactatctctgaactctaagctctccctggactccaagctctacaagcataagaattatagtagttgaactttgggaggctgaggcaggcggatcacgaggtcaagagatcgagaccattctggccaacatggtgaaaccccatctccgctaaaagtacaaaaattagctgagcgtagtagcgctcgcctgtagtcccaggtaatcaggaggctgaggcaggagaattgtttgaatctgggaggcagaggttgcagtgagccgagattgcaccactgcactcctgcctgatgacagagcgagactccatctca

SEQ ID NO: 217820 - DNA, 559 bp, Homo sapiens
  misc_feature (56)..(56): n is a, c, g, or t
  misc_feature (83)..(83): n is a, c, g, or t
ccccaggcgggaggatggacccccttacctccactaaggacgggcttcaccactcnggtccttcaatggcggaaaaccactgntccttaaaaacttatactttaaaaaccatccggtactatgcctacagcctagtacttataaatttggaggagttaaaaatttttcctaacagatctcttcataaaggttcctgttatttaaaaccccactataataactactactattgatatccatgcacaacacaggcctgatccttaattcattcattgtctccactgttatcatctcaatcaatgatgtgaacatttacaaagttgttcagagcagaaacttggaggtcaagcttcaattgtctctgagctccccatgccctactctgaaaatattctacagattctaccttaaaaatataccacaatctgcccactaatcttccactttgatttctgccatcttgatccagccatttgtcatatctttcccacactattgttcctgactgatctcttcccctgtctgcttcccattctactctctgttttttctattgtat

SEQ ID NO: 217821 - DNA, 500 bp, Homo sapiens
gaatgtctacccaatgcttgtatcaccattgtatcttagaagtaaataactcattttttattttacaggttaacatatggaaagactttgacttgagtctcagaggagactttggattttgtacttggtacttttgagctaatgctagaaccagttaagacttcggaggattgtgtttttgcaatgtgagaaggacatgaggtttggatcccaggggtggaataacatggcttggctgtttgtttcctccaaatctcatgtttaaatataatccccagtgttggagatgaggcctagtgggaggtgtttgggtcactggggcaggtccctcataaatgtcttagctatgataataagtgggttcttactctgagttcatgtgagttctgcttgtttaaaagatcacggcacctccccaccttctctcttgctcccattcttgccatgtcatgtgcctgcttccttttgaccttctaccattatcgtaagcttcccaaagc

SEQ ID NO: 217822 - DNA, 399 bp, Homo sapiens
cttcatgaaaaaatgacagtggatattacattttacacttgtttatagattttctttctttttcaaccaagaaaatattttgaacaattgaaacttttaattgcatttgcaaggttttggcttctttatgttgtcatcacacagatgcacacacacatacacatacaacacaaaagagagaacaaaaaagcaaaaggagctaggaaaaaaacaaaacaaaacaagtagaggtgtatcaaagaactcaagctataaccaaaaagaaatcgtaaaatgcctttgctcgtttctctacgctggaccaaagctcaatatttgtaggtatatgcacattgtatagatatggctaaatgttgctgacaatctcgcaatactaaactgttcctattttaagaaaaa

SEQ ID NO: 217823 - DNA, 401 bp, Homo sapiens
aaagcaaatgtattagatattttcatttcaaacttggaatttaacctagccaccaaattccagattttatttgcctacagtggcagtttaattcaacaaatatttgttaggtgctttgggtaaagcagtatgggaaataaaaggcaggagcgagaaagtgtcctcactcacccatcttacagtcataggtcttggttggggagaaaaagaccggcattaaccactggctggtctcttctatagcacaaaaaataacattcaaaaggaagaaaagataattttctattttaatttggcagaaagtaaacagtgtttaaggagaatatagagtaacaaattcacttcaaaaagaataaatttaggcactcctaccttatgaatggctaagggtatttttatat

SEQ ID NO: 217824 - DNA, 753 bp, Homo sapiens
ggacacataatcccctgttgtagagaaacttggttttcaattgtacttcctagtttcaagtttcaacaactgcctcttctcttcctttgatagctgtaatgaacagctacctcccaccccttccgagatcctcagtcatttcctaccctacccctggacccactgtcttcctttcacatcacagtgcagggaaagtactcaggggtgagattgcgccagagcttcctggcatagggtaggatttggttttgttttttgacagtcttgctgtgctttatgtgattgtgtattcagttacagcagccaagagcctttaggccagattgtctacaaattacaattaaaaataatagtaatgcctctcattaccatgattattatgattagtggtgctgtgctgggtgggcctggttcagggcccaggtctgctgggaataaggctgggaagaaatggctgtacatagagagagacttgggctgctggtggcagcggaaggggcggtgtggagtcaggaggtcttgggggatactagtcagcaggacccaagtctgttggctcacctgtaggtcggacttcaaactccagggtatgttgggaaagagagtgaagtcctactgaaaagggaaggaaagagacagggtttcagaactcttttccgaatagaggttaaggacactgacctaggcagacctaatgtgtgtctcagttctgctccttaccagctagggatcccatggcaggtaaatgtgaac

SEQ ID NO: 217825 - DNA, 193 bp, Homo sapiens
agtgcctgacctgagctgggcccatcagatccagtacttacctggaatacgaaaaagatggagagagtgaccaaagattacaaaaatctctgaagcttatctacttgagagagagtccctgaagatactggcctctcattcctgctatgtatatccaatgtgactgaactctgaataaaatatacaagttata

SEQ ID NO: 217826 - DNA, 696 bp, Homo sapiens
gcattaaggcccccagttttcctgacaccttcagggtagagagcaggcacaggatttattctctctggtactcagtaagaagcagggaaccgccaacagaggaaaatgcttacgtgtccctgagtccttggacaaacactcgaatgtatagtcccatgaggtcaactagccagaaggagctggcggatcgccttggaaagagctcgcactgcccacacaatgtgtgtggtccttggaggggctgccctggtgagctggattgcttccagtgcttgtgccttggaggagccagtagtataggggctttcttagtctctgaggtttgttaacttgggctctgctgggccatgaaaacagcactccttgctgggccttgcagtactccctcatttgccacttcccagagagcctcatagactgacctgcacagacactaagggaacacacaacctggtgcaagcaaagaaaaatgcagcctccactgagaaagtccaagttggaaaaactgtaatgagactcccactgaggtaaaactaatggaagagatggaagagaactgtaacggacaactcaggaaatgaagtataagtacaaaagtaacatttggaacttaaaaactcatgatttctaaatataaaaattcagtaaacaggagaatggtcactgctgggctgaattcatgttctggaaaagcaa

SEQ ID NO: 217827 - DNA, 575 bp, Homo sapiens
tgaaatcccaacagggataaatatctagttatgctaactatattgcaagttttactatatattagttatacttagtgtggggcatgcttactttatgttttaagatttctggtctatatcacttgtccctggcactatcagactcttgctttctattttaaataactggtcaggtgatactggttaaccaaaagtcctagaagccagtgcccactgatcttagggcatttttcagcagtggacacattcatagtattattacaaatgaaaaacagcagtgaatgctaaactcttgacataactttgttttattttggatgatatctaaagatgttttcaatatagattattaaactatgactgtaaaaacctccagaaaagcatcagatattaaaaagtggaaatattctctccagaccatgaagaagtgaaagcccagtcagcacacattgctttcggtcctttcctcttgctggaatcccagttgtcatcaagttcaccctttcacttcacagctgagtaaaataggaggccgtttgtgctccatcacacttaactgtacctcctgcttcatg

SEQ ID NO: 217828 - DNA, 481 bp, Homo sapiens
cttactagaaaaaaatctggtaaaagtttggcacattacataggaagcggaaatagattatagatgagggaaaccaattttgaacatgttgcaatcatctggaaattagatgataaaggatggtaataatagaatagtcactgtaaatctgtgccatcctggtatatacctggctgataacaagttcttttaaaaaattaattttaatgacaatgaaaattatgtgtatttgtggtgtacaacatgatactttgatatatgtatatgttgtagaatggctaaatcaagctatttaacttattatctcacagacctattttattatggtgagaacacttaaaatctacttagcagttttcagctgggtgcagtggctcacgcctgtaatcccagctctttgggaggccaaggcaggcagatcacctgaggtcaggagttcgagaccagcctggccaacatggtgaaacccagtctctactga

SEQ ID NO: 217829 - DNA, 481 bp, Homo sapiens
cttaaaagccagctttccttgaacaaagctcctgttgctttctggagtgccttataaagaatgctgggaactgcttaaataaaaaactaaggtaaatacatatgcacataaataaaatcccaaactaaaaataaattgtctcttttaataaaaaatataaagtaaaatagaatgccagactcactgaacttcccagtactatgggtctggagaacagtttagacatctctttctaaaaggctgcaacaggtgattctgctatgaagccagagttgatgtgaatgtcagaagtatatattatgtgtctagcacatagtagatgttcaacaaaaagcactacccaatgtcacctgtgcaatattcttgcccaaaatgtttaacctcaatttaataacaaggaaataataaggtaagctgaaatttaggatcattctgcaaaataattgacctggattctttaaaatgtcagcattacattagg

SEQ ID NO: 217830 - DNA, 107 bp, Homo sapiens
gctgataatgatggagaggctgcaaatggtggtggtaatgaaggatgcagtttgggtcttcctcttgtaaaactgtcaatggaaaagaaattctagtttcagcgagt

SEQ ID NO: 217831 - DNA, 427 bp, Homo sapiens
gaatgagcccactaacataaaaataaaatcagttacatctgcataagttacatctgcagtctcctttgtcatataaagtaacattcacattttccagggaataggtcagaaacatcatttccaaatcttgattcttatattttcttagttctaaaattcttatttagcctgtaatccctgcactttgggaggttgaggctggtggatcacctgaggtcaggagttcgagaccaccctggccaacatgttgaaaccccgtctctaaaaatacaaaaaattagctggatgtggtggcgggcgcctgtaatcacagctacccgggaggctgaggcggaagaatcgcttgaacccaggaggcggaggttgcagtgagccaagatcatgctattgaactcgagcctgggcaataagagtgaaactccatctc

SEQ ID NO: 217832 - DNA, 211 bp, Homo sapiens
aaaccctctctgtgactaaccacaccaaaccaccaagtttactttgatgtgaagacctatggatagatattcaaggaaatctcttcccagggacctaaaaggaccacctgttcctctctcttctaaggcatcttcaccctctgggacttccaatggaagatagaagattaggacgcatatctgacttccttcccacctgctttctctctgg

SEQ ID NO: 217833 - DNA, 816 bp, Homo sapiens
atctctacttcaagagaaattgaaaaatgagaatttttgttaagaataatattctccaaaacaggatgtctactaaaagaaagtgagaaaagagctctactactagtagaattagtaacaatgagagtaaacaattgttacccactctaagaatacagcagaagccaagcgcagtggctcacgcctgtaatcccagcactctgggaggccgaggcaggcaaattgcttgagtccaggagttcgagatcaggctagccaacataacaaaaccccatttctactaaaaatacaaaaaattagccaggtgtggtgatgcacgcctgtagttccagctactcaggaagctgaggtggaagccacctaggcctgggggatcaaggctgcagtgagctgagatcctgccactgtactccagcctggggaactggagtgagaccctgtctcaaaaaaaaaaaaaaaaaaaagaatataccaagctacctactaaggggcatacctttcccaccaaattaattcagtcctttggtaagttacaggtgtggtggtttactgtacctttaatcattaatggaaactttagttgcccattcctctttggtgtcatgcagcccttgaggtaatttgcaccctgtgatgttttaccccgtccagctccatacactccagtgtaagtaggcctcccatttacacaccttacttatattcataatagttttatttgtacagaaatagcagtaacaatctgttatctaatatcaacctaatatctacttctaatgcaatttgattgcatgcttgtattaaaccatttccctc

SEQ ID NO: 217834 - DNA, 1154 bp, Homo sapiens
ttgaaccccagcttctctgacttaaagctgccctattgtgaagtagaaatgaagtgtaagcaatatattcttaagtatactggtcaattctgatttacatagaagacctaacagtttatttactccctactatttgttatgggattatgctgatagtagctattactaatagaagatacggtctaaatcagggaattcgtgttctatcagggatggcatatgtgcatatctaaataattactgtacactgggatatgttctagataagaggtgtatataaagtagatagagatgaggaagtggatgatgggcctgtatgccagtactactatcaggaaaaatttcatgaagatgatttctgtattgggctagtaaaaagcagggagtttcttggcagacaattaggggaataagtgaagcatacattttgacatgagcaaagcacagaatcattttattactccaagactcataagactggccctgtttacttcaaagttactttctttattatcaatcctgagttggcttcaaatgaggaggcatagccatgcatttctgaaaaaaaagggagagaattagtctgttaggcagcagtgggtgaacagtgagcaaagataggaagatgaattttgataggcagagttgcatattttgcaactaaaggtagacattgcagttgtatagttgaaagaccctttggttattttagctgcttataaccattatcgttagtgatgtgcattttttctttttttttgagatggagctctgtcgcccaggctggagtgcagtggtgtgatctcggctcactgcaacctcagcctcctgagtagctgggactacgggcacacaccacgaggcttggctaatttttgtattttttggtagagattgggtttcaccatgttggccaggctggtcttgagctcctgacctcaagtgatctgcccaccttggcctcctaaagtgctgggattacaggcacaagccaccgtgcccagcccatatacatatttttatgtaagtatgtttgtaaagttagagataaaatagtgataatacagtgttactttgagatagtatagtgttactttggctggtactctaattttactgtatgctgctattaatttatatttggggttttaaga

SEQ ID NO: 217835 - DNA, 220 bp, Homo sapiens
cagcgtcagcgggcgccagggccacgccggagaccaaagccaggggccacccttcttggagcgcttttccccctttcccgggtttgtgtccccgactttctccacccggagctacccaaagccggctccttggtgcccttggcaccttggcgtgctgagcactttgcgaggaacagtctgaccccggcgcgcagctccgcgggatcctgggtactccacg

SEQ ID NO: 217836 - DNA, 404 bp, Homo sapiens
tatttagcaacggaagtggctgtcagtggagaggggagctggagaggggacagcacaggcagagagtcttccctgaagtccagctggctcttctctaaagttaagctgtctctcctccaaagtccagccatccctctaaagtcaagttgcttctcctcagtcaagctgcttctctcctctaccaactgagtctgagatctttgtaggcataggatggggggcggggcgggccgtaggtagttttgggaaaagcaacattcgattggtaaaaagacattattcagaaagaaccaatcaggagacagcaggcaaacagggatagaagttatcactttggaccaagggtttcaggcttctcggctcaaaggtggggttttgctggggatctgcccatgtctgcctag

SEQ ID NO: 217837 - DNA, 357 bp, Homo sapiens
ggccaggctggtctcaaactccggacctcagatgatctgcctgtctcagcctcccaaagttcttggattacaggctagagcctgtaatcctgcacctggccaaggtgatattttaaaatatcataggaacccagctgttttacaactcttgataaatttcccactagctgcagcctccttttttgacccagagagtctcttgggatcatccagttcagttccttggtgttttctgatggtagagattggatggagggaagggctttcccaggatcacctggtaggaggtggtgactagcactcagacttccagagcctcaattcctggtttttctttttctttttttcttttcttct

SEQ ID NO: 217838 - DNA, 361 bp, Homo sapiens
ctactcgggagactgaggcaggaggattgcttgagctagggagattgagggctgcagtgagccatgatccagccactgcactccagcctgggcgacagagcaagaacctgtctcaaaggaaaaagaaagcccagccccggcttagtcatccgatgccatacgtgggctcgcagtgttgaggaggagtttggctcccctgtgcctctgcagctagagggcagctaaattatcagtcagatcacgcccccatcagagcctcccggggtccctgcacctccagagaaatcccacccactcacccccacagcccacagggctcacgggccccagcctgccaacctacccactgccaggccagccc

SEQ ID NO: 217839 - DNA, 538 bp, Homo sapiens
tgctaactctactgtgtggtggcgaagaagcatgcatcttgaagccagcccatctgactttgaagacaggctcaactgtttttcagacgtttgactttggtccgagttcacttaatctgcttctctagactcagtttcttcttatgcacaattttatacaaatataaccatactgtatgtaaccttttggaattgcccttttttactcagcacaattctctggagattcgtgcaggttgttgtatcagcagtcattcgtttttattgctgagtaatagtccattgtatggatataccgtagtttaaccatcggcgtaatgaaggccatctgggtggcttctaatttttggctctaacaaagcttctatgaacatttgtgtatgtatttttgtgtgactatgttttcatttctgtgggatcagtacaattgcctgatcatatggtagtttagttgcatgtttattatcttctttaatatgctttttttaaagagcagttttaggttcctagcaaaattgaggaaaagatagagatttct

SEQ ID NO: 217840 - DNA, 400 bp, Homo sapiens
ctgttgttttgaaatataatgatttttttaaagttttttttcctcctacgtgtgtattctttttctcttaagttgcttttttctttttctttttttggtctttttctttatcttccacattagaaggtagtttcctcacgcctgcaatcccagcactttgggaggccaaggtgggtgagtcaccaggtcaggagattgagaccatcctggctaacacggtgaaacccgtctctactaaaaatacaaaaaaattagctggacgttgtggcatgtgcctgtagtcccagctactcaggaggctgaggcaggagaattgcttggacctgggaggtggaggttgcagtgagccgagatcgcaccactgcactccagcctgggtgacagagcgagactccgtctt

SEQ ID NO: 217841 - DNA, 378 bp, Homo sapiens
gcagatggagtccagcctgggtgagagagcaagactacgtccaaaaaaaaaaaaaaagagagagagaattttcctgtaaataattaaaaagactaagcagccccagagataagacctcctgggatcattgtccctttatattgagtgataaagtaaccttccttgaagtatatcaatccataaccaatcaccttgctgcaccctatgtactggtcttgaatggaaaatgtggtgattcttctaaagcttctctgtctttccgtgtgtgtgaaacctaagggaacgctgatcccattcatttggagttgatgtttccaggtggctatcctcatgctttgtgttcaaataaactctgtgcttaatcatatattctaaatt

SEQ ID NO: 217842 - DNA, 508 bp, Homo sapiens
gtgcaaagcttccctccgcccacaaggtttctgtgatctttagcctttattgtgcagtttacttgttaaccggcttataatgtattcagcctatgctaatcattgactccttttgggaagggtagaaggtaaaagatgtatacaatctctcagctgacctttttttaatgttggggaagaataatgaacaacttttattatctaccatagacggccagtcttctgcttctaggatgctctcccaccaatgtgtccatctatgctgtcagccctaaatgccagtcctgtgtaggaagtcctgtgttcattcagaaaagtcacccagtgtccatccatttatgtccatcatattaaaaacagttgagttatatgataaaacatgctaccattaaatattttaacagatttaaataatatgaggaaattattaatggttgtgacatgttaaacaggataaacaatttttttataatataaacttttacatctatcatctgaattatgcgag

SEQ ID NO: 217843 - DNA, 264 bp, Homo sapiens
atgttccctcattcatcattggctcattcatccgcccatcctgtgtaggaagtcctgtgttcattcagaaaagtcacccagtgtccatccatttatgtccatcatattaaaaacagttgagttatatgataaaacatgctaccattaaatattttaacagatttaaataatatgaggaaattattaatggttgtgacatgttaaacaggataaacaatttttttataatataaacttttacatctatcatctgaattatgcgag

SEQ ID NO: 217844 - DNA, 505 bp, Homo sapiens
cggggctgctctgtctatggagtagctgttcttctattcctttactttcttagtaaacttgctttcactttgcactgcagatttgtcctgaattctttcttgcgcgagatccaagaaccctctcttggagtctggattgggacccctgtcctgtaacagatggagttgtttttacactcttctctgggtatgctcctcccccatggacactggggttgccacaagatggccttcaataaacgacagtgtcgaaaaattcgtgaaactgggtcaagaggatttctccttttgaggtcttagtggggcttttgttgtttcctgcagagttggaaggaagcggaaaatcaagcacagtgtgccaaatcctgtttggaaccagaaggggcctaataaataaatatgtaaaataaaaatgctacatgcagagatctccagatttactgactgagtaaattaactttcttgggaggtcaggattctatattctgtaccaaagaaagagaaa

SEQ ID NO: 217845 - DNA, 368 bp, Homo sapiens
cggggctgctctgtctatggagtagctgttcttctattcctttactttcttagtaaacttgctttcactttgcactgcagatttgtcctgaattctttcttgcgcgagatccaagaaccctctcttggagtctggattgggacccctgtcctgtaacagatggagttgtttttacactcttctctggagttggaaggaagcggaaaatcaagcacagtgtgccaaatcctgtttggaaccagaaggggcctaataaataaatatgtaaaataaaaatgctacatgcagagatctccagatttactgactgagtaaattaactttcttgggaggtcaggattctatattctgtaccaaagaaagagaaa

SEQ ID NO: 217846 - DNA, 253 bp, Homo sapiens
cctgatagtcatatcagaatgtatttccaggtccacagagtttagtaaatacacacatgtccacttgcacacgacacacaaaataaaggagaattcaccatcctagaatttatgaaggtcttcataaaggaggtattgtagttaagaaaaaagaaagtgacaggttatggaccaggaaacccaaattctagtcttgttttgccactgagtaacagtgagactttgagcaagtcacttcccttctttcggtctc

SEQ ID NO: 217847 - DNA, 475 bp, Homo sapiens
ctcttactactcaattgtatgtttcacattttccaaaattttgttggcatctattatccactgtagtcttctctcccattctcttgtgcttgtgacttatgctttttataatattttactatgaatgggtccattcaccgtatttaatcaagtttactgcctccctttggaaacactactactttaacttctaggatatcactcactcctacttttatgtgcttgttcattccttccttcttaggcttttattgcctttccctttctctgattataatctaaatatgtgcattagcctttaagatctctgtcagcaacaacaacaacattttttaatggctttaactaccttgagtaatttctaaatgttgatgttaagtctagcattctttggccccaggaccctattgtccattgtccaactactttccaaacatcttcacccagaaataccactgggacttaaatctcacca

SEQ ID NO: 217848 - DNA, 189 bp, Homo sapiens
gcagcctgtgtaaaacttgtgccaggtgctgtctgaacaagtgttcgtttgtgggctcagggtggtgcccaagtcttagaacttagaacaaagaagagaactcagagcagagaaacttcagcaggacattttttttttttttttttttgcattgctggagtggagggtgaggtttcagacacagagcac

SEQ ID NO: 217849 - DNA, 529 bp, Homo sapiens
tcacgtaattcttaaactactagagttatggtgcacactgtaacagtgacagtacacacagtaacatggttcttgtttcagtcttggaagactttgggatattcatccttgataattacataatttaaaataaaagctaataaagttgccttcaagtcattttgtatgctgatcacaatattctctgtgacaagtttactgctgttcacattcctatatcgcagtggcaccttggtttttaaaaggaaggctatgaaggggattgggttggttgagggtaacctttggtgggggtaacaaatactgaaatataaaaactaatgtacacttatcacatggtttacagtttctgtgaattctgtgtttatgaaaacgttaagtcctgtgagagattttcaatccccaattgttttggctgtctacatatgcaaagtcttgtcttaatttaataaggaattgaaattaacagcaaagcctgtttacacagcatttaaaacagtatagatcaactggtttctgcagtctttga

SEQ ID NO: 217850 - DNA, 363 bp, Homo sapiens
ttacttagagagcgaaacaccaggaagacagttgaggggtgaggtatgggtgaggctattcaaacagactcttgtcccttcatttacttcatttctaatcagtgatactatagcttttaattactaggaccatttcaaataatggctttcctcacaatctttgaagagactatatttattctggtttgttttctcgaaataatcttaaaatcttgaaatgtgcaaatagcttaattctgcttaaatataagatcaattcaatgatttgactgttccaggctactggctgcctctgggaaagtaacttggcctttagaaacaagaatagcatttatattatttgaaagataaaattaggttata

SEQ ID NO: 217851 - DNA, 250 bp, Homo sapiens
acaggcatacatatgcaggcgtgcacacgtccacatatgctcacatgcgtacacacacatgcacagacatgcacacatgcatgcagctgtgcacatgcgtgcaggcatacacacatacatgcacgcacacacatgcatgtattcacatgcacacacacacgtgcacaggcatacacatgcacacacacgtgccgacaagaccagcctggcctccccggctccaggccaccctcattcctgccacatcctc

SEQ ID NO: 217852 - DNA, 721 bp, Homo sapiens
ccccacatcggtccgtcctgcttccagctgctgcagcgcgccttcgccgccaaagcatccagcagccccctgctccggcccagcatggcgaccccgacccagacccccacaaaggctcctgaggaacctgacccattttactatgactacaacacggtgcagactgtgggcatgactctggcaaccatcttgttcctgctgggtatcctcatcgtcatcagcaagaaggtgaagtgcaggaaggcggactccaggtctgagagcccaacctgcaaatcctgtaagtctgagcttccctcttcagcccctggtggcggcggcgtgtaacaccttcccgaggaaactccgctgccgaccctgcctgagcgcgggagcctgaggaccgggtggaggcggtggggacccagccgcgcgccgggagcgctccccggaatgagccgccccacccaccccaaggctggagccgctgcaccctgctgtccctctccaggccttggcaatgacgatcccccaaagagcccgtctgcaccccagacccagggcctcaggcctccagctcctgggatccgggagtccatcccggcccagcacccccagcatccccgtgtatggcccccctgcacctccttgtctcatccccgaagatccgtccccctggcccctcagtgtccatgtcttgagcttaataaatgtgcatttggttttttcctctgaaaaatct

SEQ ID NO: 217853 - DNA, 832 bp, Homo sapiens
ccccacatcggtccgtcctgcttccagctgctgcagcgcgccttcgccgccaaagcatccagcagccccctgctccggcccagcatggcgaccccgacccagacccccacaaaggctcctgaggaacctgacccattttactatgactacaacacggtgcagactgtgggcatgactctggcaaccatcttgttcctgctgggtatcctcatcgtcatcagtaagtgcgacccattcctgggctgcctcagcctccgcttcctctgctggctttcatccatatcctacccgctatgtcctgtcttcttgttctgtctctctctcccaacaggcaagaaggtgaagtgcaggaaggcggactccaggtctgagagcccaacctgcaaatcctgtaagtctgagcttccctcttcagcccctggtggcggcggcgtgtaacaccttcccgaggaaactccgctgccgaccctgcctgagcgcgggagcctgaggaccgggtggaggcggtggggacccagccgcgcgccgggagcgctccccggaatgagccgccccacccaccccaaggctggagccgctgcaccctgctgtccctctccaggccttggcaatgacgatcccccaaagagcccgtctgcaccccagacccagggcctcaggcctccagctcctgggatccgggagtccatcccggcccagcacccccagcatccccgtgtatggcccccctgcacctccttgtctcatccccgaagatccgtccccctggcccctcagtgtccatgtcttgagcttaataaatgtgcatttggttttttcctctgaaaaatct

SEQ ID NO: 217854 - DNA, 358 bp, Homo sapiens
tttggttttgtttgcctctacatagttagaaatcaacaaaaaagtttcattattcaaacataaagtttagacagcataaagctatcaaaatcatacatgattataaagtaacagtatttggatccttcatagcatacttattggtaaccttcaatatacaaaacactatttcattacatctaaggttcacctttttcttcctaacactttaagaattgtacctggctgggtgtagtagctcacggctgtaatcccaacactttgtgaggccaaggcaagtggatcacctgaggtcaggagttcgagaccagcttggccaacatgccgaaaccctgtctctactaaaaatacaaatatt

SEQ ID NO: 217855 - DNA, 192 bp, Homo sapiens
ttttcctccccatttcctcttcatacattacatagattgtgaatgctctattaagtgaatgaaagaatgtttcctagccctaaacactactgttcacatcactttaaatcctatcaataagtcaaatgattttttaaattaatcttatataccattagttaaatgggtattctttttttttttttttttttt

SEQ ID NO: 217856 - DNA, 608 bp, Homo sapiens
ctgatgcggtggctcagagcacccgtatcatttatggaggctctgtgactggggcaacctgcaaggagctggccagccagcctggcgtggatggcttccttgtgggtggtgcttccctcaagcccgaattcgtggacatcatcaatgccaaacaatgagccccatccatcttccctacccttcctgccaagccagggactaagcagcccagaagcccagtaactgcccttcccctgcacatgcttctgatggtgtcatctgctccttcctgtggcctcatccaaactgtaccttcctttactgtttatatcttcaccctgtaatggttgggaccaggccaatcccttctccacttactataatggttggaactaaatgtcaccaaggtggcttctccttggctgagagatggaaggggtgggatttgctcctgggttccctaggccctagtgagggcagaagagaaaccatcctctcccttcttacactgtgaggccaagatcccctcagaaggcaggagtgctgccctctcccatggtgcccgtgcctctgtgctgtgtatgtgaaccacccacgtgagggaataaacctggcactaggtcttgtga

SEQ ID NO: 217857 - DNA, 408 bp, Homo sapiens
cttcacctcctgctgtgatggctccagcccttcctggggaaggctgtgggaagtctcccctctggctggcttcaaaagcttctcccataaaagctgagcaaaggtctttgtcagacttatttggaaaaaggctcctcggacatgagtagtgagtaaatcctagaaaacaatctgttgagtttgtaaatgaatacatgtttttggacttcatgcagacatcctcaatccctattctcagatgccgtagttatctgcagaattccccttcagttaggaagtaggtttttcatgtctatctgataacctggctttttatttgaaatgcctccaatgacagaaaacaggaactaagtggcttttatttaaggaagcaaaactcctatctgcctatcacagtctagagagttt

SEQ ID NO: 217858 - DNA, 391 bp, Homo sapiens
ttttcctttcaggagcaaagcagcagaaatctctgtcttgattggctcagaccaaaaatctccatatgaaaaggggaagattcaatcacccaaacctccttccttctctattttcttttttttctatctgaagatttatcctgaccattcagagttgctcagtatgggagataaatgatgctttcttaacctcaacccctctctttctttcttacagtcagtatcctgacctggcaaggtgttccttaacctcccctctggatcccccttagcacacatctgggacaatggagcgttcagcaccacggacagcattacaccctcttcaagtgcttgttaaagccatttgtctatttcactctcaagtaaataaaaatattttttaaaattt

SEQ ID NO: 217859 - DNA, 247 bp, Homo sapiens
atcagggtttcctgaccagtgagaccacagagggctggatctgaattcagagagtcaaattggctgtacatggtcagtatcctgacctggcaaggtgttccttaacctcccctctggatcccccttagcacacatctgggacaatggagcgttcagcaccacggacagcattacaccctcttcaagtgcttgttaaagccatttgtctatttcactctcaagtaaataaaaatattttttaaaattt

SEQ ID NO: 217860 - DNA, 212 bp, Homo sapiens
caccactaccaaatccagagaagaacaaaaaatttaagtcagtatcctgacctggcaaggtgttccttaacctcccctctggatcccccttagcacacatctgggacaatggagcgttcagcaccacggacagcattacaccctcttcaagtgcttgttaaagccatttgtctatttcactctcaagtaaataaaaatattttttaaaattt

SEQ ID NO: 217861 - DNA, 495 bp, Homo sapiens
ttttcctttcaggagcaaagcagcagaaatctctgtcttgattggctcagaccaaaaatctccatatgaaaaggggaagattcaatcacccaaacctccttccttctctattttcttttttttctatctgaagatttatcctgaccattcagagttgctcagtatgggagataaatgatgctttcttaacctcaacccctctctttctttcttacagtcagtatcctgacctggcaaggtgttccttaacctcccctctggatcccccttagcacacatctgggacaatggagcgttcagcaccacggacagcattacaccctcttcaagtgcttgttaaagccatttgtctatttcactctcaagtaaataaaaatattttttaaaatttccctgaggtcctgtgcctaaacataaaccacaccatatgtttagggctctgacttcccctactatcagcttactgttaccttataaacacaaacataattttca

SEQ ID NO: 217862 - DNA, 610 bp, Homo sapiens
gttggactggaagagggtttgggagagagacccacgtcagagaggcaagtgtgaggtcaccatggggggctggataggacagagaggccacacgaggatgccaagggttcttccacatgaagagggtggagtggagaggacacaagggagacggaggagcatcagcaaggccagaggaagcccttgtggagggaatgtccctacacaaaaatccattcaaaatagacaagggcttaattgtaaggcctgaaactgtaaagccagtagaagaaaacacaggtgaaaaactccatgacactggcctaggtttcagggttgtatcacttcttgcatatgaccctaaaagcacaagcaacaaaagaaaaataaacatacatgattgcatagagctaaaaagcttctgcacagcaaaggaaatcataaacagagtgaagacaactcacaaattgggatagagtatttgcaaaccatacattaagtagggggttaatatccaaaatatacatggaactcaaactcaatagcaggaaagcaaataaacgactaaaaaatgagcaaagaacactgaagagacacttctcaaaagaagacataccaatggccaacaggt

SEQ ID NO: 217863 - DNA, 479 bp, Homo sapiens
gatgtccatagggaaagtacttatttgcacattaaacataaataacctacattatatgcatgctctttagatttccttatgaaggatgttgaagtaaatattactgaaccattgtcgctttctctctaaagatcatttctttggtttgagttgtaagctgatggtcctcgttgggcccttcatttaatatggacctttgagttgatcataaatcatttatttcagcttcaaaaggacagaagtcatacctgcagcaagaggtggctaggaagatcagatgtgaatgaaggagtttcccaactatgagcccacacataaaccagagttgtcttttactttattataatacataacaaacatatatttttccccctgggaactacattttagcaatatatttttcattattttctattcttcctccatttttatacagtacatgtccactatataacgtgtcaagtccattttgcaacgat

SEQ ID NO: 217864 - DNA, 550 bp, Homo sapiens
gcatgggggaaaatgtaaaccatcaaagaaacaaagatgtgtttgaaggaagatagacaataataatagcacaagagctcagaggttaaaaataagaaaaccaagcaaaatgaaattgatttgggtacaggaaaggtttattaaacaggacaaaaaggtgagcaaaatactgattttttaaaacctggtgattgtagagttcaaaaaaacaagcttacttgtaaatattaatgcaaaaatattaaataaaatattaccaaatagactcaaacaattcattaaaagaataatacaatgtgacaaattggggtttattcataatataaagatggttcaatattaagaagtcttaccatattagttatctaagaaagaaataaggtattattaatctccttagatacttaaaagatacttggtagcacttcttcttgtcgccatgtgaagaaggatgtgtttgcttccccttccatcatgattgtaagtttcctgaggcctccctagccctgtggaactgtgagtcaattaaaccccttcctatattaaaaaa

SEQ ID NO: 217865 - DNA, 429 bp, Homo sapiens
tggctcttctccgtggcttcatacaccctgcctcctccatgaccctgtagggcaggtggcggctctacagggcagggagtcaggagataaggatcctgaatttcattcacctgtgaccatcagcaagttactctccatggcaggccctccattttcccgttggtattgggaggggttgcaccaggatatgatccgggggccctttcttcttcagtgacagtcatctctggatacacgctctaagatctaggactgaatattcctggggaatttttttcctcggtcaatgacactgggtggctttaggcagtcgatggcatctatttaagatcagtttcacaaactgtaaaaagggcatcagaaatctgccttgctcataagatctttgggggcattaattgtggattcttatgtatgcatgagtcctgg

SEQ ID NO: 217866 - DNA, 390 bp, Homo sapiens
cacttttagatgttagaagaaaatatagatatatttgtttatatatgaaccttaaattgagtaagaatttcttaaacaatataccaaaaacagaagaagcaaatgacatgaagaaaacattgatatatctgattatatcaaaatgcttagcttggatataaaattttaagatatatttatgcactaaaaatataaaatcatgaatcattgttaatttgagagaagcaggaagaacaatagatccagagatagtacccaggatattttaattatatgtataatttctcaaaaacatctttatatccatatatgcttatctatatataattgtatctatatttctcaaaaatatgtataataaacatttatagcaaaatgctatagtttgac

SEQ ID NO: 217867 - DNA, 267 bp, Homo sapiens
agagctgccagctgtggcttgtagcataggaggctggggatctttggagatggttttgcagcatctctgggtcttttttatcagcccacagtaaatggactgcccatattttcagcctggctgactactacccagttataaagagagctgtctgcaggaggaactggccctgagatccttggacacacgatggttttcccttcaccttcaatcacctgtggcctcctaaacaatgaataaagaaagtgcaatacctcctggctcaag

SEQ ID NO: 217868 - DNA, 307 bp, Homo sapiens
gggaggaacaatctttgctgcttcttgtgatagatcagtgtttctaaaataattttttcatcattgtcccataaagaaaaaaaaaagtaaatttctctctgactagagaaattaaatgttaaagaataagattttgtcaggtaacattgaccttgggaggtctacaaactattgtaaatagctaagattttttcttgccctacccttgaaccaatttttgcctctgtgaggacaatattgcccccttctgagaatacatgtacaaaataattatatatttttaaagccatttaaacttttttttttt

SEQ ID NO: 217869 - DNA, 790 bp, Homo sapiens
catgtacacatggcaatagctcagctagttcagctatcagtgttggcacaagtcatgagactcttttgttctcctttggttattattttttttaactcatttgttttgcagatgcaaaaacccaggcccagagagatgaagaaacctggctaaggtaacatgtaagttagtgtcaaaatcaggataaaacccagatcttctgactcttagtatagctctctttttacccagccacactgcctgtgtccctgggactgttagtaaaataacaggtgagctggaccccctttttgagatgactgggtatgtttactgtctgggtcagatcagtcaagtactctgagtctagggttgttcctagaacagaagctggggttgatgagcatttgtgagtattggagaaggagtgagggggagaagcctcacacgcaaacccaggccctggtttcaatttcgtgtatgagattacctgagaacggaatgcaagtaacaggcaaataattgacatctcaaacctaactgtgtatgcatcctgagtagctaatagtgagctgttcactactaatgctgtgtgtaggttcatcccaaagacaggctgatccacacatagacaggctggtcctatgattaaggagtgtgagctggcattccctttatcaggacaaagataggttctgcttcctctggatagtcttcaggcaaagctttacttatggccttgcaaataacccatggtctcttggtcgatgaacaaaatagcagtaaagaagatgaattctccttatttatc

SEQ ID NO: 217870 - DNA, 329 bp, Homo sapiens
ctttatgagttggtaacttacagctgtgaacctgcctccttgttttcattaagtatatttgaagttaatggcaaaaggcagtgctgacaaccctgggaaatggcagtcctttgtcttcttcctggagcagatgcaaaaacccaggcccagagagatgaagaaacctggctaaggtaacatggtcttttccacccaggttggagtgaagtggcccaatatcaactcattgcaacctctgcctcctggctcagactctcctccagcctcagtcttccgagtagctgggaccacaggtgcacaccaccacacctggctaattttctgtataa

SEQ ID NO: 217871 - DNA, 203 bp, Homo sapiens
tcccagcgagcaaggaaggaaaactggcataacatggaggagcgccatgccaggagttctgactttcgacagtttattctgaagctagcccagtcctcgtcatttcaagacaataaacaaagactgttccaagaaaaattcaaaatggcaacacaaagagcagatgaaaggcagcacaggagaaaaagcagtgagaaactcca

SEQ ID NO: 217872 - DNA, 519 bp, Homo sapiens
agaatcttataagtttttaagatagtatcttaatttcctgggaacacattcatttatatatctctaattatttttcaaggttttaaaatttcactatgcccaaaaggctcttgatcatactgaacagcccgagttgtattatttagtttacagttcaaatacaattttacttgcatgtattcttgtctgaatctcaggatatttcagaagtctttaaatatattcattctattattcaaataattttttgagtcctgactatgcaccagggattggacttggatattagggtgcacagaatgaaacacgattcctcttctcaaaagtttctggcttagtgatatgaactaaaccagcagtaaacaaatacaatatagggtcataaatgttcctggagagaaatatgcaaaggacactgagggactggaaggggcacccagccagactggggacagacaagaaaggcttcaaggtgtacacagagcagattcttgaagaatgaaaggaaaccagataggc

SEQ ID NO: 217873 - DNA, 385 bp, Homo sapiens
cacctactctcaccagtacaaaggatatgcaagcatggggaaaagttgtcttatttaaagtgcacttaatactttattagcaaagactaaataaatacattgagcaagtctatcaggttatcaatcagacagtaaaacagtggaggatcaagattgaaggttaagtcgtcatagaaagaacatgcttgctgtgataacatctccttttctaggttcttgaatgcaagttaattttcccaaggtctcattttcactctgtgcctcaagacttcactcctggcccataggtggctgttgatttttttttctttgacagcagggggtgctctgggaatatgctcttcaaactaacttctgcctctagttatggttctttaagaaccca

SEQ ID NO: 217874 - DNA, 664 bp, Homo sapiens
  misc_feature (1)..(1): n is a, c, g, or t
ngagtgaagctcagtctgtctctgtaacatactataagatttgcaccttgttgctccccaggaattatgttagtgtccttttctatagctagtcttcaaggatggacagaggcctaaaccacaacaacaacaaaaattagaaaaaaaaaatacttagatttcggtaatcatccataggaactcatagcatcagtctcttttctctgtgaataatatctttgtgtaagttgtcataaaaaatcaacgttgggtttcactgaagtgagaaaccaaaaattttagtgtattttcactaatttgtgggggtggggataggtagaggccatattcatagtactttgggcagtgttctctagaaaatttatagtacttttcgtgttattatacactatcacctattaaggtaagtatttggttaaagtgctgtagaaatggaggtgatgagaggttctcattgattacataatttcctagatagtattaactcataatgctttcttttttttttttttttttgctgaaagtattttttaaagttagtaattggttctgttgattttataggtacagtgtagtgaatgtaagtgccagccagtactggagctaacattagaactttacccttctgactgtagtttcatgttcttcacataaaccctacttc

SEQ ID NO: 217875 - DNA, 317 bp, Homo sapiens
tcagaggggtccaggagaagcaggcgccagggatccagtgtgagccaggacagtgacagtgagggacattcagaagactctgagaggtggtctgggtctgcttccagaaaccatcatggatctgctcaggagcagctaagagatggctccagacaccccaggtcccatcaagaagacagagctggtcatgggcactctgcagacagctccagacaatcaggcactcgtcacacacagacttcctctggtggacaggctgcatcatcccatgaacaggcaagatcaagtgcaggagaaagacatggatcccaccacca

SEQ ID NO: 217876 - DNA, 200 bp, Homo sapiens
taggggacatatgccctaaaaatagtcagttttctagtctgagtaatagataagagactgactaagcaaagtttaaaatgctatttggacactttaatgcacatattggatatctaaaagtctacagccatataaaaattttatataattaatgagcaaatgccgtctctcatgccctaaaataaatcagtagaaacatg

SEQ ID NO: 217877 - DNA, 455 bp, Homo sapiens
ttctacatactgtggctcctacaggtaggctttatttgtatctatgtacacacacacacacacacacacacacagtatttttataaataataccaatttataattatctggagattaatttgataatactttatggttgaaattctcttacctattacccagcagttctgctcctaagggaatcatgcatgtatacaagaaaacataaaaggatatttaatgcaacattgtttgcaatagcaaaaaattgtaaacaatgtaacataaaaggatatttaatgcagcattgtaatagcaaaaaatggtaaacaacataattgttcatcagcaggtaaataaatgtactatagattatatatgcaatataaataggattctgtacaacagttaatatgaataaattggatttgaaaaataaatgtgataaatctcaaaaatatagtattgagtataaa

SEQ ID NO: 217878 - DNA, 334 bp, Homo sapiens
tgtagtgtcaccccagttaaagctggcttcttagaagatcccccttgttggttgacttctgcaatctctctcatgttccttcacactgtcttagtcttgcatggctgctggaatgaaggaccacaaatacagtggcttaaactcacatgcaatgaagagatacctgcactttcaggttcactgcagcctgagtcacacaataaccaagataggtcaacaacccctgtgtctgtcagcggatgagtgggtgaagaaaatatggtctgtacacaatggtgtactattcagcctgtaaaaacaataaagtcctgtcatttgcaacaatgtggatgca

SEQ ID NO: 217879 - DNA, 118 bp, Homo sapiens
acttaaattagtttgatctttctagagtgtgatctcccaaaatgcagcaaacctataaaaattctgattttgttttggttattttgctttggagaacaaactcatcgccaatatcgta

SEQ ID NO: 217880 - DNA, 572 bp, Homo sapiens
ggaggagctgggtattgttatttttaatgatgaaatgtctccatctagtggaacttcagagcagtaaaccttgtcactatattaaagtgaagattatgtctccaaagccattttccttaaacacatacagtgtttaaagaaaaaaataaacttccacatatgttcttagatgatatccttacaactgtatgtattccttttggaaggcatagaaatgagaccagtacaaactgttaacatttttaatgtcatgatttgaacctcaaagagaggggtgcttacaataggggagcagcacagtgcagatcccacccagttggtaacgatctagctcttaagttgggcagtgggttcacggggttcatatatactgtacctatattcttcagtatgtataaatatttcctaacaaagatctagacatgaactaaatttaagattatgaataaatctagacatgaactaaattttatgaataaagaactttctgaatatgagtactgtacttttgctggatttgtaatagggtaaaaaggagagattaggaaactaaattaaagcataaggtttta

SEQ ID NO: 217881 - DNA, 221 bp, Homo sapiens
cggcacgaggattttaccattcagtgttaaatcaacttttagtgtaaatttaaggcccatcttctaacataggggtacgtgtgattttactgtgtcccttctccctaacactccagttcaagatagcaacctaaattctgagttgattattctggacacactccctcaaaatgcgactgtaagacaccagaatacaccaccccagtatgccaatatatcaa

SEQ ID NO: 217882 - DNA, 476 bp, Homo sapiens
agaaattggtgttgtaactacttttgaagatagaatacttgttatattaatttggttttattattcttgccttttttttttttgtagaaaatcatggctttctttttcttattctttgagggacagggtctcactctattgcacaggctagagtgcagatcacagctcactgcagcattgaacgcctgaactcaagcagtccttccacctgaggttcctgaagcgcttgtgactttttatttcttcatcctttccttctctctctctccctccattctgtccttcttttattcacttgattcttttttttttttttttgacttttaagttcaggggtacatgtgcaggtttgttacataggtaaacttgtcatggagatgagttttagagattattttatcacccaggtattaagcctactaaccattagtgatttttcctgatcttctccctcctcccaccctccaccctctaat

SEQ ID NO: 217883 - DNA, 689 bp, Homo sapiens
catagagcataacttgaaaatttagtaaagaaaagatcagggaaatcagatgctgagctgttgttcaggtccccttggcaaactaaaaatatatgaatataaatgtgtcaagttcattagacactcaaagggctccctttgattctggtaatgccttaagggcagaaatcactgagagagaatcaggccagagacaagccttcagaagagtctttgctgaatgtgaaatgagttcttgtctcattcaggactggcattgaacacattactttttgaacccggctttaggaggaggcaggcttgggataaaatgtcagtttgacttcttgctagttatcggaaattgttgaagttacagaatgatgccgctcccccatctgctaagtagagatgatacttcttggggcagcaatgaagattaaagttgtgatgtaataggcttagcatggaatttgaaatccttctcaaaggggttgtgaagttctgatttatggtctttcttgctggtatgatctctttttgtgatacttcttcagtgaacatatatattcactcttccctgagaccaatgccactgtcctcaatcggacccttgacaagttttacaaacctcctgtgaatgtgatcaaaccctacctgtacttacaagccttcaaagactctcacttttctaaaaaagcatcttcctt

SEQ ID NO: 217884 - DNA, 324 bp, Homo sapiens
acagaatagcattcaaagctgatcaggtacaaataagaatgtaatggatgataaagacagagcccgtttagtggagaaaggaagaattatctactacatgaagctgggaaaataggctggctgttagggatcaaaaaaattttagcatcaccttacacaatttaccaaaattaattccatttagattgaaaagttaaatgtaaaaacaaagacagataaaaccctgaaagaattctaaggaatatgggtcaagtgcagtggctcacacctgtaatcccagcactttgggaggctgagacgggaggactgctagaggccaggagc

SEQ ID NO: 217885 - DNA, 1191 bp, Homo sapiens
ttcaggcagctctttgcacgatgcccggggagctggcacagcaggcagtggcaacgtttctgggagccattcctaccctggggtgctagcaattgcctaaccacacacagaagtgatcggaaaccacataaatgcacctcactaagcccaaactgcagggaccccctaactcctcttccactcagccccaccccccaaatacctgtgggcacaccagtgccacctgacctaaagtggagtgtgatggaggtaccggagtagaaggtctaacagatatatcattttatatgttttatcgaaacataacatcattgtgtgaacaatttctagggctcctccccttgcaaatgaggggccctgtggtagccactgagtgctaagaagcgagatgttcttcctaccaaccgtcggctttagactgggccacctcgtggctgcccaggttggagaagggttgtgaagcatggggtttgtagtcagaagatatgggttgatctgacaaaactgggctgtaaacactgtacagcatcagttactcttactggccaaatgagcacttgttaagtgcatctggcatttgagccattgctggtaccaagtgctccgctaaatgctggaacgactgagaaagagccaccactctgcctcgcatgcttctctgggacacacagacctgggggcctgagccctaggtgggaaagcactcagaggtaatttctccttctgggagggctgcacagcccccagcccagggcaatgaacaaacagggggagcccaggaaggggagtcctgtccagggcacagtcttcgagtccccaggacaccatcacctgccacggcacagaaccgcaggctgtgagagttgattccaggggtgtattttatagcttactgatgagctgtcctctcctgtctcaggatctgacctgtgccctggctggctcgaaggctccatcttttgggaggagactgaaaactgcttcagaaagatgccaagagaaagaacaagatcattttcaccttctgacatgaaaaacaggatgacgcagccaggtgccaggcttgcaggccaggctgtggtctggagacaggatctttccacttccgtctttcctcctccctcacctctttaagtccaggactgactctgcagggacctcctgtcttgcaccccctccatgcaagccccg

SEQ ID NO: 217886 - DNA, 535 bp, Homo sapiens
atgccgggagaatgtttaattgggtaattacccaggttcagttctctgaacttgcttaattccctggataacaaaaaaaaggaaagaggggtaacttaccagtcagatatctactcccttttttaatgttatatagacctggatgcttagcttgtttgtgcaaccctagtcaatttgcacagcttcgtttgtaccattttttttggaagaggcaaaataagttctgttctcaaaatagagtcaccacaggtggaaacataacacttgtaagtagttcctctggttttctatctattcagttacttttgtgctaaagagtagacgtttgagttaactataacttattgtatatttcaaaatcaagattggaattgaaatgttcctaacacaaatattaaatgcttgaggtgatgaatataccaattaccctgatttgatcattatgcattgtaagttatcaaaactttacatgtgccccataaatatgtacaactattgtgtatctataaaaattaaataaaaatatactgagcca

SEQ ID NO: 217887 - DNA, 224 bp, Homo sapiens
cgtcacgcaaacccaagaggcggagggccgctgacgtggaaccatcatcacccgaacccaagaggcggagggtcggtgatgtggaaccgtcacgcaaacccaagaggcggagggccgctgacgtggaaccatcatcacccgaacccaagaggcggaggttgagctgagaagaggccagtgcactcaagcctgagcaataagaataaaaccgagtagaacaaaat

SEQ ID NO: 217888 - DNA, 518 bp, Homo sapiens
atatttcaataatattaaatggtattattttctaccagtttttaatcagacttgaagcttttcaggcacattagagagtaaatggacttttgtgtgataaattgggtacctaatcaccaattttaatttacttctgaggaaaattctattgtaaattccagacaactggtttgcaaaccctgctttagaatgcaacctctttctaggatgaggcctttttctgtagcaaatttctgtataacgaaaataccagaataaatgctgggttttaatggacagttatgctctactacattcatgaaaaatgtacttaatttacaactctactgaacacaattcagttttttccttcgttcagttttttttcatttcagtttttctactctaacccagattgaaactttgcattatctttaacttctctgtctttatatttatttccttcatttagttattcattttttcaatcattcattcactcactcattcaataaatatttactgagcatctacttgtt

SEQ ID NO: 217889 - DNA, 480 bp, Homo sapiens
tctcgatctcctgacctcctgatccgcccacctcggcctcccaaagtgctgggtttacaggcgtgtgtcaccgtgcccggccgcctttgaacagttttcaaagcaatgttttgtacaagctcagagcaaacacttctgagctaggctagtctttccaggcacatagacataaccagctgtaaacgctaaaaataagatatggcacacatatatggtatggtgtgatgttttctttcacagaattcaacgggttttgatttgaacagttttctttttctttttttattttactttaagttctgggatacaggtgcagaacatgcaggtttgttacataagtatacttgtgccatgttggtttgttgcactcatcaactcatcatctaggttttaagtcttgcatgcattaggtatttgccctaatgctctccctcctcttgcccccaacccccctgacaggctctggtgtgtgatgttgca

SEQ ID NO: 217890 - DNA, 288 bp, Homo sapiens
gaatggaatgcaatggtacggagtagaatggaatggaacgaaatggaatggaatggaatggaatggaatggaattggatggaatgaacccgtgagcattggaatggaatggaatggaatggaatggtatggaatggaatgggttcaactcgaatggaatggaaaggaatggaatcaacaccgagtggaatggcatggaatggaatggaatggaatggaatggaatggaatggaatggaatggaatggaatggaatggaatggaatggcatagaatggaatggaatcaa

SEQ ID NO: 217891 - DNA, 157 bp, Homo sapiens
attattaagtatccatatgttatgtgtgggtttctgggttctcctctgttccattctattcctttttttttttgctatccctgcactaataccacgtttcagggggctagaaaataaacagcaaaataaacccaaagaaagaaggtaaagccagttt

SEQ ID NO: 217892 - DNA, 1129 bp, Homo sapiens
cggccgctgcgtccgagtggcgtgtgtgcggcaggtggggctggctgacaaacgtggacgttaattagagccattttaattagaaattatggacgaggtgctcctcgttaattttcaaataaaatttacagagggtttaaatcacttccctccgtgtctccccatttagcacggggattggcgtcgttaactccgtgtgtagaacagggcacgctaattcagtcatgcctgatttaaatatgtttagaacttccaactaacatgtaggagatgggaacatggaacgctgctagctgcaggcaggaggcaggagcctagccccggaaggcccagcccgtcctcgtgctgtctccggccggtgctcgtgctgaggctctcctcgggcagccacccgggagcagacaccgtgtctttcctttttaacatttcccacttggtttctacgtaatactgttttccttttgacgcagatgttctgtcttcagaaaatacttaggcgggtttgaatatgtgtgctgtgcatttggagtgcctctgagtggcttccgtctggggacagatgttccgtcttcagaaaatactcaacgctggtttgaatatgtgtgctgtgcgtttggagtgcctctgtgtggcttccgtctgggagcaggccgagggtgaatctcctggatcaatgtgcagcgtcatttggtagattgcgtgtccagccttgccgcgctgtagggtgggtgtgatcatccgtggctgcgtcattcgctgagctgataaaaatcctctggaaactttcacgttgcctgctgccaaattacatagctcaaatcaccaattactttgtattgtgtaattaacaaaatattaatttcctatcagccagtgagtcagaaacccatcttaagcttcgttctctttagtaccgtcagcgtggctctgtctttccttctgctagttaccgggttacttgtttccgtggctgaaagatacgggtttgtttttgttctcgccgatgttgagtctgatgtggcagccacatgggtttggccgtggatgcatcctccattgcccacagaaccagagtcgtccccccgactctgtggttttctttctctgtcggccgcctgcctgcctcctc

SEQ ID NO: 217893 - DNA, 744 bp, Homo sapiens
gaagtccttggagattttgctcccggcagctggagtgcaaggagctgcctggagatgaagtgattggcgggctcgcctagctcagatgttctgtcttcagaaaatacttaggcgggtttgaatatgtgtgctgtgcatttggagtgcctctgagtggcttccgtctggggacagatgttccgtcttcagaaaatactcaacgctggtttgaatatgtgtgctgtgcgtttggagtgcctctgtgtggcttccgtctgggagcaggccgagggtgaatctcctggatcaatgtgcagcgtcatttggtagattgcgtgtccagccttgccgcgctgtagggtgggtgtgatcatccgtggctgcgtcattcgctgagctgataaaaatcctctggaaactttcacgttgcctgctgccaaattacatagctcaaatcaccaattactttgtattgtgtaattaacaaaatattaatttcctatcagccagtgagtcagaaacccatcttaagcttcgttctctttagtaccgtcagcgtggctctgtctttccttctgctagttaccgggttacttgtttccgtggctgaaagatacgggtttgtttttgttctcgccgatgttgagtctgatgtggcagccacatgggtttggccgtggatgcatcctccattgcccacagaaccagagtcgtccccccgactctgtggttttctttctctgtcggccgcctgcctgcctcctc

SEQ ID NO: 217894 - DNA, 392 bp, Homo sapiens
cagggtgactcaggtggacccttggtctgtgacaaggatggactgtggtatcaggttggaatcgtgagctggggaatggactgcggtcaacccaatcggcctggtgtctacaccaacatcagtgtgtacttccactggatccggagggtgatgtcccacagtacacccaggccaaacccctcccagctgttgctgctccttgccctgctgtgggctccctgactcctgcagccattctgagtgcaccagaaactgtgaggctgcagtggggaccacagtattggctcacctcctctgggctgtgggcgcttcagggacagggttgggactgcctgctggatcagattccggccccttttgtctcgtttgctaataaatacgtgtgcatgttc

SEQ ID NO: 217895 - DNA, 373 bp, Homo sapiens
aaccctagcttcctcaccactgctccctaaaatcagacagcaacagggtctgtacaatatgcatttcagcatgaatttccatgttcactcccacagttcccaaatgagtccagccccaagcgataagctatgggccagatgggttctaggaggatgaacctagcagcagccacctcagtgataggaatcaggagactgggtactaaggttcagagtcagggtcaggcacagaaatggaaaatggttgtccaggatgagcaatttgcctctcacggtttctcaggccgtggtcctgacctgtatcttcccctaatctccccgtccctgggactcacccatgcataagaattacgttcaataaaaacaaatatat

SEQ ID NO: 217896 - DNA, 456 bp, Homo sapiens
gtcttaacgttaatgggcaggcctggacctactgtttagagctactgggttcaaatttcatctttttatggctggaccttgagcaagctacttaagtcctctgagctgcagtacctacatcttaaggttgtttggaggataataaagttaatatattataaaattctgacaccttgccacagggtagatggctcaagtgtgtatgtcatttcttctttatctgtctgactctgataagcctacaaagatcttcagggaaaggatgaaatcttattcatctgtacaacactacagttagcacacaacccagaacacagtgaatcctcaatccatgttgaatgactcaactattgggaaataaatgttgaagagtagaaagaaatggttcctttttcttcctactaatagggaagagagcctctctccaacccccaacctcaaaaaaaggaaaagaag

SEQ ID NO: 217897 - DNA, 573 bp, Homo sapiens
agaaaaacaatcaacaactccagggaaaacaaaagccaggcaggaaaagcagtcacacggtcctgcgtggttcagcagtgagcaaggtgtttatcatcaccacgtcaacagcagaggcagatccaacccccgagaaagccactctgacgggtatgagtggggagcgcaggtgtgcagcggggagggcagaccttatcgggtgacctgttctccctggtcaccaggtaaggtcagcagccctaaacccattccaaagtggccacttggtttggccttgagaagggcaagacagcgcctctgggaggtgggaggcattactcctgaggttactcatgccctgatagggtctgtctgtgtccccacccaaatctcatcttcaattgtagttcccataagccccacgtgtcgtgggaggaacccagtgggaagaaattagatggatgggagctgtctcccccatgcagttcttgtgatggtgagtgagtctgcatgagatctgttggttttacaagcacctggcatctcccctgcttgcgcttctccttcctgccgccttgtgaagaaggtgccttg

SEQ ID NO: 217898 - DNA, 557 bp, Homo sapiens
  misc_feature (495)..(495): n is a, c, g, or t
  misc_feature (502)..(502): n is a, c, g, or t
agaatatcagagttttgccagaaacccttgagtctggagtggtacggctggagtccagattgcagtctgtggaggagtggacaggagaccaagaaattctcgagttctcttcagagaccaactggggatcaacaattcaatttaattctgacacccaaggaagaagagagtgcacctgatgtagtagccactgtaagaactgtgttggagaatgatccgattggccagtgcaagagggattgcagagaagaagaaaccacaagcagaaaaaccagatgaggaaattaagctaaatattaactatctcaagaatattcccagaagtgactgctaaatttaaatccctgctcacaatgaaatactgtacagcaggggttctcaaactttttggtcttaggacccttacagccttaaaaattattgagaactccaaagaactttcaattatgtgggtcataactactgatacttactgtattataacttgaaactganaaaattnttaaatatttataaacatttaaaaataataaacccattgtaagctaatgtaaata

SEQ ID NO: 217899 - DNA, 1818 bp, Homo sapiens
  misc_feature (1816)..(1816): n is a, c, g, or t
ggaccgtgtcaaattcatggaacgtggcatcgtgctctgacaaggagagcaagaggtcaggatccacaaaacaggccggatgaaatcaccatctccgtgcggggaggtggagagagcagagccctccctgccagtctggcaactccagcaaagtcctcaggctcatcccacacactcggtgctagtcactgctgtgtgtttacatgagtaatggagctgccgggggaggggagttgtaagcagagcgctgagcctcgcagctcgcattcggagggaagctgacatccacaccaagtcgagacttccagggatgtggccggggagcagtcacatgctgtagctttcatgagcacaggcatcagtcaggcagatgtttgtcgactggaatggcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactatgtttcaagctgctcaaaaactgggaggatatgaaacaataacagcccgccgtcagtggaaacatatttatgatgaattaggcggtaatcctgggagcaccagcgctgccacttgtacccgcagacattatgaaagattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagcaagaaagaaaaagaaaatgccccaaagccccaggatgcagcagaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagccccttaccacgctactcctacctatctccccttttatactaataatcttnta

SEQ ID NO: 217900 - DNA, 1937 bp, Homo sapiens
tgagttcaatcaattcagaacgtcgagatggagcccaactcactccagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggagctccagctgttgtgggaagagaggaccagccggcaacttttatccagctctaaactttatttcctcccagaagacactccccagggcagaaatagcgaccatggcgaggatgaagtcattgctgtttccgaaaaggtgattgtgaagcttgaagacctggtcaagtgggtacattctgatttctccaagtggagatgtggcttccacgctggaccagtgaaaactgaggccttgggaaggaatggacagaaggaagctctgctgaagtacaggcagtcaaccctaaacagtggactcaacttcaaagacgttctcaaggagaaggcagacctgggggaggacgaggaagaaacgaacgtgatagttctcagctacccccagtactgccggtaccgctcgatgctgaaacgcatccaggataagccatcttccattctaacggaccagtttgcattggccctgggggggcattgcagtggtcagcaggaaccctcagatcctgtactgtcgggacacctttgaccacccgactctcatagaaaacgagagtatatgcgatgagtttgcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactatgtttcaagctgctcaaaaactgggaggatatgaaacaataacagcccgccgtcagtggaaacatatttatgatgaattaggcggtaatcctgggagcaccagcgctgccacttgtacccgcagacattatgaaagactcctctcacatccttgtgatcagatgcaaccgctaactaccaaaatttgaagatcattgattttatttacaacagtgcctctctcaatgttcaatcaatcattctccaagaggaatcacccataatcctatgtgttgtggtggggagaaaaagctaggattaccgttctagatgtcttccttttaattggttctaccaaagaagggcagaggacatgcacatatatccaagaagagactgaagctctgggctaaaacttcatgattatggtggatttcattcattcttgctagtcacaggttgcatgaacagataaaacagagatgactggattggtgaaggaacactgttttcaagaagggtcaatgagttgagaatggtcaggactttgtgggcaaatatctagtctggaaatgcccttggaattttgtaaagccttccaaaccaaatcaggatgatgagagctcttcctactaggctgcgggttcttctgttctcattcttttcactccgataaagagaactgctctttttcctatttccctgccaccagctttgctttcctagaagatgaagaagtgagtgatctctatgcattatccactgatttatttttcatgcactgtggttcatgtttccagtaaacgttttcattttacaacaagaaaaatgtagccagttcctcagtaaaatgttacttgtatatta

SEQ ID NO: 217901 - DNA, 1957 bp, Homo sapiens
  misc_feature (1955)..(1955): n is a, c, g, or t
tgagttcaatcaattcagaacgtcgagatggagcccaactcactccagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggagctccagctgttgtgggaagagaggaccagccggcaacttttatccagctctaaactttatttcctcccagaagacactccccagggcagaaatagcgaccatggcgaggatgaagtcattgctgtttccgaaaaggtgattgtgaagcttgaagacctggtcaagtgggtacattctgatttctccaagtggagatgtggcttccacgctggaccagtgaaaactgaggccttgggaaggaatggacagaaggaagctctgctgaagtacaggcagtcaaccctaaacagtggactcaacttcaaagacgttctcaaggagaaggcagacctggcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactatgtttcaagctgctcaaaaactgggaggatatgaaacaataacagcccgccgtcagtggaaacatatttatgatgaattaggcggtaatcctgggagcaccagcgctgccacttgtacccgcagacattatgaaagattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagcaagaaagaaaaagaaaatgccccaaagccccaggatgcagcagaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagccccttaccacgctactcctacctatctccccttttatactaataatcttnta

SEQ ID NO: 217902 - DNA, 1765 bp, Homo sapiens
  misc_feature (1763)..(1763): n is a, c, g, or t
ggaccgtgtcaaattcatggaacgtggcatcgtgctctgacaaggagagcaagaggtcaggatccacaaaacaggccggatgaaatcaccatctccgtgcggggaggtggagagagcagagccctccctgccagtctggcaactccagcaaagtcctcaggctcatcccacacactcggtgctagtcactgctgtgtgtttacatgagtaatggagctgccgggggaggggagttgtaagcagagcgctgagcctcgcagctcgcattcggagggaagctgacatccacaccaagtcgagacttccagggatgtggccggggagcagtcacatgctgtagctttcatgagcacaggcatcagtcaggcagatgtttgtcgactggaatggcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagaataacagcccgccgtcagtggaaacatatttatgatgaattaggcggtaatcctgggagcaccagcgctgccacttgtacccgcagacattatgaaagattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagcaagaaagaaaaagaaaatgccccaaagccccaggatgcagcagaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagccccttaccacgctactcctacctatctccccttttatactaataatcttnta

SEQ ID NO: 217903 - DNA, 438 bp, Homo sapiens
ctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagcctctccagcagctacccttatgg

SEQ ID NO: 217904 - DNA, 709 bp, Homo sapiens
tgtggaaacacttctgtgctacacaaagtcttctaaacaaaacaaatagtccatgccctggctccaggctgcggaccgtgtcaaattcatggaacgtggcatcgtgctctgacaaggagagcaagaggtcaggatccacaaaacaggccggatgaaatcaccatctccgtgcggggaggtggagagagcagagccctccctgccagtctggcaactccagcaaagtcctcaggctcatcccacacactcggtgctagtcactgctgtgtgtttacatgagtaatggagctgccgggggaggggagttgtaagcagagcgctgagcctcgcagctcgcattcggagggaagctgacatccacaccaagtcgagacttccagggatgtggccggggagcagtcacatgctgtagctttcatgagcacaggcatcagtcaggcagatgtttgtcgactggaatgggtaatcgctactttctctttgcttgatttttgtttgtgagcttgtttacctttggtaattccaggctggctttctgggatggactttcagaccagcgtttaggggaatgagaggagagagcgggtgtgggaaggggatcctaagccctaaagcctctttttaaacttttgcctctctgattttaaaggcagttctgctttactgagcttccaccaacagtaaaactgttatccggaggagaaaatca

SEQ ID NO: 217905 - DNA, 672 bp, Homo sapiens
tgagttcaatcaattcagaacgtcgagatggagcccaactcactccagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggagctccagctgttgtgggaagagaggaccagccggcaacttttatccagctctaaactttatttcctcccagaagacactccccagggcagaaatagcgaccatggcgaggatgaagtcattgctgtttccgaaaaggtgattgtgaagcttgaagacctggtcaagtgggtacattctgatttctccaagtggagatgtggcttccacgctggaccagtgaaaactgaggccttgggaaggaatggacagaaggaagctctgctgaagtacaggcagtcaaccctaaacagtggactcaacttcaaagacgttctcaaggagaaggcagacctgggtaaatatgacttgtaattttaaatctaatgtgtgggcgtatatagtaacttttcggttgaagatttttctggaaacactatcatttatatataaatgtatttcaaatttctttaacctcaaagggtcctaagaatatggatg

SEQ ID NO: 217906 - DNA, 2189 bp, Homo sapiens
  misc_feature (2187)..(2187): n is a, c, g, or t
tgagttcaatcaattcagaacgtcgagatggagcccaactcactccagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggagctccagctgttgtgggaagagaggaccagccggcaacttttatccagctctaaactttatttcctcccagaagacactccccagggcagaaatagcgaccatggcgaggatgaagtcattgctgtttccgaaaaggtgattgtgaagcttgaagacctggtcaagtgggtacattctgatttctccaagtggagatgtggcttccacgctggaccagtgaaaactgaggccttgggaaggaatggacagaaggaagctctgctgaagtacaggcagtcaaccctaaacagtggactcaacttcaaagacgttctcaaggagaaggcagacctgggggaggacgaggaagaaacgaacgtgatagttctcagctacccccagtactgccggtaccgctcgatgctgaaacgcatccaggataagccatcttccattctaacggaccagtttgcattggccctgggggggcattgcagtggtcagcaggaaccctcagatcctgtactgtcgggacacctttgaccacccgactctcatagaaaacgagagtatatgcgatgagtttgcgccaaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttggtggcactttataaatacatgaaagaaaggaaaacgccgatagaacgaataccctatttaggttttaaacagattaacctttggactatgtttcaagctgctcaaaaactgggaggatatgaaacaataacagcccgccgtcagtggaaacatatttatgatgaattaggcggtaatcctgggagcaccagcgctgccacttgtacccgcagacattatgaaagattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagcaagaaagaaaaagaaaatgccccaaagccccaggatgcagcagaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagccccttaccacgctactcctacctatctccccttttatactaataatcttnta

SEQ ID NO: 217907 - DNA, 1113 bp, Homo sapiens
tgagttcaatcaattcagaacgtcgagatggagcccaactcactccagtgggtcggctcaccgtgtggcttgcacggaccttacattttctacaaggcttttcaattccaccttgaaggcaaaccaagaattttgtcccttggcgactttttctttgtaagatgtacgccaaaggatccgatttgcatagcggagctccagctgttgtgggaagagaggaccagccggcaacttttatccagctctaaactttatttcctcccagaagacactccccagggcagaaatagcgaccatggcgaggatgaagtcattgctgtttccgaaaaggtgattgtgaagcttgaagacctggtcaagtgggtacattctgatttctccaagtggagatgtggcttccacgctggaccagtgaaaactgaggccttgggaaggaatggacagaaggaagctctgctgaagtacaggcagtcaaccctaaacagtggactcaacttcaaagacgttctcaaggagaaggcagacctgggggaggacgaggaagaaacgaacgtgatagttctcagctacccccagtactgccggtaccgctcgatgctgaaacgcatccaggataagccatcttccattctaacggaccagtttgcattggccctgggggggcattgcagtggtcagcaggaaccctcagatcctgtactgtcgggacacctttgaccacccgactctcatagaaaacgagagtatatgcgatgagtttggaggcagattaacttcccattgttcttactaagaagtacaaagttaccaaaccaatgaactgaagaaaatctagaaaagttttcacgggtagatattgattgagtttccactagagacgaatgatcatctgtattgttattcttttcgggttctgaaatggcttggaaagaacttttaaataaactgggcaatacagtaactgatcacataaaattatatttaatgagatgtgtcatctatcacagtgttttccacacagttcttatcttacatctttgtgattcatttgtgctttatttttattgcaacaaatctcacagtaaagaaacctctttatcttggccatagaat

SEQ ID NO: 217908 - DNA, 1172 bp, Homo sapiens
  misc_feature (1170)..(1170): n is a, c, g, or t
ttctgggtttccagaacagactgttctcttctgactgttgcatatgtattgaagcctggcactatgaatctcttatgatgtaagattgaatttcccattgccattttttcagataacagcccgccgtcagtggaaacatatttatgatgaattaggcggtaatcctgggagcaccagcgctgccacttgtacccgcagacattatgaaagattaatcctaccatatgaaagatttattaaaggagaagaagataagcccctgcctccaatcaaacctcggaaacaggagaacagttcacaggaaaatgagaacaaaacaaaagtatctggaaccaaacgcatcaaacatgaaatacctaaaagcaagaaagaaaaagaaaatgccccaaagccccaggatgcagcagaggtttcatcagagcaagaaaaagaacaagagactttaataagccagaaaagcatccctgagcctctcccagcagcagacatgaagaaaaaaatagaagggtatcaggaattttcagcgaagcccctggcatccagagtagacccagagaaggacaacgaaacagaccaaggttccaacagtgagaaggtggcagaggaggcgggagagaaggggcccacacctccactcccaagtgctcctctggccccagaaaaagattcagccttggtccctggggccagcaaacagccactcacctctcctagtgccctggtggactcaaaacaagaatccaaactgtgctgttttacagagagccctgaaagtgaaccccaagaagcatccttccccagcttccccaccacacagccaccgctggcaaaccagaatgagacggaggatgacaaactgcccgccatggcagattacattgccaactgcaccgtgaaggtggaccagctgggcagtgacgacatccacaatgcgctcaagcagaccccaaaggtccttgtggtccagtcgtttgacatgttcaaagacaaagacctgactgggcccatgaacgagaaccatggacttaattacacgcccctgctctactctaggggcaacccaggcatcatgtccccactggccaagaaaaagcttttgtcccaagtgagtggggccagccccttaccacgctactcctacctatctccccttttatactaataatcttnta

SEQ ID NO: 217909 - DNA, 319 bp, Homo sapiens
aaagagagggagagggagaccgtggaaagagagggagagggagaccgtggaaagaggggagagggaaagggagagggagagggagagggacttttgtgtggaatcgagaatacatatttttaaaaataagtagtgtgcatagtatactagaagatgaccatggaaagtgagagtagggtaagggaaatgaacagggagtgtgtaggagggatggtccaggtaagccatcagaggcaagacttcaagggaaagaggaagtgagccacgcagatgcctgggggaggtgctccagggagaggtcacagccaactccaaggcc

SEQ ID NO: 217910 - DNA, 353 bp, Homo sapiens
actgtaaacttagagtcatgagattatgagctgatttggtcaccttcctctgcctttgttcaccgtgagttctgatgtcttagtgacttagttcaaagaagcttacgtcttagtttgaaacaggttctccacggtggtccccaaaacattctctgcatatccataagaattgagcgctatgggtgttaacatgcagaaagatcagtttgcagcagcaagtacaaaaggagaataggaatatctgtcgaatgagtgtgttttgtacataacttcagatacttgtgaacatgccttatatttgtccaacaactgtcagaataaagaacattctaaaacgagcaaaaaaaaaaaaa

SEQ ID NO: 217911 - DNA, 413 bp, Homo sapiens
tcctctttctttttttagggcatatgtgattacgctgagtctacctggatcatccagcatactgttttctgaataaggacccttggattacattggatccacctggaaaatccaagatgacttcattgtaagattcttaattgcatttacaaagtgtttaccttataagaaactatatttacaaattctgggtgttagaacataagaatcttggaggggggacattgttctgcttactatactttcatatttgtaagaatttaaaccaaatatataatagaagaagcatgtccttaatcaggtatttgagtggtaaatttatagtatataccaagaaactgcctgcattagtctgttctcatgctgctgataaagacatacccaagcctgggtggtttataaaggaaagaggt

SEQ ID NO: 217912 - DNA, 251 bp, Homo sapiens
tcctctttctttttttagggcatatgtgattacgctgagtctacctggatcatccagcatactgttttctgaataaggacccttggattacattggatccacctggaaaatccaagatgacttcatttgacttcatggagagttcctgaataatcagttgacagaggaagaaaagacaaaggcctggtttacagatgattctgcatgatatgcagagacctaagagtgaacaatcagagaactacagtctc

SEQ ID NO: 217913 - DNA, 435 bp, Homo sapiens
aacttaacagagactacagaaattgtttaaaatccagatccatgagagatttttcatggaggactattttattattgacacagtttagaattactggtacataaaaattactggaaataaaaaacagacttttagtgggtttactgtagtttaaattctctacagataatgagaattactattgtccatacccaagatctactgttcttattgccccactcttggtatgccattcaaggtaaaatctgctctaagtactatctttgaagatgggcttgctgcattaagtattcttaacctacttaggagaaaactttacaattaatttttattgagagcctactgagtccatggtattgtatccacacagactgcatgcacatgaatgtcgctagttactaatcatatttatttgctaaagtcatctcaacagga

SEQ ID NO: 217914 - DNA, 292 bp, Homo sapiens
cttcaatccagccaccagaagccgcattgtttacttcatcctctctcgggtcaagtatcaagtgataaacaatgttagcaagtttgggatcaacagacttgtaaactctgggatctacaaggcagctttcccactccatgattgcaaattccgccgtcagtcagaggatcccagctgccctaatgaacggtaccttctgtacagagaatgggctcatcctcgaagcatatacaaaaagcagcccttggatcttatcaggaaatactatgagagaagattggatctacttgcg

SEQ ID NO: 217915 - DNA, 484 bp, Homo sapiens
agtgtcttcagtgactagtttctcattatatcatctggatgcatattagagacgttaactcattacatactgtggatgtcttggggcattacatcttcacgctctcagggaaccacagttgagaagaaatttctaaaagatatgccacgagcagatggaaagtctgacttttaagaaagaacgtggaatccaagaaggatgctgacatatgtgagagtgaatatggacaaacgttaactccatagaaatagagccaatgtctaacttgaggtagcatcagcataaaactctaagaccaggcaaaaacactgtgtaaagcgagagggatgtgatggccaaaaagtgatctaagatttctgtaattctcagatattaactttagactttgttgaatattcctagttaataaactaagcttaatgtttaaagaatatacatagagcttttaactttctaaaaaaattaggaggataaatagagtaag

SEQ ID NO: 217916 - DNA, 1077 bp, Homo sapiens
gtgggtcaaaaggtaaatcatacgcagttttgttagatattgccaaatttccatccaagagaattatatcactttgcatcttagtgtagtttaatttgcatttctcatattacaaatgagattgaacaatgttccatgtgtttaagggccatttttatatcatttttgtatgtattgtttgttcttgtctttccctattatacttggtttttttggccttttttcccttgcttaaaaattttttttaaattaccttactttttaagagttctttatatattaggattatgctgcagatattttctgccagtgtgtgtcagcagtcctttgattttgcttccgttatttttttgccatgcaaaaatttttattatgtaatcaaatttaatctgttattgcctctgggtattaagtcagagttagtactctctccctgaactgaggttaaagaggaattcacttctttttgcttgtatggtttcattttttacatttagttctctgatctatttgaagtgtattcttttgtatgctgtgaggtatggatttgatcagttttttctaaatggctaattgattgtcccacacttttattaaaaacctgtctttgccccagtgattcatgatgatgcttttattgtattttaaatttccatatatacttgggtatatttctggactttctattctgtttcactcatctggttgtctgttcatgtgccattttacattaaaaaaattttttttgttttaatttttatttagagacagagtctttctttgttgcccaggctggagtgagcgatcatggctcactgtaacactgaactcctgagctcaagcaatcctcctgcctcagcctcccaagtagttggaactttaggcgcctgtaccattattatgatactttaattatagaggctttatagtatgctttaatgtctggttgtggtactcagtccttatagtttttctctcagtattttcctagctataattatatgtttgttttttcatatcaacttgaatattaatgtctagctccattaaaaagtttgtttgcagttttattgggat

SEQ ID NO: 217917 - DNA, 517 bp, Homo sapiens
atctccgctcactgcaagctctgcctcccaggttcacgccattctcctgcctcagcctccccagtagctgggattacaggtgcccgccaccacgcctggctaattttttgtatttttagtagagacagggtttcaccatgttagccaggatggtcttgatctcctgacctcgtgatctacccgcctcagcctcccaaagtgctgggattacaggcatgagccaccgtgcccagcctgttcaaatcttttgtacattcttcttttgggtttctttctctaataaataaatttagttgtaaaagtcaatttttgttagatgtatatactgcaaatattttctccactctgtgggctgcttttgcactcttttacttgtgtcttttgacaaatattaagattgtaataaaagcttggtcaaaagaggatcccttaaaaattgtatttatgtgtattccattctaccctatccatttctgtttcttttttttatttttattttttcagacggagtcttgct

SEQ ID NO: 217918 - DNA, 386 bp, Homo sapiens
accacacccagctaatattattttttgtatattatgtacagatagaccatgttgcctaagctggtctcgaactcctgggctcaagtgatcctcccacctcagcttcctgagtagctgagactgcagatgtgctacggattggctgggcagctcttcttacctggactcattcgtgtgttttccttcacttaggttcatctggtgtgtctatcccatccctctgcctcatcgctcacttaacaatagcagcctcctcatgacaacatgccctagtatgaaagctcttaccagacctcagcttgcatcctgtttgcttatgtttctttggccaaaacaagtcatatggtcaagcccaaagtcagtgggggaggtgattacacaaggac

SEQ ID NO: 217919 - DNA, 498 bp, Homo sapiens
cagacatggctccatgcgggcaggacccctcgctggggactctgtctttccttctccccagcccagactcgtcctcccgcctccaggcggtcttgggaagctctgaaagccttgaggttcaccacctgccctggcttccccacctagagtcctcaggccaggtcaggggcacttttcaaaggggccacaggggtgggctgggggccttagggtttggggtgcccctggacctcctgccttgcttctggtctggtgtcatcatcagataggaggcacagccaggaggcagagcagtgcagccctaggacagccccaggaactgggctttggggtcggtgactgttggtgtgattcccttctcagctacggggctctctgagcctcagtgtccccatgggtagaacggcgacagtcacggtcccagagcttccagcccaggtcctggcaccaagtgatgcccagtgtgtgtggcgtgtcttctgcgcatggctctgacca

SEQ ID NO: 217920 - DNA, 353 bp, Homo sapiens
atggagtttcacttttgttgcccaggctggagtgcaatggtacattcttggctcactgcaacctctgcctcctggattcaagagattcttctgcctcaacctcccgaggagctgggactacaggtgcccgccaccacgcctagctaatttttgtatttttggtagagacagggtttcattcaccctattggccagggttttttggagagagatctggtctcgaactcctgacctcaggtgatccacctgccttggcctcccaaagtgctgggattacaggtgtgagccaccatgcccatgccacccttttttattaataaattaaaaacaaaggcttacaataaaattttact

SEQ ID NO: 217921 - DNA, 677 bp, Homo sapiens
cattttacagatgaggaaaataaagcttggtagttaagtaacttgtccaaggtaacacagccagtaagtgccacatttacaactcaattctaggtctttttgtctctgtctctgaattacgttagactctaatttttatccttacattagtctgttggggtcatcaatgattcttaatactagaaggttgtctctaatcttaatgaggactctgcaatcatcctttcctttaataactattcatccaagtggcttgtctatcgttgttgtaaaataagtacgtttaattttttacagaagaaatgtagtgggcttaatcatgtgctggccatgtgtgtctgtggatgcagcatttaggaatatgggtcccagagtacagggctccatctttaagctctggaggttggaagctctaggaaaactaaggtgggttaaatgtgttcccaaaactgtgatcacattttatgtttatgcttttctctccctttctcgagtcatggtaggttactatttgagtgccatgccctagaactccctaaagtaaaggcactggtatcccaaaagaactgttctaaaagattacttacttctgtgaaggcagagagggtgctacagaatgaaaatagcattttaggaaggttgagtcagaggtgcgagtggggcatagagagattttc

SEQ ID NO: 217922 - DNA, 418 bp, Homo sapiens
tacaaaaaggaccaactgtagagccagtagttacaaagattctctgaagcaagtgctatggaagagctcagggatttttctttctttttttttccatttgtattgtaaaaatatctatagtttttcacacatacaatgatgccaatttcagtttttagcgaatgaaggagacacagaaggagaaatttgtatctcatatctgaaatagtttaaacttaccttgattttttttatcctggctaatgaaattttgttcattctttactgaagattataaaatgatttgtgggccagttgtattagattgaattagaagggttaagtaggaaatgatgataaccaccttttattatattccaaagcattgtgcagaatactttgcccgcaattaaatgaatatttaatgtaatacttagtc

SEQ ID NO: 217923 - DNA, 448 bp, Homo sapiens
tgaatatagcatttggaatttaattgattgttgtaaactcacttcaagtatatcttctgtttctttgagttatgtcatgccagtccctacagagtctgttaaccttacttggtatcattgtttcactttgcttattataatttaacccaaacttccccaaattttccacaattatattattaatagaaattacagaatacatcaggatcaaggcatataaggattaaggggagaggagtaaaaaaagaaatgcgcaggggcagaattaaggaatttagattttcacctatgagcaatgtggagtctctgaagaattttaagtaagctgagttctaatttcactttttattgtgatcagctgaacttacataggcaggcagtatttatctaaggggatttgcatcagtccctttggtgttttagtgagtatatgtttttttgtgtggca

SEQ ID NO: 217924 - DNA, 341 bp, Homo sapiens
tctcacagttgatgacatcatagatttttctgaaaatgagaaagaagttttggaagtgtcagcaatattcaaaacaggagagtgaggagaagcaatgataaaaaaaaaaaagtatcaaaatttttctatttgaaaaaagccagacatttcaaactctcagactctttgaagtagaaaatataaaagacaaaaagactcacatttggatatgttttggcaaatttaaaaaatttcagtgattaagagaaatcacataagtatccaaagagaaaatgaaacacacaaaaaaggcaggaatcagattttcatcagagattttatctcctctcctttccttttgc

SEQ ID NO: 217925 - DNA, 1222 bp, Homo sapiens
  misc_feature (995)..(995): n is a, c, g, or t
  misc_feature (997)..(997): n is a, c, g, or t
taatttaaaaattttttttgtagaggtgggatcttgctacattgccagggctggtcttgaactcctgggcttaaggaattctcctgcctcagcctcccaaagtgctgggattacaggcatgagctgctgtgcccaggctagaatggtttctgtaaactttatcttttactttttttgttttgttttgtttttttaagacagggtctcactatgttacccaggctggagtgcagtggctattcacaggtgtgaccatagctcactggagcctcaaactcctggactcaagcaaccctcccgagcagccagggctataggcacgtgccaccaagcctgcctacacttgtggattttataaagtactctctacatttctttccctagaaaaaaatattaccaccctttagattctaattctaaagtgctacatctaatacctctaacataagtaaagtctcattttaaagcatgtccaatgaataaatttgcttctactgcctttgcatatgctaagattttgatggaggaccatttttccagtgagctcacagatagtaccctgtgccctatgtcagcttagggcagcagttagaggcctttacccagaaaagaaaaagcctagcttgcttctaaggctacatacatccagatctgttccaccaaaatcaaatctgtggcaaggaggtccatggctacagattcttctgctatgaggcacccagggaaatagtccagaggtctgaattgcaaacaaaataattttaactaatataaaaaagaccatctgttcagtaactaattcccttgaggacatgatatggaagtcaactatccagcttccacctttaccatgggtttaaagtggcaaggaaaaccggcccactttgtgcccagggctcacggcgggaatctacaccttttggtaattgggcctctgccaggagttggacccaactggggacaacagggaaaaccctttttttacaaaaacaccnanacctcccaagaacacctttctctctttcataaccccaaaatatccctccggaacgggggcgccctataaccccagtccttgcgcaccctcgggggggaggcacattcttggcgctacggcctctctcctgggcaacataggtgtgcccaacaacagactacacacgcgggccgctctcctacctctctttgctgctcactcatatatgcgcgcctcatgtcgcct

SEQ ID NO: 217926 - DNA, 240 bp, Homo sapiens
ttccaaatggctggcaacctacctacctgcctggacatgtgaagaattgctaacattccccttaagatgtttctgctgacctggggcaggcataaaaacacatggtatggtgtgctgggcagagctagagccttgcacacctgcgtgggcttccaatgcagcactttttttttttttttttttgagacagggtcttgctttgttgcctaggctggagtgcagtgacttgatctgagctca

SEQ ID NO: 217927 - DNA, 1080 bp, Homo sapiens
tgtgctcacctctgagcaagaatttggtgggctagttggtttaagggaatggcccactgagtttctgtctgcctgcacttcaaaactgtttaagtctttaggatcatatctagaatatttgcactgaaattcagaaagggcaatttgccatttttatatttgcaaaataatcaccaaaggaaagagtactttttctcattaccacagatcctctgaaaaaaatgcagaaatttaattttaaaattctaattatttaaaatgtataagcaaaagtttgtactctgagcttgcaagcagaggcatttattaaaatttcttttttacttatttccttttgaatgtttttaaatgatatgaaaaagcttaagaatgtggagctatgtaaaataaaaaggaagtaaccccaccaagcacctctcaggaaaccctgtttcctgcccttccctccacccactcttatggtaagctttgataatagctcagtgtgtatcctcccaggcctgtttctggacatagcaacatttctctacatatatttgttttcaataagatgtcccacatagttggtagtgagggagtgttattgttgccgttgtttttatttttttttaattttggcaaagcacacaccacctttgggatgttgctattgtttttaaatgaaatcctagtacagatattctgcaacttgcattttttactcatcaatatattttagatagccttccacattgggacatccaggtcaacctcaaatcttttaacagctgtaagacattccaagtttttttcattttcaacggatcatatacgtaactcttgttctagaaagaaaggaatctggcaacttttgaggggatcttggggattttttttttcttaagaaaataattccatcttagaaatcgctaaactctatcttgttctattgtgttttggtaacaagggtcacaaatataagatgtcatcataaatattgggaagcagtcacagtccactttatcttgttgctctgaaaatgggatttgtgaatttactaaacattcttctggttataaaaataatacatatccactgtca

SEQ ID NO: 217928 - DNA, 427 bp, Homo sapiens
tactccatcctgggcgacaaaaggagacctatctcaaaaaataaggaagggggaagggatgaagagagggagaaagggaagtttggaagaaaaggaaagaaaaaaatgtggaaaaaatcgatccaacaaaaaggtattaagactcataaagactgtcttatgtagcagtgaacatttgtcttatgatttgttaatggagagtccaccaatctttcaaatacgacatagagacaatgtcatttctaagttgaaagtggagttgagacaacagagtgattaaaatgattagtactaaaagtatatacttgtatttattttaatttacctagaataatatgtcaagaatcatatactcgaagatgaaaattacagcttttctgaggatggtagcacaaagagtaaaaatgcttctccacactgtagtttg

SEQ ID NO: 217929 - DNA, 588 bp, Homo sapiens
aatcctggttctgtcatttatcaactttgtgacattgaaaaatttacttggtcttgctgagccttagccgcagagttagtgctgagggtgctgtactatggccggcaaaattttatggaagacagcagagcccagcaataaatcaactgatttcaatcattcattcaaccacatttgctgaatgtctaccatgtaccagttaggtgctggcaatacagtgatgaatacaagaacgtggtccctgatttgttaatctaattaacaaattttataatctaattaacagcagttctcccatatctgtggttttgttttccatggcttcagttgtctatggttaatttggtccaaaatattaaatggaaattccagaaataaacaattcataagttttaaattgtgctctgttttgagtagcgtgatgagatttcactttgtcccactatgtcttgcctgggatgcgaatcttccctttgttcagcgtctccacactgttgacacttgctgcccatgagtcacttaatatccatcttggtggtgggatcaccgtgcttgtgttcaaggaacaccgattttattttaccagtg

SEQ ID NO: 217930 - DNA, 360 bp, Homo sapiens
gggcggggtgtggacccccatgctctgcttgtttcaataggcatcacgtccccagggacagccacccagagctgaggtggaggctgagggggtggtcagggtcttcctgctgtctctgaagaccccctggggacacgtgcttgtcctcctctgccctatgtccccttgtcgctcttccctcctctgttgtcccaggtcgtgcccatgtgtgcgatcatgtgcccttcaacagactatgccctgggcatgatgaggggtgggactgggggagcacgaggcaggtcctggctttaaggaggcattgggatgtggtccccaccctgatcagggccccacatccactggttcacccttcctcct

SEQ ID NO: 217931 - DNA, 434 bp, Homo sapiens
caaggtccttgacctcatgcagtcttatagggagatttataagcaattgactaattactaaaaaaaatgataaatgcaatattagtggaagcaaagttactgtgagagcaaaagagaactgcctaggccagtgcagagcaagggaagtacaaaaatttcctagagaaagtcacgtgttagttgaaatccataaggataaattagagttgcccagagagagttccacaagattagagtccatctctaatttactttcctatcccttagcaaccagctcgacatatgacatcacaggtattcaataaatctttgcataatgagtaaaagtatttttacagcaatagcactgcctttgagaaaattactattatggcataaaggatcatgggacagctgtctttagtgaatacacacatacacacctgcaaacacac

SEQ ID NO: 217932 - DNA, 366 bp, Homo sapiens
gctcagggagaactgtggctcctggaaccaattccccatggatgctcagggaggactgtgttgcacagtggtcttgcaacgcctgtaaggtcatagtcatactgtccctcttctcagctgtaaatgggctggtaaaagaatctgtctcattaatgtgttgaaaattcagtgagataacacaaagcacttggttctctttctttacgtaagaattgcttattaaaactggagtcgtaaatgttataatacttaaacctgtctgttgccccttaaatgtagaagcttctagacaatagaaactaagtcataagtgatttttgtagtcatcagatgtgtgcttttaaccattgaaattatatgtaacag

SEQ ID NO: 217933 - DNA, 488 bp, Homo sapiens
ttgagctccgtggagataggccccctctcctggcttctctgcttgagccacataaaatgccacttcacagctcttccctttgaagcctgatccagtatgcatttggagctaattactgcagttgacacaactccatctaaaagcgtcatgaaagattctgtaatcactgataagaaaatgatcttgcaaattattgctgtgtcctcctttattgcctctttaccttaacagtacagtttacaataatgtaaatttttttctaatctttcaactttaaccctagaaattgtagatgttttagcagtggttatgtgatattggcacaacataactatataatttgctcaatattgtggtgcatacctgtaatcccagctgctcaggagtctgaggcatgagaatcacatgaacccaggagatggaggttgcggtgagctgagagcgagtcactgaactccagccaggacgacagagtgaaaccctgtctc

SEQ ID NO: 217934 - DNA, 462 bp, Homo sapiens
aaatgctacatgttgagcatcccaagttcagaaatcgaaaatacaaaatgcttcaaaatcaagaactttttaagcatcaacgtgatgctctaaagaaatactcagtgaagcgtttcagattttagatctggggtgctgaactgttaagtgtaatgcagatattcccaaatctgagaaaaatccaaaatccaaaacccttctggtcccaagcattttgggtacagcatactcaaactgtattaggtatttcttttggcctagggggcattgtgaaaaattactgagataccaagggagccacaaactaagaaagtttgaacatctctgctttagaagcttgagctaactaaggatttcaccaaaaggaggaagcacctcttacctttttttgtgctgaaaagtttgagtttgcaattttaaatctgatccaaaattgtcctaatacagttgttcaacattaaa

SEQ ID NO: 217935 - DNA, 544 bp, Homo sapiens
cgcggtggttcactcctgtaatcccagcactttgggaggccgaggcaggtggatcacgaggtcaagaaatgaagaccatcctggccaacatgctgaaaccccgtctatattaaaaatacaaaaattagctgggcgtggtggcttgtgcctgtagtcctagctactcaggaggctgaagcaggagaatcgcctcaacccaggaggtagaggttgcagtgatcccaaggtcgcactccagcctgggaagcgacagacatcgtcccaaaaaaaaaaaaaaaaaactttaagcacaaactttttaaaagctgctgaaaggaaaagaaattttgaggtggatacatatagtataactcgattcctgtctttattttttaccccccgatctgacaaacatgaaagctctccacaacttctctccattatttatacatttatacattcatccagacatccaatatttactgagcacttaaaatacattaggcactgcacctatcctgacactggggattcagcaacagacctgacaataaacgtgataatt

SEQ ID NO: 217936 - DNA, 331 bp, Homo sapiens
cccgggccggtccacctaagtctccgggagctgagccacatcttgcagctcctcagatttgggtggcgggcaggagttggcaccaggtctcccagatccccaaggaaagcacccaggtgctttcatttcagagacctgggttcctagggccacctgggcgaagccttaggcggcagggacaggggcagtcccaggtgtgtctttggcgatgtctggacagctctgtccattagagatgctaaaggacatccctaaagggatgagcatattctgccttcagttccctcccctgctgctcctgtcttttaaccgcgtctgctatccctctttc

SEQ ID NO: 217937 - DNA, 497 bp, Homo sapiens
gagttcattttctaagacaagaaaataaagtcagtatgtattatttgtagatattcctaattattatatgaagtgcacttttatcctgtatcagtcattcatactcaaaagttttaaagtcgacttctctcttcttttaatgagtgactcctaaaaagaatttcttttgtattcccattgcaacttttttagatcaggaccttctgctgactttaaagagtatccgagtaaccttgtttcccacccttagatgttacaaagataaattgctttatttttttaaacttcaaagctaaaggatttatccttaactcctccttattctctcccttaaaagctgaaagagaagtttgtatgggagaaaaatcaaagggtaaggataatctatagtccctaactaatgaatggtctttagggcagcactgtccaatagaagtataatgtgagcagtaattgtgaatcacatctgtaattttaaatttcttaggagccacatt

SEQ ID NO: 217938 - DNA, 602 bp, Homo sapiens
agactccgtctcaaaaaaaaaaaaaaaagataatggaagatgcttatattccatttggggtgggaaaaattacaagcagtgtgggcaaaaaatatacattcatggaaaagtatctgaatgataaacatgagagtgaaagaataaagtcaaatatgtgagttgtttcattaaataataaactaaattattccttcctctagatcaggggtgtccaatcttttggcttccctgagcctcactggaagaagaagagttgtcttgggccacacataaaatacaccaacactaacaatagctgatgagctaaaacaaaaaaaattgcaaaaaagatctcataaaagaaagtctacaaatttgtgttcggctgcattcagagccgtcctgggctgcatgctgcccgtgggctgtggactggacaagcttgctgtagatcctctgagattgggttaagtaaaaaaaaaaaaaacccaggtttatgctgaatataagaaatatacataaaataatatgaaaaagaaaggttgaaaatgaagtgacatttaaagaggctgggcgctgtgtctcacatctgcagtctgaacactttgggaggcctaaaatta

SEQ ID NO: 217939 - DNA, 201 bp, Homo sapiens
gaaaagataacacatcatggaagaaaacatgggctgctaaattcagttagaatacatgccaaatagggcatgttgatccaacagcttctctgcatatttgggatgagtagctgttgatagggcatttcagacctcagtcttacagcatttatcatatgtatctccagcttgcacctctctccttggcaatggccttcactg

SEQ ID NO: 217940 - DNA, 602 bp, Homo sapiens
agcatccagcatgtattctattaccactcagtgaccaaggttttatcccacttgcatatctaaaccaataactgcaaagggagaaggaattgtataactggcttagaaaaatagtcattcaatccctgggatgctcaataatgaccaaaatgaaggttctgcttaccgataagaaggggtatggttgtggggtaggcagccagcactgtctgccccaggagagctccagaggagagtgtaagacaaaagccaaattctttgccatcctttatgagtcctgtgttccttctctgtagctttatctgctgctttctgaataggccaagcacttaagttgatcttatctttgaaatttcagtcccttcatcctttattgaatttttcacctctttcttcttatttttatctttcaaagcctagttcaaaggcagcctcatctacttccccataatggggtgcatccctcctttttctagcctgctatggtttggaacttctctatttggcacttttgctttcctgctttatatcagtcatatcataagtctctcaccacagtggagtgaaagctccttgaaaacagaaatggtgtcacattattc

SEQ ID NO: 217941 - DNA, 445 bp, Homo sapiens
acatacacaaatgaataaatgtgattcaccacatacacaattaaaaacaaaatgctgggattacaggcgtgagcccccgcgcctggcctactcaattgttagaagctgcaaatagcttaagtttccttgactctgaaaaagaaaacaaaggatcagcaacattttaagcgaagttaaaaagattacttcagtttagtccacgcagttaactccagttctgcttgctattcatgaatattttggctttccatgagtcctgaaagttttttcctctattctaatgtcacaacttccaaagctgtcggaaacctgcatttaagtgcacctgtcaaagtcctatggttgattataaaaccaccttttaaagaggaccaaaacaagacaattgtctgtggatgacaaaagtcttaggccagccactattaaagtcaaaattgataatgaa

SEQ ID NO: 217942 - DNA, 240 bp, Homo sapiens
tcctgtattagactaattgggttggctttgatatttaattgctaaaaacacacttagaatacaaaccttactgtgtcaaggtctcaaagaagaaataattggtatggtataaagtattgaattgtatgctacaaacttctaagctaaaatattttcaatgtatgcaaggataggtggcatacatattatatattattcccccattaagcaaatttataatgagagaaagctatcttccat

SEQ ID NO: 217943 - DNA, 434 bp, Homo sapiens
ccttattgccatgaagtttacgtaggctatattttgtttattgtaacggaattcagactttgtactatgtttatgtatactatattttgtttattgtaagggaatttagactttgtattattttgttcattgtaaaggaattctcaaaactttgctggttttgagaaatggcctaatattaggagtgtcaagaggatatgttttaataagtaatatgtaaattctgggttcttgtcttacctcagttagtgaaacatagtttaatctatgaaacagtacaatatctttgcctcagttacattcttaggaacattaaaagtattatgcattgtacattttttgagcataaggggagaggatgtcattataaaaagccatctcactgttacactcttattaccaaagagtaaaatataaccttcctgaaagtagaa

SEQ ID NO: 217944 - DNA, 247 bp, Homo sapiens
aggcagaggttgcagtgagccgagattgtgccattgcactccagcctggacaacaaaagcaaaactctgtctcgaaagaaagaaagaaaattcttgaaaacaaaatgtgaagaagtgaaaagttaaaacttttttcttatagtaattactaagtgatgtcaacctcaagccctaaatttatgttcacaagtccagtttaggctgatctgctttccccagtgcaatgtaagttccatgagggcagggg

SEQ ID NO: 217945 - DNA, 255 bp, Homo sapiens
agaaattcaggtgtagtcctagaagtcagtgagaagaaaaatataggatgttctgcaagttgtaatgatgtgtggtttaaaggcctttgagagtcctaagaaggaggcatagaggaaacagcccagcatttgaagcagacaaactgggcttcagagcctagctcagccactttagtacctgtgaggctttgggaaagttacctaacatttctgatattctgttttctcatccaaaaaattgagttgttaagaatg

SEQ ID NO: 217946 - DNA, 548 bp, Homo sapiens
accttgaaatgagatagaaagtcatttggagggacaactgaatgacacacttctgttcacaggtaaccaggaccacaaggaaccacaacagggaggattacaggattgtgttatcacctggaaaatcttgagataggaaagtacattttccaggttccttcttcctctggcttccagacaggttcagccaatggaaaacactggtggaaaattgaagtacaggaggaaacaagaagcttttgtttctgaccattaattctccgtatcaaagctccctctggtgaaacatcttgagtggtttatgctttccttcctggaccttgaatgaaactatatgtatatatatatttcattataaactacttcaaactgttctgaaagtaggtaggagttttttaaattaaaagatattgaaattgtacttgaaattttgtcacaattatctctttaaaaagtcagttattaattttataaaatgtaaaaacaaagctttttccttatataagtgaaaaagtactttaatataagatggtgttattatttacatg

SEQ ID NO: 217947 - DNA, 394 bp, Homo sapiens
gactgagtatattcttggtttccagatcccagcctggagcaaatactgtggttaagttacaggaaagggcaattgagaaaatgacagctgcctttcattgtattaagttgattcattcaacaaatatttgttgagcaaatactatgtataaaacagggcatgaagagtcatataaaacagaaaaatatgacttagttcgtgtcctcaaagaagttaaaatctggggaggcagaaagcagcattccaaagaactaaatgtgctcatcagcatttgagggctggatatggtggctcaagcctgtgaccccagcactttgggaggccaaaatggtaagatctcttgaccccagtagtttgagagcagcctgggcaacatagcgagaccaaaaaaaaa

SEQ ID NO: 217948 - DNA, 689 bp, Homo sapiens
tggcttacacttgtagtcccagtatttcgagagactgaagcaggagtttgaggtcaggagtccaagaccagcctgggtaacatagtgagaccccatttctacaaaaaaatgaaaataaaaaattacctgggcatgaggatacatgcctgtagacccagctacttgggaggctggggcaggagaattgctgaagcccaggaggttgaggctacaatgagccataatcatgttattgcactccagcttgggtgacagagccagaacctgtctcatttaaaaaaaaaaaaaaaaaaaaagttggggagggtttgtggtccctgtgggttcatggaaagcccatggatttcaggaaatccatgggtctccctgaaattgaatgtaaaatgtggtgttttgtgtaattttctagaaaaagaggcctagtctgggtatggtggctcatgcctttaatcctagcactttgagaggctgaggtatgaggatcacttgaggccaggggttcaagactagccttggcaacaaatcgagactccatctctacaaaaaaaattaaaaaaataaggctaggcttggtggctcatacctgtaatcccagcactttgacaggatgaggcagctggatcacttgagcccaggtgtttaagacaatgctgggcaatatgacaaaaccctgtctataaaaaaaaaaa

SEQ ID NO: 217949 - DNA, 204 bp, Homo sapiens
ggtctaataggacaagcagtcgcaaaagatttcaaccatacacagggtggacaatcggaactcaaatgattgagaggtgatggagttgcaaagtactgcataatgtcttgtaaattatgcctgtcaacaattctgaatagtcttacattattattgtcttcttaccataacaattaaattttttctataaacagtaaatgatgt

SEQ ID NO: 217950 - DNA, 389 bp, Homo sapiens
taagcttcttttccaggcacgtctgcagagcatgacaggtgccagcgagaagccatctgcaggtgccacatgacactggtggagacatgcacaccttctacccggaggcctcgaggcaaactctagacgctggaggagaaggtggctggccctgaggccaagctagggctggagggtgagcggcctcaggcctgggctcactgactcactgtccagcagtcagaggcaaaacctcacaccaagccacggggccacatgaacccacagcagactagcttcttttttttttttttttttttttttttttgtttggcccccccccggaccggggggggcccctctaaggtgccgcctcgtggcgtttccactttttggccctgggcgcggcg

SEQ ID NO: 217951 - DNA, 295 bp, Homo sapiens
gcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctc

SEQ ID NO: 217952 - DNA, 480 bp, Homo sapiens
gagagaaagaaaaaaggcacatgctgtttgaaaaatgtgtttgaaaaaaattacttgtgtgtggaagggggatgatgattgtttgaatattaagctgttgaattctaattcgatataagagagagccactacaggattgtaagctgctgtcagatcctgtgtgccacatattgtagttatttgtgcccatttccaatgtccttattaaattgtaagctctttaaggtcaggggctgggttttgtagattgcactgaaaaaaatacaggaagtagaaggactggcaaaggaccagtctcattaattctggtggtgatgaaagggcacttttctacaacactttaactgatgagctacgctgttgctgagaataaagactgttataagtgttacttaaagtagctacttaacatttacaaactttcggttttgaaaataaattagactttgggagtcatgtttccctggcaaaactcgagtt

SEQ ID NO: 217953 - DNA, 512 bp, Homo sapiens
agcacagctgagaccaggctgtgattatttcaaaacagactttattaaaaacttagtataatagggaattgcagaacaaatatgtatgtatttatatatgtattatgtgtggctgatctaggagaaataggcagcatctacttgctgagctttcagttgtctcatggtgagcagagggcatcttttctttgaaactcagaagcaggttgaaatctgggggaattaacttatttttttcctttcttccaaagaccttatttcatgacctataatttgtgtcctggctgactaacattgggaatatcagttcactttaggagattcagtctccttcctgctcagatttattgttactctgtctccagtagaacaaatagaccattagtacagaagagattcattcattgaacaaatatttaggacatgtgtcagatgtggttccaagtgctggacaaagaataataaggaagttaagctttgtgctagtggtgggggtaagatagaaaaaaaaa

SEQ ID NO: 217954 - DNA, 635 bp, Homo sapiens
cctttcattttggccaaacttggtttccaatttctaaagcaggcttctgctcatatttataatgtgaaaattttcttaaatgttaacacttatgaaatcgttatgctacataaaaattcccctgagtgtgagatacacgaagaaatgcaagagatgaaaaataatttgctctatcacacattttcatatttaccattaggcattaaaagcttcaaatcaaaattaaatttcctatgtaaaattaaaaagacaaatagcatcagttccttaaattagcagaagcaggcatctgctaaagttctgaggtagacattcagtgcattttacaagaaatcaacaatatgtccatttcttccagtccttggatcgaaataagtccattcgttctcttcatctataacccaataaataagttttgatggccatctaatgcaaagataatgccctcttaaccataagctaaaaaaaaaaaaaaaaaaagaaaagcttaaaaaaaagaaagaaaaaaaaacacacaaagaatgcaatggctttgaagcaacagccaaatttgtttttgtccaattcatttgtgtcttccagcccaccaagagcttacagccactgaaaaaggaagatggaagaaaggagaggtg

SEQ ID NO: 217955 - DNA, 491 bp, Homo sapiens
ttttgtatcgtgaatgtgtgatatagtgtgttcttacaatacagtaagccagagaaaagaaaatgccattcggaaaatcctaaggaagagaggatgcatttcctcgtctccacgtggaagcggatcaccctaaaggtcttcatcctggtctttttcatgctgaggaggctggggaggagaaggaagaggaggggctggtcttgctgacccaggagcagcagagaaaggagaaaatccacgtgcaggggctggccagcgctgggcttctcgggaatggaatcacacacggactgtggcgtacacatcacaactttaaaccccgtccgtactgaagcctgcgtccgaatttcttctgtttttgtggcggaaggataaatattccattgtacagacggtctacccggttcatccgtcacccacccatgggcacccgggccgtttccacccttagtgaaggaagccgcacgggtgtttgtgcggacaggagcttc

SEQ ID NO: 217956 - DNA, 376 bp, Homo sapiens
aaagtgctgggatcacagttgtgagccaccacaaagcctggcccagaacattttcatcaaaaataaacgtcatcagcccagccccagccccccagccataaagacccactcagccaccttctgttcccaggggctggccagcgctgggcttctcgggaatggaatcacacacggactgtggcgtacacatcacaactttaaaccccgtccgtactgaagcctgcgtccgaatttcttctgtttttgtggcggaaggataaatattccattgtacagacggtctacccggttcatccgtcacccacccatgggcacccgggccgtttccacccttagtgaaggaagccgcacgggtgtttgtgcggacaggagcttc

SEQ ID NO: 217957 - DNA, 538 bp, Homo sapiens
tcaaaaaaaaaaaaaaaattgttctatgccttctggcctccatggttttttctcagaaatccagaggcattctaactattgtttcccaacaggtaatgctttatttttccccagctgctttttaagattttctccttgtctttggttctcatcagtttaattatgatgtatatggacatggatttctttcggttatccttatcagagttcacagagccacttgattgtgtttcagatatctgggaagttctcagctatgatttcttcaagtattgttttctgtaccatactgtcctgtacttctgtgtcattgataacatgaatgttagagcttttgacattgtccgtgaattcctgagactattcattttttaaaaaattttctctaggtgggtgtggtggcatgcacctgtagtcccagctatttgttggggctgaagtgagagatcacttgagcccaggagggaggtcaaggctgcagtgagccaagatcgtgcctctgctctccagcctgagtgacaaagtgagactgtgtttc

SEQ ID NO: 217958 - DNA, 411 bp, Homo sapiens
taatactggtcttactctgttgcccaggcttgaggacaatggtgtgatcatagctcactgcagccttgatctcttgggctcaattgatcctcctcccacctcagcctcttgggtaactgggactataggcacatgctaccaagaccaagcccagctaatttttgtattttttgtagagacagggtttcaccatgtttcccaggctggtcttgaactcctgggctcaagcgatctgcccacttttgcctcgcaaagtgctggaattacagacatgagccatgtacatgtggctatgtaccagtaaaacttttatttacaaaaatagacatgtttgctgatccctattttagagaatttgccctgtttcctattttcatgtcagctcagggtttattggtatattaaccttat

SEQ ID NO: 217959 - DNA, 572 bp, Homo sapiens
tagttttctgaaattgaaggcactggtatagctcattaaggtggattgcataatactgtcttttatttggatttcctttaaacatggagggttcttacctgtctagaacaagtttgttcaagccgcagcctgtgggccacaagtggcccaggacggttttgaatgcggcccaacacaaatttgttaactttcttaaaacattatgtgatttttgttgccattttatttttttggctcatcagcaattgttggtgttagctagtgtattttatatgtggaccaagacaattcttgttccagtgttgctcagggaagccaaaagattggcccctggcctagattgaatgaaaatcaatcagttgaaggcttatgatatgcgaggcattgttctaggagctggggatatggcatgaacaagacaaaattcctgctgcataaaacttacactccagtgggggtcatagtgaggagaatggcgtgaacccaggaggcggagcctgcagtgagccgagattgctgcactgcactccagcctgggcgacagaggaagactccgtactcaaaaaaaaaaa

SEQ ID NO: 217960 - DNA, 226 bp, Homo sapiens
gatgggcaagtgggagtaggctggttgcagcaggaaaagacctctgctctctgcctgcagtcatcctgaatgagatttggacgctgataaagaggccttgtgctgttcactgtggccacgggtggggtctacttcatgctcacatattagcatgtatatctctgatgtaagcctactccacctccacccttttgtttaggtgttgattactagcacctacttctag

SEQ ID NO: 217961 - DNA, 542 bp, Homo sapiens
aaataggcaggaagtaccacaacagctaatattagagattatttcactgtttggagagtgttgtgaaggttataaatcctactgttgctatgtgagttctctttattccgttacatctgcattttaatcttcctaaaacctttcagttaacatgccttgataacacatagatgtgcagaaagttttaacattgatcttttaacttacgtttctcaatgactgccttgatcaagatacttgatgagagtttcatgacttaaatagctttagttcaggagtcaattttagcaccaaggctgaaatatcccaaaggtatccgaaaggcaagtaatgttctaagatgaataatttagaaaatatgccttaatatttcaagagagatcattcatcttatatttttgactttcattttattatgagccatcgtagatgttttaacttctttagcccacaaagaaatttctccaaagagagccagccaaccggagacagacagagacaaagaaggtataatgagtagagagtgcctcagtgtctcttaa

SEQ ID NO: 217962 - DNA, 459 bp, Homo sapiens
cgtagagagaaagtggccagtttttataaaaacgtaaaaaaatgagacagtgcatatactaatatggatgctttgtaaagaccgtagatagctctgatttcttaacctaaatcaatttgtttccttaaatcctctgagcagtttgtaacacaagtatattatccatgtagttgtgcttcacagcagtagaagtatgtgtgtatcattttctatactcaaccaagcagcttctggatgcagctctccacaggggacaataacagctgacatacagcacacacttagtgccaggcactcctagcgcttatacatgttgactcatttaagcccacgataagcctatgaggcaggcactattatcccatgtacacatttgaagttctcagtggttaagtgactcgccgaaagcctaaattgtaagtggcagagctgggacatgaacccaggccgtcagttatg

SEQ ID NO: 217963 - DNA, 683 bp, Homo sapiens
cgggggggcacatagtagttttccctcttaaaatattaaatttaaaataacctcgactgagtctctccttctcagtactgctttggaagagtcaccatgtaattcgggttgaaaatctgtttcaccagtgatgctagatacatgtgtgagaagagtttgtgtttataaaacattttttatagggcatcctgtgtaatgttaatgtatgcaattggatctctccagaggaataaagtaacacatttagaaataaactgctggaattggagcatttcaaggttttgagtactggttctgatgactcttgggtttaagtgataaagtgccccaagttttagtgttagcctagtttatgttgttagtaagcagtcttttctggcttcataacccagctacatctacagtgacagtccgtatagagaaagttatgtacacctggcactcgcactcattttcccaataaagtgtgcactgcgtgatgctcattccgaacataactcaagggtggtatttgcagtggatgtgctggagcttcccccgtgtctgccactgggatgggactttaaagtggcttcactcacagggtctccatttcttctgtctgtccctacccttctccaaagaactgtatcagaaacccattcattttaaagataaccacacacttcaccgtctgtcactgt

SEQ ID NO: 217964 - DNA, 282 bp, Homo sapiens
ggcatagtggttacacacctgtagtcccagctactcgggaggctgaggcaggagaattgcttgaacctgggagatggaggttacagtgagccaggagattgcgccactgcactccagcctgggtgacagagcgagactccatctccaaaaaaaacaaaaaaaaaaaaacaaaaaaagaagtacagtccacaacacacacaagaaatgaagttttctgtgttttaagaaagaggagttttaaaaaacaataaacaacaatgacaactgcgcatgttaaaatca

SEQ ID NO: 217965 - DNA, 1015 bp, Homo sapiens
ctacactcagttttcatcagtgaacagattttccttttacatcagcatcagaagcattatggctggctgaactgatagagaactagcaagtatggactcaaaagtggcatggggaccccttagtaattaattactgagggtaactaaactccaggtaaccttttgccccttcctttcttccagccattggaagaacgtcctcatgtggtacagtgtcaggcaggagacccatgtttctttctctgaatcaatagtgggtggcacagaacaacaaaaggacgtctagcttttagatcctgggctaccaaatcttctggcgccatcagctccccttccctcttggcacctctcctgtcctcaccctggtatgtagtaaacccaagaagtactattctctgggtccacctgcccataggatcctgaatcttcacacaaacaatattagtcacaattctaacaaccagttctgaaacatttactatatactgaatgatttgcaaacatagaaaagttaattttcacggcaaccgaatgaaatagattttcggcctggcatggtggctcacacctgtaatcctagccctttggaagcctgaggtggatggatcacttgagtgcaagagtttgagaccagcctggacaacatggaaaaaccacgtctctaccaaaaaattaaaaaattagctgggactacaggtcctggtatattgtaaacccaagaagtgctgttctctggggccaccagcctttgtattatgttggtgtggaggagggaggttattggtaggtaccgagataaatttgcccataggctcctaaatcctcacacaaacagtagcaatcacaattttaacaacacaactttaacaggtgctacaggtgctacctgtagtcccagctatttgagaagctgaggtgggaggattgcatgagcccaggagattgagactgcagtgagccaagatcacaccacagcactctatcctaggcgataagagtgagaccctgtctccaa

SEQ ID NO: 217966 - DNA, 546 bp, Homo sapiens
ttgagagctgtaatttaaggaagaaggtatcataggttacctctgtggaaattctagaatttgaatattatgcccctgctcacttgtagactgggctgtcactataaagttaggctgacttgactgtatctgataattaggggctgggagagcatggaaaattgaagccatagataatcccagtgtcttgttttagccaataataattcttctcccaccaagtctttatcagaactgctaacaaggagaaaagtcgactggtttgagtttcctcaccttttattctcccctgggtatcttcagtagaggtgctaatgaacagtgaaatggccaaaaggtgagcagctccagggaggagaagaaggaggctcagataatccacaaactgtaatcgctttgaataattgagttaactccagtaaaatgtagagatacattcacctgctaggcattgttggaagctaaattaacacactggaagcaaagctttcttttaagtttcatttttaatctaatggtggacattttggggcactgcagcctatt

SEQ ID NO: 217967 - DNA, 437 bp, Homo sapiens
tgagatggtgcccgagtgtgctatggggaggtgttcaggctgtttgctcctgtagtaattagccagatttaaatttcaaaaatcaagaattttaaatttttacttttattttatagaaaagaaaataaccaaagtctttctagggaaccgcaagactacaaaagtcatcccacctctgctcaaacaccttcagggaaagtgacttctttactaaataagacagtgccatctgtccccttgcctccaaatggaaacattacttcaaacattctgtaactttttgttcaaatgcttaatggagctggcaggacaaagatcttccatgtggatgcctgtgaaagtatgtctttaccagaagataacattttacccagaaaggcagtacagcataatggctcagatagagggtgctagacccaacttggtgagctattgta

SEQ ID NO: 217968 - DNA, 664 bp, Homo sapiens
ctcacacctgtaatcccagcactctgggaggccaaggtgggtggatcacttgagatcaggagttcaagacctgcctagccaatatggtgaaaccccatctctaaaaattaaccaggtgtggtggcatgagcctgtagtcccagggcagggctagggcaggcacatggacggggtgctcggcggccacacctactgcacactgctgcagctcaccaggatgtaccccggcctgcaggtgtacaccttcaccgagcgcatgatggcctactgtgaccagatcttccaggacgagacaggcaagaaccggtggcgggaggctgaagcatgagaatcacttgaatccggcaggtggaggttgcagtgagctgagatcgcactactgcactccagcctgggtgacaaagctagactctctctctctcaaacaaacaaacaaaaaaaaacatttcttgggcgggcgtggtggctcatgcctgtaatcccagcactttgaaaggccaaggcaggcagatcacctgaggttgggagttcgagaccagcctgaccaacatggagaaaccccatccctactaaaaatacaaaattagccaggtgtggtggtacatgcctataatcccagctactcgggagggtgaggcaggagaatcgcttgaacctgggaggc

SEQ ID NO: 217969 - DNA, 402 bp, Homo sapiens
gaaacttctttatccacgtcctcactctctttacaccatgcccaagttcacccagcttctccttgagcacttcaatatcacatggatcgacaccccccaaaaaacccttttccatttgagaacagctctctgtgttaagagttctgacataatgtaccagaatctggttgcctttaacttccacccaatcttcatgactcctgccactgaagctatacagttttgttttctggatttcagtcattcttcacagactcattccagacaatctccaaaatgtcagtgtaactgttagaagttggtgctaagggttgatcagaactctgatgagtatagagacctttggtgctataatgtcccttatttgaggaattgtatttctactgatatatttggaaagca

SEQ ID NO: 217970 - DNA, 410 bp, Homo sapiens
tgctgggcccgcacttggtgtagaggctggagagaagatcgtgtgtgctttgtgggccacatgcaggtcctgtcggtctttctgttttgttgataaccctttagaagtgtagaagcctggccaggcgcggtggctcaggcctgtcatcccagcactgtgggaggccgaggcgggtggatcacctgaggtcaggagttcgagaccagcctggccaacctggcgaaaccctgtctctactaagaatacaaaaattagccgggtgtggtggcgggtgcctgtagtcccagctactcaggaggctaaggcaggaggcaggagaatctcatgaacccaggaggtggagcttctagtgagctgagatcacgccaccgcactccagcctgggcaacagagcgagacaccgtctcaaa

SEQ ID NO: 217971 - DNA, 640 bp, Homo sapiens
attttttttaagtttctgaagccattttcatggaaagcaaatttgcctgaaatagaaaataggttaataggtgggtaccagctaggcttaaaactaacagagcaggagggaaagtaggtcagattttcctatcacatctttttacttttaaagtaaaaatggatacacatgaaatccgactcttcttaaattcctcaaaggcttggccttgtattaatggttgcttcaaaaaagagtgaatggcattttctgcttattatgtcaaaagctgaagctcttaccaataggatggagatgtatataaaacatacccacatgagattcttactttaaaatgcagattttaaggggtatgatgttgaataccatgtataaatgtaaggagtatatattttgaatactatgatcaccccagaatgatcattcaataagaatgtatctaatatcatttgtacattactctgcattataattgatcatacggccaactttaaatccacttagttttccctgttcagagatttctttcccagatatacttaagcatatacatgtgcatgcatttaatttcctagactatggagactaaaaatatggctgaaatttttaatatgattactttttgttgatatttaggttt

SEQ ID NO: 217972 - DNA, 343 bp, Homo sapiens
tcaggaagatagaaattttaataaattttagatcttaagtcacataagcatgttaaaattttgagcataaccacataacattaggcacttagcttctaaaccagtttggggagttgggggcagtaggaatcaagaaaacttggtcagtccagtacaaggcaaaaatacaggggaatgaaaagcagaattggaggaggtagaaagaaaaagccttaatatcagtgaacaatgaattgattaagcttttttgttaaaagatattttctgtttgattttttttccattaaaagagacactccctaacataattacacagaaatattaaaaatatcagggaaataac

SEQ ID NO: 217973 - DNA, 401 bp, Homo sapiens
ataaccaatttggaaaaatagttgttcttacaaagttaaacataaacctccatatgataccaccatttcactccttagacaagtgaaatcgtacgttcacacaaaaacctgaataagaatgtttacaacaacattattaatagtttacaaaaacaagtcgggcacagtggctcagtcatgtaatcccagtacttaggaaggctgaggcaggtggatcacttgaggtcaggagtttgagaccagcctggccaacatggtgaaacctcctgtctactaaagatacaaaaattagcagggcgtggtggcacatgccagtaatcccagctactcaggaggctgacgcagaagaatgacttgattgatccccggaggcagaggctgcagtgagtcaagatggcgcc

SEQ ID NO: 217974 - DNA, 386 bp, Homo sapiens
gcaacctgtagcaatggacccctctatggcctccctgagccaaaccctacctggctaagcacctgcgcctgtaagattgtcctcccagtggtgggagtgcgagagaggccatcttcacttccccttccttggagggcctgactttgttgccctaggcaggccaggaaacttattctaatgccaacgaaggaggcaacttttctagctagaaaagcacacgctacagctctctctcttgccctgaacaagcagaagagcacagcttatccccaaaagctcctggacaaatgtaggctctctgggggagctggtaagggaatactgcctcccttaacaaaacaaacctgagaatctccaaggtttagcactgcacacggagtctccca

SEQ ID NO: 217975 - DNA, 780 bp, Homo sapiens
  misc_feature (713)..(713): n is a, c, g, or t
  misc_feature (720)..(720): n is a, c, g, or t
  misc_feature (760)..(760): n is a, c, g, or t
actctgtgagtccctttatagagagatcttatttgtacattcaacctttggtctcatatataactctgaccactggaaaactcaaggacaaagtgaaccaaaaattaagctggacttgctaaaacaccatactattttccctgatttatatgtaaccaactctctaaaaatgaaaaggagttctacattcaattttccttcccaaaatttaacatttttcctcactaataaacactcctgaggagaactatttatgacacaatcctcttgtgtcctctttaagacaatgtgaaatataaataagtaattttaaactagatggtgataatcttttataaaaagtcctatctcatttttaaaaagtaaattttagggcattcaaatttgtatcacacaacttttcagaaatatacctgttatgtaatactaggtacaaatgtactgatttttctccaaggtataaaaatagctttggcgaaagtagctactactagttaacacaaaactcaagaagttaaatcagtcaagcagttaaatatgaaaggcaaagcaatgaaaatttttgtttggttgaagggcataaggggagaacacctagtcttcgttgtaatcagctatatcctttatggaaagaaaagcttataagagatgcgaaaacccacataatgaatcagagtttgttttctttttcaaaacaacctaaaaagctaggngtttggngtattctgtagcactagaatgaaaatttgcttttggtgtnttttttttttttttttcaaa

SEQ ID NO: 217976 - DNA, 465 bp, Homo sapiens
ctgcatagcagttgagtgatgctggttagctgttaaggtggcctgttgcagtgcagagtgctgagctgtttcctgttttcttctgattgctcctgaaaaaagaagccctgtcctgaagaacaaatggcttttcagtttattaaaatgcctgtcaactgcccttccagtcacccaggcctggaagagaaataatagagcatgcagtgagcacatctagctgatatgataatcacacctcttccccctccctattctgttaaatggcaaatctgatcatgtcaacatacatgaacttaaaatatggggaatgttattgaagaaatggtttgtaagtgtaggtacttataacatggtgtatgtttttgattatgaatatttcttactataaccatgtttctatcattgaattaaaatgttttcttggtgttaccttttctcaaaataaaactagaaatattttgtaga

SEQ ID NO: 217977 - DNA, 395 bp, Homo sapiens
ctatacccagaaaaccctaaaaactctgccaaaaggctcctcaaacagataattgacttcagtaaagtttcaggatgcaaaatcaatacaaaaatcagtaggatttctatgcaccaacaatgtccaagctgagagccaaatcaaaaggtaatttcatttacaattgccacaaaaataataaaatacctaaaaaatagctacccaaggaggtgaaggatctctacaacaagaattacaaaacactgctgaaagaaattagaaatgtcacaaacaaatagaaaaatactccatgctcatggattggaagaatcaacattgttaaaatggccatactgcccaaagcaatttacagattcaatgctattcctatcaaagtaccaacatcatttttcaca

SEQ ID NO: 217978 - DNA, 285 bp, Homo sapiens
ccttcatcttgctgcaaggccttgagccactggcccaagatagtcatcagctcaagtgagttgctgaagcctaatgtcatgtgacttggagtaatttactacttctctgagcctcaattagcttgactgtaaaatgggggtgaatgcctactttgtagcatggtggtgagaattaaatgacgaaacgaatatgaatgctctagatctgcattggccaataggaatataaggtggaccataaatgtgaatcacatttggggttttaaattttccagtagctacaat

SEQ ID NO: 217979 - DNA, 416 bp, Homo sapiens
gttctgggaaaaacgcaatgagctccaggacatagacaagattatggctcagagtgaaagggagagataagaattcagagaataatttgcatcagaaaagcacctgacaaaaagatcagatggtacaaagcatctagcaccttttcttcagctgaggatatcatggtactattataacagagggaaaaactgtactgaggaagaggatcattctgtattttgtgtgcttggattcaacaaggaaaatatttgtgatgaaatgcaatagtgtaatcacaactctcctcagttcagattttgttattgaaccaaacggaggtccactcgcccagcgtaataagactacgtatctataccatatctaaacgaaggcttgtagcaagagaagggaaagtgtttgtttgtagggaccaagc

SEQ ID NO: 217980 - DNA, 535 bp, Homo sapiens
tgttccattactgtgatcatgctttattgtatacctggcacctggcactagggtgaccaaccttcccagtttgcccagtactgagagattttctgggacactggactttcagtgctaaaacctggacagtcccagtcaaatcaggatgatttggtttgaccctacctggcatgtagcaggcacttggtactttgtactttttaaaactctttgatacttgttacctcttttgattattaaacccacgtggaaggtagggcacgtgatagagcctgatggcactggatacatgaagcatccgaagctcacagaggctaagttacacgcttaggtgttcttattcctactctaagattttaatgccagtcaagaaaattgtagcactttgggaggctgaggtgggtggatcacttgaggccaggagttcgagacctgcctggccaacatggcaaaaccccatctctactaaaaatacaaaaattagtcgggcatggtggcgcacacctgcacaagaattggttgactctgtctcaaa

SEQ ID NO: 217981 - DNA, 825 bp, Homo sapiens
gctgctttactgtcacaggaaaggcattcaataaacgcttgttgaatgatttaataaatagagctgtggatgaatggctagatggatgcgcctgagcgaaaccaaactggaaaggaaaacctgttgcaacataaccgcaccatgctcccagcaccacactgaggtcacgtgggggctctatgctgtttggggtcacctgaggcatattatgtctctttggagtgagtgatatacttttgattatcatctcaatggtttagtgtctgggtccttatgggtttgggtttggtggtgaggccaaagctgggggttaaattaaggtaacgctaaggcataggattgggggtgaacatagagctggcctgaggttgtgaatagggttggggatgggatgaggctgaagttgagactaagggtagaaatgagaataagggttgggcgtggtggctcaatcccagcactttgggaggccgaggcaggcagatcacttgaggccatgagttcgagaacagcgtgggcaacataatgaaaaccccatctctacaaaaaagacaaaaattagccaggcatggcagcatgcacctgtagtccctggtacttgggaggctgagctgggaggattgcttgagcccaggaggttgaggctgtagtgagtcatgatcataccactgctctccagcctgcgtaacagagtgagatcctattaaaaaaaaaaaaaagaaaagaaaggaaggaaggaaggaaggaaagaaagaaagagaaaagagagaggaaggaaggaagggaaagaaaaagaaagaaaggaaggaaggaaggaaggaagga

SEQ ID NO: 217982 - DNA, 335 bp, Homo sapiens
agtagaataattgcctggtagctctagctctgatgtttctggatggattcagttgtgaaccaacacctagggcaggacaagaatggaggccatgtgaggtgttggatgccttcctcactccatggtaatgctcctttctccactccagacactctcctgtttcatcatgatcataccactgctctccagcctgcgtaacagagtgagatcctattaaaaaaaaaaaaaagaaaagaaaggaaggaaggaaggaaggaaagaaagaaagagaaaagagagaggaaggaaggaagggaaagaaaaagaaagaaaggaaggaaggaaggaaggaagga

SEQ ID NO: 217983 - DNA, 387 bp, Homo sapiens
gagattggtcaaagttggcaccttagaataggtgaagtttccttggtaacttcccttgatctttcttgcacctattcttctgccataatacagccatgtactccattttcatcccctcacgctcccctactcatgctgtagtacatttggtcaaacaagagatcccctgctccccaaggactccaccttccaaaacagtcatattctctatgcccacctctcgatagaaatttccatttcctcactgcagtttggctgtgaatgattagtagtcatgcctctgcctctttcaccttttaacccagaaaccttttcttaaatctgctggatttaccgtaagaacaggaaaaaaggaagtaatgtttattgctttcaccccttttctct

SEQ ID NO: 217984 - DNA, 574 bp, Homo sapiens
gagaattaagttctaacagctgttccttgtgcttgaccaccccctcccaatgccatctttgatggtggtggtagctgttaaaaggttttgtgccctccacacacctccttaatggtcagactatttggaacctgaacaaacccatctctgaaaactgttttgcttttttttctccttcattatgaggtttatttacattcaaaattatagagagacactggagaaataggatgcctattgatttatttccaaacttagcacaggatcggttaatgcatagttgacattcatttatgattaagtttgctacagcattttaagaccaagacaataaatctgccttagaatagtcaagaatactgatgttttgagctgtggttaggtaaaagaatgtaaaaaaatacactctcaaatggatcccacagaagtgtgtatacatatgagagagaaagagggagagggagggaggatgatgatgcaaaagcaaatggagcaaaatgtaaaccattgatgagtctgggtaagggatgcatcagagttcttttactattgcaactttttggaagtttaaagt

SEQ ID NO: 217985 - DNA, 623 bp, Homo sapiens
gcagtagctcacgcctgtaatcgcagaactttgggaggccgaggtggaaggatttcttgaagccaggagtttgagaccagccttggcaacagagtgagaccccatctccataaaaaataaaataaatgtagtcaagcttggtgatgcatgtctgtagttgtagctagttgggaggctgagacaggaggatcactcgagccagggaggttgaggccttagtgagctgtgatcgcaccactgcactgaggtgtggacagcagagcaagaccctgtctctgtctctgtctctctctctttatatatatatacacacacacacacacacacacacatatatatatactatttacatatatacactagttttatagatatatatctataaatatataaatagaacttatcaaagttctattgtctataaatatgcaaagaaaatagaacttatcaaaatttgtcaatgcagagaaagcagtacttaaagcaaaacttatagtattgagagtatatattagagaagatctaaaatcaatactaagctttcaccttaagcaactagaagagcaagctaaagtaagcagaacgaaagaaataataaaaattagagcagaaatcaatgaaat

SEQ ID NO: 217986 - DNA, 564 bp, Homo sapiens
ttctctatctcagctgcaatagtgttccatcttaccacagagtgttttataattaatgctgttgactttataccccaaaatgggtcaagaagtggctacatgattaggggatgtttaaatttgtatgacgacaaagttaattgcaacaagtagaaaacttgggtgctaacacaggataacttctgctctttttctttcctggatatagttctgttggggtataaagtattaggtatttgtattttttgctgtcaaaataatggacttaacttttagagtgttcacagctaggatctctgtatttgtttttcaactaacaactaattttaaatgtattgtatcttttattacctgttctcttagattgttttttgctagtaacccttactcagcttctgcctttggggcttggactaatattgcttgtatggaactacagtactgtgactaaacatggagctcaatgcagctactgcttacaactgcttaaactttgtagtttggacttcatttttttctgtaataacaacttattaaatctagttgtatgaagtaaaaaaaaaa

SEQ ID NO: 217987 - DNA, 377 bp, Homo sapiens
agttcaaggcagtgagccatgattgtgccacggaggttggtgttttcaccgttagctgtgagagtgcaaaggcataagatgttagcagtggaagaccaaggtgtcactgatcgtttcgaggttaccctacccctccagctggctgtcttcagcagttgaggagacgcaaactgcacagaggacaatgaaatggaaaaatgtgtggttttcaatgagcaaatatcatggagggcagtacctagagccgggcatagtgactggcacctacagtctcagctactcaagaggattgctggagcccagacgttcgaggctgcagtgagctatgatcgcatcactgcactccggcctgggcaacaggccaagatcctgtatct

SEQ ID NO: 217988 - DNA, 390 bp, Homo sapiens
aaatatggtggtatcatggaagccaaaaggtgagaacagaccaaggagagtctgaggagagaaaaactcagatcgaacgaacgcctggctaccaggggcacctggcatggagggtccagcaggtggtgtcacggcaagcaagagaagaggtagataactgaaagtgaagggagggagtgctggatttggagcagaatggccacttcaggagcaggggctgagcctccgagactctgccacctcagttcctaacacacagcagccgtctagtgaaagtgccggcaggactcaagcctgaaacactaagaatcaaaggggcagtgcaggcctcgccttcaaagagaggcacgatgggtaacgtgtggggcatgaatgtccccagtatgacgg

SEQ ID NO: 217989 - DNA, 756 bp, Homo sapiens
agctgagatcctcacacccaagtgtctgggttgcacaagcaaatggcagaagcaagcgggaaaagacgagaaggtaaatgtgggtgctcctggggaatccgtcctgctccccactgaggtcacagactaggcataagccccaccctggatgaaacagacaactttaaagtccccgccatgtggtatccaacctcactgtagtgagctaacctcgtctgcgggacacatcagaagccaggaactttcagagaacatcaagacttccagtttgcattggtccacaggaacatctcaagctccacctacagagctcagaaagattcaggagcgggtttaacggccaatgatgcttccccaaatctttctgtcctcctaattcattctgcatcagggccgtgtgctgtggatgcttaagtacgcaggtgttttcaagactaagaaggtcttctgaaagttcttccccatgaacaggcaaaaatcaccactcattgcagggggaccttatgcttgaggatatcatgggcaagaagctccagccaaactagtaagaaccggccggccaggcgcggtggctcacgccgtaatctcagcactttgggaggaggaagtgggcagatcacttgaggtcaggagtttgagaccagcctggccaacatggtgaaaccctatctctactaaaaatataaaaaaatgagtcggttgtggtggtaggcgcctgtaatcccagctccttgggaggctgaggcaggagaatcg

SEQ ID NO: 217990 - DNA, 682 bp, Homo sapiens
agctgagatcctcacacccaagtgtctgggttgcacaagcaaatggcagaagcaagcgggaaaagacgagaaggtaaatgtgggtgctcctggggaatccgtcctgctccccactgaggtcacagactaggcataagccccaccctggatgaaacagacaactttaaagtccccgccatgtggtatccaacctcactgtagtgagctaacctcgtctgcgggacacatcagaagccaggaactttcagagaacatcaagacttccagtttgcattggtccacaggaacatctcaagctccacctacagagctcagaaagattcaggagcgggtttaacggccaatgatgcttccccaaatctttctgtcctcctaattcattctgcatcagggccgtgtgctgtggatgcttaagtacgcaggtgttttcaagactaagaaggtcttctgaaagttcttccccatgaacaggcaaaaatcaccactcattgcagggggaccttatgcttgaggatatcatgggcaagaagctccagccaaactagtaagaaccggccggccaggcgcggtggctcacgccgtaatctcagcactttgggaggaggaagtgggcagatcacttgaggtcaggagtttgagaccagcctacctatatcagcagctgagaaggtgaaactaaagt

SEQ ID NO: 217991 - DNA, 755 bp, Homo sapiens
agctgagatcctcacacccaagtgtctgggttgcacaagcaaatggcagaagcaagcgggaaaagacgagaaggtaaatgtgggtgctcctggggaatccgtcctgctccccactgaggtcacagactaggcataagccccaccctggatgaaacagacaactttaaagtccccgccatgtggtatccaacctcactgtagtgagctaacctcgtctgcgggacacatcagaagccaggaactttcagagaacatcaagacttccagtttgcattggtccacaggaacatctcaagctccacctacagagctcagaaagattcaggagcgggtttaacggccaatgatgcttccccaaatctttctgtcctcctaattcattctgcatcagggccgtgtgctgtggatgcttaagtacgcaggtgttttcaagactaagaaggtcttctgaaagttcttccccatgaacaggcaaaaatcaccactcattgcagggggaccttatgcttgaggatatcatgggcaagaagctccagccaaactagtaagaaccggccggccaggcgcggtggctcacgccgtaatctcagcactttgggaggaggaagtgggcagatcacttgaggtcaggagtttgagaccagcctggccaacatggtgaaaccctatctctactaaaaatataaaaaaatgagtcgcaggtgtaccgcgccagaaagtctaagctcgttgcgctgtgaaaaggcgccaggtcc

SEQ ID NO: 217992 - DNA, 777 bp, Homo sapiens
agctgagatcctcacacccaagtgtctgggttgcacaagcaaatggcagaagcaagcgggaaaagacgagaaggtaaatgtgggtgctcctggggaatccgtcctgctccccactgaggtcacagactaggcataagccccaccctggatgaaacagacaactttaaagtccccgccatgtggtatccaacctcactgtagtgagctaacctcgtctgcgggacacatcagaagccaggaactttcagagaacatcaagacttccagtttgcattggtccacaggaacatctcaagctccacctacagagctcagaaagattcaggagcgggtttaacggccaatgatgcttccccaaatctttctgtcctcctaattcattctgcatcagggccgtgtgctgtggatgcttaagtacgcaggtgttttcaagactaagaaggtcttctgaaagttcttccccatgaacaggcaaaaatcaccactcattgcagggggaccttatgcttgaggatatcatgggcaagaagctccagccaaactagtaagaaccggccggccaggcgcggtggctcacgccgtaatctcagcactttgggaggaggaagtgggcagatcacttgaggtcaggagtttgagaccagcctggccaacatggtgaaaccctatctctacataatttatatttggagaatgaagtcggcttagtggtggtacggcgccatgaaagtgctacaaagcttagtttgcgcttgtgaaaagggtcgcacggtttcc

SEQ ID NO: 217993 - DNA, 542 bp, Homo sapiens
aagaaaacagaaataatcctatgtccctctcttctgaatacagggcatgattttttagaaggaattagtcccaaaagtttttgagtctaacagaaaagaagaagatacttttacctacagaaattgtgtgggcctttgaggttctatgctccttttaggcataacatggtgttgaagccatttgcagttagcagtgacctgatagtatcttatggcaactttgtatttcaacttctcagcttgtgtgatccttctattgctgactatagacccaggaaacctaaaagctacatcttacctttctaattctttactccttggccatgttctgtttctagcacagtagatattcacacgtggcaccttatgcttacctaggccctcataaagcaaaatgctctttgtttgggcaccaatgatgtcagtatagaccagcaaactagagggcagcaatctaggtccttaaccttttaaaatagactgatgtactagctgcctttggattttggtatctcaataaagagattagtatgttggccttt

SEQ ID NO: 217994 - DNA, 523 bp, Homo sapiens
aagaaaacagaaataatcctatgtccctctcttctgaatacagggcatgattttttagaaggaattagtcccaaaagtttttgagtctaacagaaaagaagaagatacttttacctacagaaattgtgtgggcctttgaggttctatgctccttttaggcataacatggtgttgaagccatttgcagttagcagtgacctgatagtatcttatggcaactttgtatttcaacttctcagcttgtgtgatccttctattgctgactatagacccaggaaacctaaaagctacatactccttggccatgttctgtttctagcacagtagatattcacacgtggcaccttatgcttacctaggccctcataaagcaaaatgctctttgtttgggcaccaatgatgtcagtatagaccagcaaactagagggcagcaatctaggtccttaaccttttaaaatagactgatgtactagctgcctttggattttggtatctcaataaagagattagtatgttggccttt

SEQ ID NO: 217995 - DNA, 708 bp, Homo sapiens
agttgcatgttgtgccctttgtaaaaagtggtctgttgtagcgcatttagttttttcaattcagttcaacagaatttttttgagtacctacgtgtagtctaggtactctaaaggtttgttctatcctttcttgaatcttgcttatgtttatagagtattcataatgtgtgaagcagagtcattgcctgttgtctgaagccagcataggaattgtcgttttggaactcagcttcttagctaattgtctgtatctcatttgaaggattattaaaattatagtctcttcagtttattctgctttcatttatactgtttcatatgtcttaacagattaaagcaaagacattaaagatttggtcaaatctaagattagaaaccaattattttgacttacagtccaatattgtatctgttttgcataagttaatggatgcctattatgttgtgatattccggatgataattctatttatgtaatgctttagtcgtaaacattcaaatactgtttctcagaaaaaataatgcaccgtgtttttttaaaattctgtgttaggtcaaattcagcattctgtaattttttcacatttatattcttcttcttcttttttttttttttttgagatggagtctcactctgtcacccaggctggagtgtagtggcacaatctcggctcactgcaacctccacctcctgggttcaagcagttc

SEQ ID NO: 217996 - DNA, 105 bp, Homo sapiens
gtagcaggagaggagatgggtgacggcagaaaggggacagatgagggtaaaaccaagagccagatcccaagcccctcaaaccacggacctgcgagatagacaggg

SEQ ID NO: 217997 - DNA, 543 bp, Homo sapiens
atttttagtagagatggggtttccccatgttggccaggctggtctcgaactcctgatctcaggttatccacccgcctcagcctctccaagtgctgggattacaagtgtgagccaccgcaccccgccctaatctcagcctttttatatcttcttggtaggcccactttttggcatcccctaacaagaagtcctcagagatttttactactcaacatgtgtgcgtcccactcagatgtattgtgttctttctgttcaccctctacttcccattccatttcttcctctgacttagggttagaatggcccaatgatcctacaactttttgatgctatttcatttgattcctctactgtctaaatcacaagttggctaactttacttactgtaagggatcagatagcaaatagtttaggccttgtgggccattcaatctgtcataactacccactctgaccatatgtagtgcaaaagcagcccttgacaatatataaatgaatgaacgtgaatgtatttcaataaagctttacttgtggacactgaaa

SEQ ID NO: 217998 - DNA, 457 bp, Homo sapiens
aaggcagattaggagatggccctaaagtgcttaagtctaccatttttgcactcccttgacctacggttgtcaaatgtttcttggtgaggatggagatacgtgacaatgaacaggcctttcttgctattaaacagatgggtggttcatgtttcatttagcatttattcaaaagggtttcccccacaaactcaagcaataataataaagatgtattactcctttatgctatgttatctggaatttattcctaagtatcactgaagcaagactgcaagtggtttgtgcatttatatatcttgaatcgctatacattagaaaagcatagaattgttatttgccctattacaactgcttttgtattaggtttagaaatcttctcagtttttgtgcaatcctgaaaagaaaaaatgaccctttaaattctattcactgtctgatgaaataaatccttgtgtaa

SEQ ID NO: 217999 - DNA, 425 bp, Homo sapiens
acatattttcttgtaaaataatgaagttttgacttgctttgttaattagtggttgggtgaataaaaatttactcaaagcaggactactacattgtgagagtaaattggcaacagtgctatttatttgagctctgtttaaaaaggaaaaaaaggactctccgtatatctagctttctcctgtgtgagcactacactttaacaaggatatttctggacatagtaggaagcatggactgtggtggggagagattggggattagtataccagttaagaggcttttaaagtagtctaggcaagagaatattagaaactctaaaccagacagtgaaatttttagagtggaattgtggtgaagattactttgagacttttatgaagtagaatgaaaagatttgaagaagaattagatgtctggaggttaggg

SEQ ID NO: 218000 - DNA, 419 bp, Homo sapiens
cagagatgggagttatgctgctacaagccaaagaacagctataacaaagactcctttgacctaattctggtcgcactcctctaagccctcaaggccctgacctttggtctccgcatctggcatgtgtagtctagttcagctggatcagtttagtgaaaatcccccattcttgatatctctctcaatatcttaccctggcctgccttcatcaagaatctgctgagtcagtctagcaagaatacccctttatctctgatgtttcctctcagtgatttttccattcaccaatccccaacttgctccttggctgtaaattcccacatttccttgttgtattctgagttgagtccaatctttctcccctacagccaaatcccattgtagtagtccccccgaataaagtctgccttaccatcttt

SEQ ID NO: 218001 - DNA, 443 bp, Homo sapiens
aggactctacttctaattgtatagagaacactgataatccatggcattaactgtttctagagatacacaaaataaattcacctgatactcctaattcaccacttacgagacacaaggaacttgatgattctgcatgattctttcgaacatttgtggaaaaccaagggatataatgacattggttggttgctcctaacattgctggagaatgtggtgaaagaaatggatgagctcaggaattggaatcctcagctccagacgcacataaatatcctagaagattctaatgtgccctgaaggagaatattctctcctgtagccacagggttgaaattgcttaaaatcaaatacaagtcctcaccttgcaattggctgatttacaataaaatgtgaactctcagccttgcagggtgtgtactgttgaagtggggggcatcgattgg

SEQ ID NO: 218002 - DNA, 508 bp, Homo sapiens
aatagtgagaagtcccatccttgacagaggtgtctgggaaagtactcagtgaaatgcgctgatatcttttcagtgggaagtgagggagacaccagggctgcacttacaggtcaatgggaaagcaatctgcctcccaatcatcctcttgactcagtgttctggctattcagatcagacaggcacctcttttcatatgcaggaatgctgatgttccaagtagagaaagattgtgactgtctcctgcaacctggaaggcactcctcctgtggggatgtagtcaccctggagtgtttcagaaagtctgtacacttaaagtataataataataataataatatatatataataaataattttaagatttcaaaaaaaattaaaacaaatgtgggtcggttcgggagcaacaaatcttttcttttttattatttaatgttcaaaatttaaatatatatatatatatatatatatatatatatatatacctccaataaatgaaacctgatgactg

SEQ ID NO: 218003 - DNA, 282 bp, Homo sapiens
actatcgcattttttcataattaaaaggtatttgttagttatccatttataagactggtgtgttacaagctttaagagtatacgcatgcagtttttataatgattaagaaggctttttattatttggaaatgcccagaatatagcagtcaatacctaaaatacttgaaatatgtcagagcatcattatgggtgatttcttaacatttttataaatggttaaacaagtatttgaaaatatttgtatgcctctatggaatataaaagttaagtttaaaattcta

SEQ ID NO: 218004 - DNA, 357 bp, Homo sapiens
tttcagtggatctctgtgactcatgagctgaatgaccttgaagcaagttgctgcccctctctgagccacagttttctcatctgtaaaatggacccaggccaggcacagtatttcatgcctgtaatcccagcattttgggaggccgaagtgtgaggattacttgagcccaggagtttgagaccagccctggcaatatagtgagactgtgtctctataataactaaaaaaacttagctgggcatggtggcgccatgcctgtggtcccagctacacttgagcctgggaggttaaggctgcagtgagccgtggttgtgccactgcactccatccagcctgggtgacagcgagaccctgtct

SEQ ID NO: 218005 - DNA, 390 bp, Homo sapiens
actagaaattaataataaagatcagtaaattaaagttccttccacctggaaaatttaaaactcttaagcaactgtcttagtacattttgtgctgctataaaagaatacctgaggctgggtaatttataaagaaaagaggtttatttggctcacagttttctgtaggctgtacaagaagcatggcgtcagcgtctgcttctggtgagggcttcaagaaactactcatggttgaaggagagcagacttcacatggcaagagaggaagaaagagagtaggaaggtgccaggctcttttaaacagccacattgttagtgaactaagagtgagaaatcacttattattttgaggtggcatcaagccattcatgagcgatctacccacatgatgca

SEQ ID NO: 218006 - DNA, 511 bp, Homo sapiens
caccattcaacgcactgcaaagtgacagagtgagaacatcagtccaaaagtaaggagagaccctgtgccatcagagacggtgtatcctgtggagtcattcaggcaggtgacttggaacagggagtttcagcgtagtgagcccttggtgcctggcttaggagtgaatgagattaggagaatgagattagaggttacagagccttcctaagaggccccaagagtcttccagacctcagcacccccatctggaggggagcagtgggccctgttgccctcacacctgtgtctctattgtctgaaagttcagtagaagggagttcaccacctctgtcacctctgtcagctcctgcctgggggccactctctcctcacccagacacaggctccccagccagatcactctggaactttccctggcagctcagagtggcaggagtcagagctgtgttgacattgcacatttttgaacctgtctacagcagcctgggttgggcacaacctggaattgccc

SEQ ID NO: 218007 - DNA, 508 bp, Homo sapiens
aaagatgagatcctgactcatctcctgataccctgacttactcccttgctccaaacatcctgaccttgctattctttcatcatgccagacactctcctgcctcagggcctttggatggaaaactcttccttcagatatctgaatggctcaatcctttactttcttcagggctaccttcttaatgaggccttttttggataccctaaaatttcagcggactcccacacttcctataatttctttgacttcttttccttatgacttaccattatctaacatactgtacgtttaatttttcttgtttctatctgaatgtaagcttgaatggctgtgcatttattttgttgactcattgctctggcatctaagacaatgcttagtacattgcaagcatttgataaattcattaaatgaataagaatattgaggcccagaaagatgaagttactcacctaagattacacaggtaatgaacaataaagctaaaatctaaacctacattgcctta

SEQ ID NO: 218008 - DNA, 339 bp, Homo sapiens
ctccgcctcctgggttcaagcaattcttgcgcctcagcctcccaagtagctgagattacaggcatggtgtccaccaatttttttttgcattttttggagagacagggttttgccatgttggccaggctgctctcgaactcccgacttcaagtgatccatccacctcagcctcccaaaatgctgggattacaggcgagagctaccatgcccggcctaaatcctaaacaacttgaacattttctttaaatatgtttattcctagcttgtatcctctaacatatgttactcctgctagttcaataaatatctgttcaattgtttttgttgttgtcttgattc

SEQ ID NO: 218009 - DNA, 1319 bp, Homo sapiens
tatcttaaatgggattttataactaaaatctaaagttcaattcaagagcaataataataaccaccaatacaattttcaaaaagggtcatcagaacattttaccctatcaggtatcaaaacttactttaggaaaccatagttgttataagagtaatactgccctaagaaaaggaaaagagatcaatggaacagaatagtctagaaaaagacccaagtaatatatataaattagtttatgatgaaagtgacatttcatactagtagggaaaaagttggaattttcaaagaaaaaaaatgatgtgacagaacaaatcgttcttcatctgataaaataataagcttagactcatgtcacaaatcataaaacaaaaaataaaatcttccaaaagaaccagaagtaaatacagaatagttgaaaaaatgtgaaaataaagccttctgtcctaggtaagaccttaaaacctagaacgtataaaaaaggctgacgttttaaatcataaaaattttaaagctttttcatgaccaaaaaaatgcagtttaaagacaaggaagagtatgggataaaccattttcaacatacataaacaaaagatttcaagtcagactgtatcagggagtcctttatactataaaactatttgtaccataactatgagaactggacagaagatataaataattcacagaaaaaatgttaataaacaagatatgtgaaatatactcaaggttttaggtaaatgcaaattagaacagcacttttttggccacagaagcataaattaacaattttcatataaatcctattttgaaaccaactcgatagttgataaaaattctaaatccagaattctagttttcttaacttatcccaaagaattacttgcatctatgtgaaaagatttatatataataatgctcattatggcactgtttttattagcaaaaaacttaatgggttaaatatattacgatatatctatatggttttgtagagtagtcaaattcagagaaagaaagtagaatggtagttgccaggggctggggggagaggaatgggaagttattatttaatggatacacagtttcagtttaagatgatgaaaaagttctggagatggatgattgtgatggctgttgcacaacaacatgaatgtacttaatgcatctaaactgtatacttcaaaatggtaaattttgtattttaccactatttaaaaaaagtgttcatctaaatgtacttatgaggtagtctccaatgtatagttttaagggaaacaaatatgttgtagaataaagtataattccatttatctttaaaa

SEQ ID NO: 218010 - DNA, 196 bp, Homo sapiens
actccctcaccaaggtacccaagcaacgttccaaacatggcattagcctcaaagttcaatgactctatagttctatggaatgcctacaaatatttttaaaatgtaatcacttatagaaagattcaacaggctattttttcccttcaaataaatttagaatacacacacacacacaaaaaaaacacctcgtgattat

SEQ ID NO: 218011 - DNA, 456 bp, Homo sapiens
gtttcagcatatcatcaataacactgggtattactatttttaatgttaggaaaattgatatctcatttatattaggacaaatacaagtaagatataattgttttggaactctgtacaatgagctgatgacattgttacaatgagagacacttgttagagaccagcttaagcaaataatgagatttattgcctcatgcatctgggtgctggcctcagggttgattgattcaagaactcaaatgatgtcacagaaagtgctatccctcattcctcttctattgcagacacttttttctaaggagggaggcatggttgcaaggaggtctaggcttatatcatcttagctaaggaggtctagaggaacgagacatctttgttgtctctgatttaatcctacattaatcagagctcatttaagtgccatgatagaaacccaatttaagctggcttaagcca

SEQ ID NO: 218012 - DNA, 440 bp, Homo sapiens
tgggtgggtgtttcaagcctcttcagaagcgataacagtactagggttttctgggaagggccggtggtgagtgtgattttgctctgccccaggtaactgttctctacaatccactttagggtcttggccacatgtgggaggtggtcccagcagctcctctgtaggcatatctgagcattttgtgaggttggagcctttctctccagtgagttcatggttccacaagaggaagctgcctgctatcgcctgtgctcatttgatgacttcctaggttttacgacattaatttaagctctgcagcccaagtaactctctttgattgcagcagtatgcgcttaaatgtcagagctttgctgaaaaaccacttgagtttgaagaaagtcattgtgttcagtaaaatctagccacattttatgtttatgacctttattagggcatcc

SEQ ID NO: 218013 - DNA, 186 bp, Homo sapiens
tttattgcctaagtaggtgacctatcagagacagtcttcccttttttcaattatcttcagtcgctaatcacgaatccttggagccctcattcacttggtattgagaaagcaagtgtgcttccatactgtctgagacctcacacgcttttctacaatggcattcaataaagtgcacgtgtttctggt

SEQ ID NO: 218014 - DNA, 347 bp, Homo sapiens
ccccacctccaaatattggcaggaaatttagactagcatttcaaaattagtgcaggggtatggtcacatctttggcactttatttttaaagattacaaatcgagaagtatagcatagtccttttatcttttaaataattagcttatttttttgaaatttgtcatctttttgactgacattttccagagaattgctgtaaagccacaagatggagctcaagctaagcaccaaatcattttggaattagattgagtgagctaaatcacattaggaattgaatgtaacactttttgtgttttaagaaattaagtctgaaatcaaaatataatttaaagatgatcaaaact

SEQ ID NO: 218015 - DNA, 519 bp, Homo sapiens
aaatgtgtatatgtatttttttttagccttcaaatgtaaattaacatggagcccaagaggccaaaaaacagctgctacaaaatataccagatttgtattatattgaatttgtggcccaaaccagaccatatatttttctgcttggtaaaaatgtgatagtgaaatgggagagttcctttgaccccctcatgggacttgcgacagggttggctcgtttgctcagctgccgtgcccaaaccccttgtgggaaagggagcatacaggtgagggggtgcagtctctggggtgaatgtctttgggcactggcaggaacaaacctgcagcagcctctaggggttgcccacaacctctggagcccctaagggtgtgtgttacaaacaatgctcttttagcatttgccttctactgttggctaagtgttaaccagctcagtggagggtcagggtgacagctttttacaccctgccctcttggtacctaggttcttgtccagtgtccaggaagaatcagatcacacgg

SEQ ID NO: 218016 - DNA, 521 bp, Homo sapiens
atatcaaatacttttgtatttcaaagctaattttaaagaattaaaatcttttttataggtacatgatagttgtattatacatacttacagagtacatgtgatattttgatatcacacaaacgtatattataatgatcaaatcagggtaattagaggatcaccaagaatttttttaagatagtttttatgtgtagaaaaacataaaaataaaatcaaacatgctgttgcaaactgtcccaaaatattagtcaagggtgcttggaaaatattcaaggctcttctgtttcttaacttatcctgttttggtatataccttttaatttttgttgtggccataatttattgtattaaacaatatagtgtaacaatgatttactcctcatttaaattgtaatttgtcttataagtaatctagaaatgatttaaaatatttgggaagatatgtgtaggttatatgcaaatgctatgccactttatatcagggaattgagtatccttgggttttggtatctgtgggaggt

SEQ ID NO: 218017 - DNA, 347 bp, Homo sapiens
agtagaggcggggtttcactgtgttagccaggatggtcttgatctcctgacctcgtgatccacccgcctcggcctcccaaagtgctgggattacaggcatgagccaccgcgcccggcctgtcttgggtttctttggcatcttctcattccccatcccgctgcaagactctgtgcctatggaggcctcctagtggtataatgtgaagtttctgtgcatgggatggcaagccagttaggaaggaaggtaagtaaatatcccttccacttcctggacttcagactaaggctggttggattcttgctgtgtccctaatgcaatccccgagccccttccactgtgcattctg

SEQ ID NO: 218018 - DNA, 275 bp, Homo sapiens
gtacttctgcaactgtattcctaagaaaagtacatgtgctgtgttatctgagttgcaagctgaatgagttgtttttcatgactgctatttttacttgaaagaacaactgagagctgggtgtgctggtatgagcctgtaatgccagctgctgtggaggtggaggcaggagtttgaattcaggtccagcctgggtaacacaataagaccctatctctacaaaaacaaaaacaaaaacaaaaacacaagaaaccagacacacatacaaacacaaaccc

SEQ ID NO: 218019 - DNA, 524 bp, Homo sapiens
cagtagtggtaagtagtaagatttgtgatatatttttaagatacagcccaaaaatttgttggtgaatactatggtttgactgtgtctcccaaagttcctgtgttgaaaatttgatctcaaatatgaatgtgttaagaagtggggcccagtaggaagtgtgtgggtcatgacgtcatcaccctcttgaaggaattaatgctgttgtttcaggagtggtttccttataaaagaatgagtttggtctccttttgtttctctctccctctctttccccatctactatgggatgatacaaaacaaacaagcaaaaatgtccttgaaaaattccagcccctcaatcttggaagtcccagctcccagaactgtgagccagtaaaggtctgcttattataattacctagtctctggtgttctgttagagcagcacaaaattgggctgagacaatagattaaatatgagtaaatcaattcatatgaattaatatgtctctattcagtatcccaagttatgagggtagacaata

SEQ ID NO: 218020 - DNA, 475 bp, Homo sapiens
aaatgttttattaaaataaaatgaatggttgggaaactagaaagaaaattcatctttgcagggaagattatgaggttgatttgagatacgttgtttaaagaagtaatgtaatacattcaagtctaaatgccctctggacaagtgcacatagagaagagaaagtaaagactctaatcaagaagcagagctcatgttttctgattcccagatccgcactcagtcttgaccacttgcattaacccaatgaacagcagtcagaacagacgcttacctctaaatggatgggaagacacgctgaattctctttagcataaaaggtattatcattaaagttgcattatttagagaacatggggagttatgaggtatggctacaacttcctgaatcctgcctttctctttacaacccgggccatctgccttaatggttctgctagtgttttcagtggctttccattgcctttgacaatgaagg

SEQ ID NO: 218021 - DNA, 346 bp, Homo sapiens
ttttctttttttggaatgtgtactctatttaatataatctttgatggggttaagtttatgtctatcatctttctaattgttttcagtttgtcccctcagttcttttttttgtttgtttactgttactcttttctgtcttttgagaaaataaaatatacttagtattccattttatcatctctttggcttcttagctacacctctctgttttattttctttaatggttgttctagggattataatgtgcatctatttgttagattcattacagtgcatctttaattattcttacatcacttctcctatgttgaaaaaaacaacagtataattctgtatacttctctt

SEQ ID NO: 218022 - DNA, 388 bp, Homo sapiens
agatacatgaaaatatgcaaatcacgaatcatcagggaaatgcaaattaaaatcatgatatctcacaactgttaaaattggctatcatcagctgggtgtggcggctcatgcctgtaatcctagcactttgggaggccgaggtgagtggattgtctgagttcaggagttcaagaccagcctgggcaacatggcaaaaccctgtctctactaaaaaaatacaaaaaaattagctgggtgtggtggtgcacacctgtaatcccagctacttgggaggctgaggcacgagaatcgcttgaacctgggaggtggaggttgcagttgaccgacatcatgccactgcacaccagcttgggtgacagagcaagactctatctcattaaaaaaaaaa

SEQ ID NO: 218023 - DNA, 598 bp, Homo sapiens
cagccattctgacaagaactagactttgggctccttgagaatattcagttttgtaagttttaatatcctctcaccatattcagcttaaaataccatacttaatgattatccttggcaagacaggtgtgaaaggattgctgttgtattacaatcatggtgcaaaaataccagtcaccagtgagggtatacaaataccccttcaaattaattatggctgcctatgaaaggaggttccctacgtgtcctttgattccgacattcatgggcagtgacactgtgaatgaattcaagagtgaagatggggctgttcatgtcattgaaaggcgctgcaagctggatgtagatgcaccaagactgctgaagaagattgcaggagttgattacgtttattttgtccagaagaactcactgaattctcgggaacgtactttgcacattgagggtcataatgaaacattttccaattgctataccgttcaccctgaaaatgaagattggacccgttttgaacagtctgcaagtttagatattaaatctttctttggttttgaaagtaccatggaaaaaattgcaatgaaacaatataccagcaatatta

SEQ ID NO: 218024 - DNA, 615 bp, Homo sapiens
gactcacacatctgcaattgtctggctattgcctgcagctggctgctttgtgttggccttgcctgtatgactggaacaactggggttcctcttcttccaggtttaattcatgaaatcctgccgtaccttcaataccaagatttatccagtctagcacagtactccaattgtgcaatgcacctttatatgtggataacatctggacccctccatctacctgtgccaaagaaagaatcacaggagaatggagaccctccacgctaatacaaatatattccacttctattagaccacccaggccatggcattaactccatgacatgaagaaaatgcaggaggaggatactcaatacaacaggacttctaaagactggcgaaatgcttcatgatatcatcaaagaatgagatgtacttaaatcaagaatctcaagatgaaatcattctggattatccaagtgtgtcctatatccaaaaaaaaaaaaaaaaaaaaaaaaaaaatttgttggcccgcctggccccttaaaaaaggtttttaaaccccttctcgtggggggggggggggcccccatttgttttgtggccactgggccaaagcgggttcccgagggaaatctc

SEQ ID NO: 218025 - DNA, 525 bp, Homo sapiens
gactcacacatctgcaattgtctggctattgcctgcagctggctgctttgtgttggccttgcctgtatgactggaacaactggggttcctcttcttccaggtttaattcatgaaatcctgccgtaccttcaataccaagatttatccagtctagcacagtactccaattgtgcaatgcacctttatatgtggataacatctggacccctccatctacctgtgccagtaagtaaaaatgctttctaatcctgcttcgatgaaattgtctgggggcttcatgtcattgttcttcagagttggatctcaattagtgtcctggaatacatgtgtcgtttcttagttaacccacccactttatttaagcgcatccaaagtaactacttcaaaaaatggtgtggagaagtagttttctgagttgcataaaaatatacatatgtttattgaataatttgattggtattgaggttttggcttgaaactgttttccgttagaatttaaaaattgttgcttggcttccagcattc

SEQ ID NO: 218026 - DNA, 396 bp, Homo sapiens
aaagcagagttctaagcagaatcctaaccctgcgagggtggggagaaaatcaatgttttgagctggtgtctgtttgcagcgaggtgctggtgaggccattttcatcaggaggaacggtggtggtggctacttctgggctttagatccacgcaaggtctcctaaatacaagtcactgtcatggtacacaatttagcaaaacttggaggctgattttccccgttgacttagctaagggtcaggaggaagctgtttagaagtacagaggttctgcatctgggagggtaaaatccaaacgcctctcatgctcagagggaaagcatgcctgcatgtttactatcactgctggcctacgtgcttgtgtgtctgaaataaaactgtaacttatataaaaaaaa

SEQ ID NO: 218027 - DNA, 396 bp, Homo sapiens
aaagcagagttctaagcagaatcctaaccctgcgagggtggggagaaaatcaatgttttgagctggtgtctgtttgcagcgaggtgctggtgaggccattttcatcaggaggaacggtggtggtggctacttctgggctttagatccacgcaaggtctcctaaatacaagtcactgtcatggtacacaatttagcaaaacttggaggctgattttccccgttgacttagctaagggtcaggaggaagctgtttagaagtacagaggttctgcatctgggagggtaaaatccaaacgcctctcatgctcagagggaaagcacccattcacgtcccataccctcaacgccgacagcgtttgcgggttttccttttccctgaaaataaaataaaaaaaa

SEQ ID NO: 218028 - DNA, 422 bp, Homo sapiens
cacctcagatcctgactgagttggtctgaggtacagccaagaattgatattttccaggctccccaggtgattctgactgcaagtagggctgggaacctcctagttatgttgagaatgtgctgggcaagtcagacagttaatcctgtatcactactttaccaagggctgtgttctttcctgccagaacttggccccattcagtgactttgtctgcaaatcaggatagctacttggtgaaggtgagtgaaagttttgggtttatggcttaaagaatggacaaataggcctggcatagtggttcctgtctgtcatcccaacactttgggaggctgagacgggaggatcacaggagttggaggctgcagtgacctgtgatcacaccactgcatgctagcctgggtaacagagtgagaccccatccg

SEQ ID NO: 218029 - DNA, 189 bp, Homo sapiens
agttttgagcacagagccctgccagcatctctcttctagaagaacctgcaggccaagaccctgattaatttttagcaaactaacatgaccaaaaacatttttttgggtgattttagtaattgaataggtaacattagctaataaggctgtttttgctgttttaaaatcagaactggttagctctccaat

SEQ ID NO: 218030 - DNA, 435 bp, Homo sapiens
caatttcttttcatatgtgctgcatctgctgataatttatgttctcaaagccttccttttcttctaagtagctcattaaagtgtttccctaaacactcttccctttctaaaactgagtctggcataagctattcaaatattaaaagttctactgaactacaattggtttgaaagctgcagtgaacagactggactgccttcttttaaagcacactttcccttttagcaatataattctattcaacttttgctttcaatgtgtggcaccaaatctctttcatctcaaaaaggcagcagtcttttcaagaatactctggaaacacctttcccttaaatgttttatttgattatcagcactgcattatcactattttctaattatcgtcatacggttttggtcacacttaatgaataaaaagtaatggtaaaaaagaa

SEQ ID NO: 218031 - DNA, 2195 bp, Homo sapiens
ggcacgagggtcgggcggagcaggcggctgcttgacagctgagagccgagcgggcggcgcgggcaggtccacgggaagcctacacgcccaaggtcatgccctgaccacagctgcccttcaggaggctggcacggagccacctggggccattgggctgtttgtcaagggtggggcagcagcaacttgccactcttcctccatgagcccagccagagcctccactgggcacttagcacaagaaaaaccctgcaggagccggatccagagcgctgggattcagcaggagtgccaggagaattcaacacaggtgtgctgcctcctctcctgccaggtgtgtggctgcacaggagtcttgctgatggtggaattcaagtcaccagtggccaaagtaccctccaggtgtgaagagttgcaggtcctccgaggagccgggagctgcaaggttctgaaaaagacttcaagaaactgactaatcgcgatggctgcccctgacgggagggtagtctccagaccccagagacttggtcaggggtctggccaggggccaaaggggagtggagcctgcctgcatcccctggacagcctggagcagaaggagactcaggagcaaacgtcgggccagctagtcatgctgaggaaggcacaggagttctttcagacctgtgatgctgaaggcaagggcttcatcgccaggaaggatatgcagaggctgcataaggagctaccgctcagcctggaggaactggaggatgtgtttgatgccctggatgctgatggcaatggctatctgaccccacaggagttcactactggatttagtcacttcttcttcagccagaataacccaagtcaggaagatgcaggtgaacaggtggcccagcgccatgaagagaaggtgtatctgtccagaggggatgaggatctgggcgacatgggcgaagatgaggaagcccagttccggatgctgatggacagacttggagcccaaaaggtgttggaagatgaaagtgatgtcaagcagctctggttgcagctgaagaaggaggaacctcatttactgtccaactttgaagacttcctgaccagaatcatctcccagctccaagaagcccatgaggagaagaatgaactggagtgtgccctaaaaaggaaaattgctgcttatgatgaagaaatccagcatctctatgaggagatggaacaacaaatcaaaagtgagaaggagcagtttctcctgaaggacacagagaggtttcaagcccgcagtcaagagctggagcagaaactgttatgtaaggagcaggagctggagcagctcacccagaagcagaaaaggctggaaggtcagtgcacagccctgcatcatgacaagcatgagaccaaggctgagaataccaagctgaaactcactaaccaggagctggcccgggagctggagcggacttcctgggagctccaggatgctcagcagcagttggaaagcctccagcaagaggcctgcaaactccaccaagagaaggagatggaagtgtaccgtgtgacggagagtctacagcgtgagaaggccgggctcctcaagcagctggatttcctaaggtgcgtcggtgggcactggcctgtgctgagagcacctcccagaagcctggggtcggaaggaccagtctgagggtcatccttgcctacgtgctggaaaaacgtgcctgctgagagagtgccctcaattcccttggtccccagtgcagtgtttggaccaccaagtagccactctattatgtttggtccgtttacacatgcgcccacatccagtttattcctcctggtggggaggctctgccccactcctctgagtccctcacaggactgtgcttggtacttgatctcatgcgagcagagctgggtttaatgagcatttaatctatgctagaaatattatctcgttcattgtcagcaaaactgttaggtgagtagggcagttcattcacaggaatttactgatgggaagttgatattagaggaaagaagtaatttaccacaggcgacacagctactctctgatggggccagaatggaaatccgtaactcggctgtgttctgttcatgtttgttgaatgagtaaatgaatcacaaacagagcaccaagaaaaagctttctcagccttcaaagacccccagcaataaactcaaagtttactggt

SEQ ID NO: 218032 - DNA, 525 bp, Homo sapiens
ggcacgagggtcgggcggagcaggcggctgcttgacagctgagagccgagcgggcggcgcgggcaggtccacgggaagcctacacgcccaaggtcatgccctgaccacagctgcccttcaggaggctggcacggagccacctggggccattgggctgtttgtcaagggtggggcagcagcaacttgccactcttcctccatgagcccagccagagcctccactgggcacttagcacaagaaaaaccctgcaggagccggatccagagcgctgggattcagcaggagtgccaggagaattcaacacaggtgtgctgcctcctctcctgccaggtgtgtggctgcacaggagtcttgctgatggtgcttttctggatgccagggatacagctgtgaaccaaagagacacctgccttcatggagcttacactccagaccagcgctgcacatcagaaatgcaacatgagccacttgtataattttccattttggccacattgttttaaaaaagtaaaagaaacagatga

SEQ ID NO: 218033 - DNA, 367 bp, Homo sapiens
aaaaaaaaaaaaacaataaaaaatagcaatacaacaataaaaaataatacaaataaaaacccaatacagtataataattatttacacagcatttacattgtattaggtattataagtaattagagatgatttaaagtataagagaggatgtgcgtaggttaaaggcaaatactatgccattttatatcagggacttgagcatccatggattttggtatgtgggggagttgggtcttggaactaataccatgtggatacccagggacaactgtacattcgctctttcttttttacattatcccctttcattcctctttcctcctcacctctttttagccacaatctcatagctgcacagcaactcgga

SEQ ID NO: 218034 - DNA, 659 bp, Homo sapiens
ttcctgggggcaatttacaggttctctggattagacagccccattgggacatcgctcggacccttcaccttctagcccacgcaggacaactcgctggcgtcggtcacaccttccgcaggtggttggaccgcctaagccagatgcacccggcccacctcccttagcaggggttccgaatagaagtgtgaaaatgtgtgcaatgacttctgcaaatcagaggacttgttgaaaggtccaggggtccaggcgtgaagggaaagcagccaccctgcggggcgccccctccccggcgtctcccgggcccggggcgctgcgcaggccgccgccgatcccagggcgcagccagcgcacctcgggcctagcaccattagaaaggcaaatcgcagagccggggtgcatttaaatgcccggccatgggccctgggggtgtctctccagcgggcgccgccgcaggggcctccagggcgcgtcgaccccggggcgctgggcgcggcccgcgggcgcacccaagacctcagcccgcagcgcccgggcgtccgcgccaggccggggcaggggagggcacccagagcccccgggcccgcgtccccggccccgcccgggcccctcggccgcctcccagggagagggcaagctccccggcccccgcccgcggccgc

SEQ ID NO: 218035 - DNA, 271 bp, Homo sapiens
ggacagatgaagactagtggatggaaagtctcagtagggtgcaagctttccaagtataacgactgagtccgagtcatctctgttacccagcacatggcctggcacaaaaggagcagggctgagtttattcacaaaaccagccttttactgagtaccctctaggtgccatgccctgatctgggtactgggaacaaactggtgaccaagatggacaggatccctgcctacctgcggcttatagtccagtgatgaacaaagatgctgagcatct

SEQ ID NO: 218036 - DNA, 595 bp, Homo sapiens
aaggtgtctagtaagtacaagatgaaacatcacttacctaacttcccttcccacaacgtcactaaagctatgggaaaggaatgaaaaaggtatcaactcacatgggcaaataaatggaaacaataacagcaatagacgggaaatttaacaaaatatttggaacacacccaaaaaactggatgaaaaagctcccattttagcaataaagggaagtagaatgatatttataggagttttaaaaatctattatgggctgggtgtggtcaaacattgggaggccaaagggggtggatgacctgtggtcaggagttcgagaccagcctggccaacatggtgaaaccccgtctctactaaaaatacaaaaattagctgggtgtggtggcacacccctgtaattccagctactcgggaggttgaggtgggtgaacttgggaggcggaggttgcagtgagccaagatcgcgccactgcactccagcctgggtgacagagcaagactccatctcaataataataataataatgatgtctttcgtttgtttgttttgagacagagtctctttctgttgcccagccggggtgagggggacaatctc

SEQ ID NO: 218037 - DNA, 415 bp, Homo sapiens
atgccatcactgtaatgagccactgtggaatcttgtggaaaggggaagtgattcaaaatccttgtgagctattgacatagggctgaagattgatacatctctgaggtaggacagtgagggtatattgctgtcctggccagctgaaagcaaactgcttctgatgggccttatggacaggaatggagaaaaagggatttggcaggtcaatagctgcatgccaggtaccaagggatatgttcatttgctcaagcaataaaaccacatctgctacagagcttcaattagagtcaccacctggctaagcttgtggtaatccattgtcagtctccaaaatccatctgtcttctgcataggccaagtaggtcagttgaattgggatatagtgggaatcacttctcctgaaacttttgagtcc

SEQ ID NO: 218038 - DNA, 379 bp, Homo sapiens
gagggacagcaggcacataaagatggcagatcttgcaggattttttcagcagagtaagagaaagagaatatgagtgggaaaaaaagtgggaaggggctttcaggtgtaaaagttttagaattgctgagaaaccaacacaagaagaatgcttccgtttttgctaagtatctgcttaatgccaaaaatttatatgccatgggtccagccagcaacatccaatcatctgtgagatgattgctcaggtcaggcattggcacagcaggcatgaaggaagattaaagggtcaagtgacccctgggcatcactgagttagcactgcagggatgaccccacagtcctggctagagagagcactgagaagataagtaggagcttatgg

SEQ ID NO: 218039 - DNA, 223 bp, Homo sapiens
gccaaggacacaggcagctgtatccatccacaggctggtgtatccatccaccaggcactacattagttgagtgtcctggtgccagctctgaatttagagatagtctcagtgtttttcactgttgcatcccaaaagcctagcacattgggttgtaggaagcacttttcagagaaactccctgatcttttcagtctggatcagaaatcctagagtggatgtgtgt

SEQ ID NO: 218040 - DNA, 426 bp, Homo sapiens
gaattttgtaccacgtgctcatattctatctcttactctcctctggccccccactttcctaaatagagaatcacacttacagttggtaaaattaaggtgatactatcgtttgtagaatgggaaagatttaaaagaggcataaagaaataaatttgattagtatgtaatgaccacagaactaaccttacaaagaaacatagcctctgaaaatattagcagtatgatcataagttgggtggatcatatccacccaggcaacatggcaaacaaaatatgctccttggatcgacctacaacatcaataatccaagtctcttattcagtagctcagggatagcagcaattcaagtcatggcttcagtcagtctaatctgaagggtatttgcatgaaatgtcattcagactaaatggctcagggtgaccttg

SEQ ID NO: 218041 - DNA, 432 bp, Homo sapiens
atttcagataagtgttatataatgatcactggatcagttagagtttttgaaacttttcccctagttaggtaactactaaaagaacattgtgaaaattccagagaagtataaggaagaaagtatcactcacctatattcctgtggttgagtagacagttttgatcagagggaggaatgtagaagggaaatttatttatttattataggagaaaggagaaggtatcagttattgagcatagatagacattcaaagaaaccttgcaggtcagccaggccttgagaggagatggggagagagaaagagacagaaatagacaaaagaaaacaggcagaactctggaatggtttgcattcttctgaaaacagtcagaggaaccaagaacatagtaggcatctggccaagtagagttcagtgcagttaaggtcttggtc

SEQ ID NO: 218042 - DNA, 419 bp, Homo sapiens
gataaatattcaaataagtaaacaacatttgcttgaagactggctttggttttcccgcctttcctgattcctcggaatcaggaaatattattaggctttgttaataataatagatggtttatgaccggttttgttcttgatttacttattcaaaacatagttatggcgccactcagaaacaggtgaattaaaaagaatgaagtatctttgggcctttctgaaagctgcaggaactcttgtggggaggaagaagatagggacaaagtgctcaaaccattttcttggaatctgtgtcagagaagctaagcttgtttgggatgcaacttggagacaagctctaaagcatgttttattttctccttgcgaagagttttttaaggaataaggaatgattagactgttagctccttacaaggtgg

SEQ ID NO: 218043 - DNA, 462 bp, Homo sapiens
cataaaacattgatgaaagaaatttagatatgaacaaatgaaaagatatcctatgtttatggatcagaagaattaatattgtttaaatgttcacactacccaaagcaaatatatagatttaacacaatcctcatcaaagttctggtggcattcttcacagaacagaaaaaaacaatcctggccaggtgttgtggttcatgcctgtaatcccagcactttgggaggccgaggcaggtggatcacgaggtcaggacttggagaccagcctggccaatatagtgaaaccctgtctctactaaaactacaaaaattagctggatatagcggcatgtgcctgtagtcccagctactcgggaggctgaggcaggagaattgcttgaatccgggaagcagaggttgcagtgagccaaggttgtgccactgcactccaacttgggcaacagagtgagacttcatctcaag

SEQ ID NO: 218044 - DNA, 305 bp, Homo sapiens
actgaatttgttgatcaattctaagagtttttttggtagaatgtttaggtttctctatatatgtgaccatgtcatctacaaacagggataatttgacttccttctttccagtttagctgttcttttttttttttcttgcctagttgctctggcttattcaaaggttgttgacacatacatagatacctattttaaaagagtggcatgtgagaaaaatacaggaaatagagcccaataagatatgaatatttgaatttgctgatccattctttcatataggactataagatttaactcttaaaact

SEQ ID NO: 218045 - DNA, 417 bp, Homo sapiens
ttgagctttcgttttttcatgaagatgaagggaaccctttgctaaaatagctcccttcttacctgtacatgaagaagttgtatccctgatgatggaaaatattcatgcatttataaaatgttgaattacatcatgttgcattacagagacttcacaatgtgtgaatggagctgtatagtacaaaaagagaacacctctggctgtgcttctatcatgggcaaatagattgtcatccaggaagctaaagtcatttaggtagtataataggtttgtcatgaaattatcaatagaagtgctatctaataatctaaattcaccaccaatatttcttaaagtttatagtgctttataccgtggcccttataaccagaaacataatagaaatggaaaaatgtggcttaaataaaaattggaaga

SEQ ID NO: 218046 - DNA, 512 bp, Homo sapiens
cacactgctttccacagtggctgaactaaatttacattccccccaacagtgtataaataagcattcctttttctcaacctcgccaacatctgttgctttttgacattttaataatagacattctgactggtatgagatggtatcacattgtggttttgatttgtatttctctgatgattggtgatgagccttttttcctatatttgtttgctgcatgtatgttttcttttgagaaatatctgttcatgtccttttcccattttctaatggggttgtgtttgttgaattaggttgcttatcaattctggatattagacctttgtccaatgcatagtttgtgaatattttctcccattctgttggtagtattcttcagtattggcaaaagcatttatcttctggagaaatcgattgggaagaggctaatgtcactgattccttaatagtgttcttccttatactattattagggttggtgcgttttcattgtttgtcttttgtttatttgtttt

SEQ ID NO: 218047 - DNA, 377 bp, Homo sapiens
actctctgatgtgtttataggatataaattatattgttccttttttggagatttttcttcatgttgataaaaatttttaaaggcatttaatgttctgaaactactttcctaattgtttggtgaaaggttgacaataattcgttctttaaaatctgaagattaatggatctatacctgcttgaggtaatttttaccttaaaaaagtctaacttggaatttcttgactatttgttttatcatgttatttatgctaaatggatgtgtgagaaatgaatttgatgctgctcaaatataccttttccttttgtattgtaaaacctctaaagcaggagcttcaatatagaaatggtctggaattgagtaaggcggatgaattt

SEQ ID NO: 218048 - DNA, 401 bp, Homo sapiens
aaacgtccacagagaatggaaaattactgaacatacaaagaacaaggaaaaatcacaacttgaatgagaagacacaatcaactgaggccaaaattgaagtgagtcagctgttgcaattaccagacaaggattttaaagcagccatcataaaagggcgtcagcagcaaactattcattctccttgaacaaatgaagaaatagaaaaatctcagcaaagaagaagaaattatttaaaaagtgaaagtgagtgaattgaaacattccataaccagaattaaaaactagcaggattagctcagtaataaagtggagaagacaaagatagatcggtgaatatgaggatagatcaatagaatttgctcagtctgaccaacaatgaaaaaggtagacaaaaaaaaaaa

SEQ ID NO: 218049 - DNA, 526 bp, Homo sapiens
ttttttttgagacagggtcttgctctgtcacccaggctgaagtgtgcaggggcactatcatggcttcctgcagcctcaacccctagggctcaacccctacctcagcctcccaagtagctgggaccacgggtgtgtgccaccacgtgggctaatttttgtattttttgtagagatggggttttgccatgttgcccaggctggtctcgaactcctgagctcaagagatctgattgcttcagcctcccaaagtgctgggattacaggtgtgagcaaccacgtccggcctgtgcatctctcttaatgaaacctgccaaggaatctggcaaagtcatggaaccgtgtggtccaggccagcaggatggaagatacagagcagccatgagtcccgaggctgtgacccaagccctcatcaaaacacctgccttgggggaaaaaactctgctagtagaataggtgtctaccagcagtcccaaaagctataggtcctagagggcagatgccacaaatgataaggccccaaaggtaa

SEQ ID NO: 218050 - DNA, 439 bp, Homo sapiens
tcctgtttatatttagtgtgtttttataattctcctggtaaatatgatgtgttttaaagacactctccaaaattacaaagaaagtagtcatttactacacgctcttaactgattcatacaagacagtttactgatatgtaaagcgttatttatattttttcaccgtgacagagaaaaaatatagttttacatttcaactaatatcccacgtgcatacatattatgcatacatgtaattccctattaaaaatgaaaaatcctgcccctttctcaactacattaatttcagggctgcctgctagactctaaagctacagctttaagttcatcaatataagaggcagtttccaacacatcctttttgccaaacctttaccaagggtaacactccccagcaatcacatctctcaccgtaagtcttgatttaggggagggggag

SEQ ID NO: 218051 - DNA, 500 bp, Homo sapiens
tttttttttttgagatggggtctttctgtattgctcaggttggtctcaactcctggacttgagcagtcctccaccttggcctctcaaagtgctgggattacaggtgtgagcccccatttcttttttgcagcctcacctttctttttcctctcctactgttggtgatcacttctgctgagtatctcttcgtcttacttctgccactgtcccatggctcacctttcctgccagtccccaccggcacacggcaccgcacttgcctctataggagtgtggcagccactgccagccatcttccccaacgtccatttctcccctttcccctgcgtgattgcctctgggaataaaagaccacatttcccaggctccctcattctggccttggccatgtgactaactgctggtcaatgggcgcagtttgggatttgcaggaaggctgattaaatgcaactgattccgggttaacaggaagaccctttttgcccttctgtcttatcccc

SEQ ID NO: 218052 - DNA, 394 bp, Homo sapiens
gaagttaggagactgcagagaacagtgtaaattctatgtggaactctatgttgctgctaaaatggataagggaaattctatataaagaagtggacatgactgggccccgtggctcacgcctgtaatcccagcactttgggaggtcgaggcgggtggatcacctgaggtcaggagttcaagaccagcctggccaacgtggcgaaaccccgtctctactaaaaatataaaaattagctgggcgtggtagcatgcgcctgtaatcccagctacttgggagacttgggagaactgcttgaacccaggaggcagaggttgcagtgagtcgagattgtgccactgcactccagcctaggcaacagagtgagactgtctcaagaaaaataaaataaaataa

SEQ ID NO: 218053 - DNA, 337 bp, Homo sapiens
ccaggagttcaagaccagcctgggcaacatagtgagaccctccccccatctgtacaaaaaaattacaaaattaaccaggcattgtggctcgcacctgtggtaccagctacttggaaggctgagacaggaggatggcttgagcctgggaggttgaggctttaatgagccatgatcatgccactgcactccagcttgggcaacagagtgagaccctgtttccaaaaacaacaaaaactggtttcaaatatattgctacattggaattctccataaaggaattaattgttgataacaatgccctcagtatactatttgtcaatacctataacaatgcaac

SEQ ID NO: 218054 - DNA, 277 bp, Homo sapiens
gagatgtgtaggagaggcagagccactactgaaagttcccactagagcagtgcctagtgaagctgtgggaatgaagcagcccccaagaccacagaactatagggccaccagcatataactgcaccctggaaaggctgcaggcataagactccaacctgtgagagctgctgggtggactgagtctaggaaagctatagaggtagggctgcctgaggcctttgtgagcccaacctttccccagtgggcccagcctctgtcctagtgtgcccaggatttt

SEQ ID NO: 218055 - DNA, 568 bp, Homo sapiens
tagcgaagtgaaataaagatattttcagacacataaaagctggaagacactttaaggctgaggtgggcagatcgcttgagcctcagagttcgagaccagcccgggcaacatagtaagaacctgtctctaaaaaaaatacaaaaatagccaagcatagtggcacacgcctggagtctcagttacttgggaggctgagcctgggaggtttgcttgagcctggaaggtcaaggctccagtgagccataattgtgtcattgcactccagcctgggtgacagagcaagactctcaaacaataaataaaaagctgaaagaattcatcaccaacaaacactataagaaatgttaagggatgtctttcaggcagaagaaaaataccagatggaaatctggatctacacaaaggaatgaaaggaatgacaggcattgaaaatggtaactacctgagtaaatatatatgcctgtttttcctttttaaatctctttaaaatataattgaggaatgatatcagcaaaagggcagagtaagacagctccaagctcccatcacccaacagaaacatattaaa

SEQ ID NO: 218056 - DNA, 385 bp, Homo sapiens
cagaaaaatagctgaaaaatcaaatcatttggagattaaagaacacacttctacataacaaatgggtcaaaaaagaagtctcaagaaaaaatttttaaatacttgaaactaaattaaaatgaaaattcaacttaaaatttgtggcatggaacataagcagtgcttagaaggaaacttatagcaatgaatgcatatattagaaaagatgatttaaaatcaataatctaagcttccaccttaataaactaaaaaaggaagaacaaattaaatccaaagtaaacagaagaaataactagaacagaactcaatagagaaaaccaactataatcaaaagctagttcttagaaaagatcaataaaattgataacccttcagccaggcagag

SEQ ID NO: 218057 - DNA, 329 bp, Homo sapiens
agtttctcagaaagaaacatttaataggcgtttatgaacagaaggcaagtcagggatggcaccaagataagatggtggatccctgtgccatcacccccacccccccgacccagggcttctatagcataggggaagggtaatgcgggcttcagcagggatgtgtatggccagacacggtgggcggatcacctgaggtcaggagttccagaccagcctggccaacacggtaaaacctcgtctctactaaaaatacaaaaattagccaggcgtggtggcaggcgcctgtaatcccagttactcgggaagctgaggcaggagaatcgcttgaa

SEQ ID NO: 218058 - DNA, 258 bp, Homo sapiens
tgagaaaggaccatggtttgaatgggagcaccaatcaggttggagtgggaatgtcaaaagctctagatccttaggatctgctgctagagagggcttggaggtgattagaggggtcttgtttgctgaactaaacaaacttatttgctgggaatgacttggtaatgttagaaggaaatttgcttttttgggggagagggtgacaaagtcttgctctgtcgcccaggttggagtgcaggggtgcaatcatggctcactgca

SEQ ID NO: 218059 - DNA, 485 bp, Homo sapiens
agctacaaaaagacacggaggatatttaaatgcacattgctaattgaaagaagccaatgtgaaaagattacacactgtgtaaaatcaactatatgaccttctggaaaaggtaaaattatgaaaacaggaaaaggatcagtggttgccaaggcttggggttagggatagagatgtgcaggtggaacacagaggattttaagggcaatgagactactctctatgatactataatggagggtacatgtttttatacatttgtccaaatccatagaatatacaccaccaagaatgaaccctaaggtaaactgtggactttgggtgattatgatgtgtcaatgtaggttcatcaaatgcaggaactgtaccactctggtgaaggacactgatagtggagaggctgtgcatttgtgaaggtggaggatatacagctaatctctgtaccttcctctgtacttcagttttgccatgaatctaaacttctgtaa

SEQ ID NO: 218060 - DNA, 249 bp, Homo sapiens
gtttaagtttgttttcctttgtggtcctttaatcatccaaggtcaaaacttgggtgttatcctacattcttatttctttttttgatcgctcttgctgcccaggctggagtgcaatggcgtgatctcggctcaccgcaaccactgcctcctgggttcaagtgattctcctgcctcagcatcctgagtagctgggattacaggcatgcgccaccactcccagctaattttttgtatttttagtagagacag

SEQ ID NO: 218061 - DNA, 401 bp, Homo sapiens
gccttgccggcaccttgaacttccagcctccagaactataaggaaataaatttctgttgtttaagtctgagtggcttaacaacagtttaagctgctgttatggtagcccaagccgactaatacaacacttaaggatttcagtcactgagtggaaccaccttagaatgtgaaagacaatgaggatatacacacagcctccttcccctgtgtttggagggtggcttcaaattccttctgttttatgtgctgtgtagggaaaaaaaaatctgtaaaattatgtgagtttgtaattgatagattggttctctttcgtgcaaatagtgcttatagtttaaaagtcctagaaaaaattcacagtcacattttctgtatgtaactacatttatgtaagtgaaaacttg

SEQ ID NO: 218062 - DNA, 255 bp, Homo sapiens
tcctctggggcttggcggagggtcgggagataggaagtgtttgaaggtgacatgcactcagatctataatttactttgaattgcaacaagtacaactataaaattggattaatggacagatacacaataaggcaaatatagtgaaaagttaattgtcaaatctaactgctggttattcaagcgcttattgtccagttcttttaactttcctacaggtttggaaattttacacgatatttaaaatatataatttaa

SEQ ID NO: 218063 - DNA, 523 bp, Homo sapiens
cgatgtaaattattggcttctacctttacgtcagcgttttctccatctctcattttgtcatttaacacactgtgctacaatcatgtggcagcttgatcatctccactacactatgctttatttctcgacaaagctcagcacaaatggcttctgatttaacggatggacgcaggttctgcactgacttctgtttcggaaccacagtaaggctgtgcagcaggagccacgaaacccgactccacctagtgctttaagacgctactgacccgtccctttggcgaggggacaacttcgaagtatgacctggccaggaggagccacaaagcgcgattagcctcgctgcatttcaggtacaggccggcgccagccgtgcctcaccaggtccaccggctccgagcagcagcaagcccggtcggaaagcgaaagtggcctcgccatgtccagaccggccagctcccccgcctacctgaccccgccccgcagccgcacctgggtccgagtcatcgccgcggccgccacggcc

SEQ ID NO: 218064 - DNA, 458 bp, Homo sapiens
aaacaactccatggaactcagaaggagagtccccaaacatgaatttggcagtgatttttcaacactgtccagggagaacataagccagctttccaccatcatttggacaaatttttagtgataggacacatataatttatcaggctttattgtggtttcattttcttttggtttagattcaatactcaccagataacttctcagatgccacagtatgaggaatagggtaccctgtgtggtaagaggactattccccccattgtaaccaaataaactggcatttggcctatatggtaattttcttcataaactttataaaaaataaatatatattttgttgaggatacagggctagtgaaaaataaaaatatcaatataacattaaccttttagaaattagttagcataaattaacccttggaagcctaatcaattccatgtgtccagaaaaaaaaaaa

SEQ ID NO: 218065 - DNA, 621 bp, Homo sapiens
atatctctgcattgatctcccaggtgatgcaactcttctctgtgctctgcctacaggggacactgtgacatatctctgcactgatcacccaggtgatgtaaatcttttctagtctctgcctacagagggcgttgtgacatcactctgcacggatcacccgggttatgtaactcttgtctaggctctgcctatgggggcattgtgacatctctgcactgattacccaggagaggtgacacttgtctaagctctgcctagagggacattgggacatatctctgcactgatcactgaggtgatgtaaaacttgtctaggctttgcctacagtgggatttatgaaatatctctgcactgatcacccaggtgatgtaactcttgtctaggctctacttaccgggcgtattgtgagatatctctgcactgaaaacccaggagatgaaactcttgtctagtctctgcctatgggggcaatttaacaaatcactgcactgatcaccgagatgatgtaactcttgtataggctttgccaacagggggcattgagatatatctctgcactgatcaccgaggtgatgcaactcttgtctgggatctgcttacagtggacattgtgacatatc

SEQ ID NO: 218066 - DNA, 339 bp, Homo sapiens
ggaacaatgcaactggaagactttagtcccctccctaggaataggatgtgtgttgatattcctagtgtgtgtctaaacatggtctgcatttagcttgagtgttgacattcatcgatccctaaatgtttcaaaagagggaagcattccagcctagcttttcagggaagcagagaatcaggtttttcaggactgggggcaggaaggcctcttaggacaatcaccacagcttcctaactcatgcccctacccccatcggctttgtctctcctttgtcctccacagacctgccatcataatatgatcttaccacctccctattcagaattcttcaccattagc

SEQ ID NO: 218067 - DNA, 603 bp, Homo sapiens
tggaaaaggtaagtaaattgggcacagaaccaagtcacagccactaactgcacagtcatgagaaatgaaaactatgggaaaaagagttttgaaatgctaattgaaaagcaagatacaaaagtataaaaaatgttttaaagagctataaatgtgccataatacaacaatgattaaatgcttatacccatagagaaaaatactggaaggaaatttcaccagtacaaccatggctgtgccaaaaaagcaaacatgagtgatttcctgttgctgttgtcctctcttctctcaatgttctatcacatagttattgttagaatacaaaaacaaaatggataaggcaaatttacgaaaggtatgttaatactaagtgtcaataatctgagtgtttgtacacacttatttagtaagcttgtaaaaaaaattcagtggttaaaaattcagtggttatttaacaaaaactttttcaaaatattaaattgatacaacactacaatgtatcataatttccttcttacttgcaacaaactcctggatgaacaaaatcttcctcaaatgtctagacaacgtatgtatgtattgcctacacaggaagacagttttgca

SEQ ID NO: 218068 - DNA, 486 bp, Homo sapiens
ttttcaaattattagaaaaacatattgcatatattaaattatattctttatatattttgtctgattctctattattagcagattctctattattattaatagatttttttaaaaagcccctgtaattaaatagaattaaataggattactctttattgtatcagataataatgaaatatcacagtacgtactgaagtcaaataattcatcaaaatgaacttgctgctgactttcatgtgtactctattgaacatatgaattacacttttatttactattatttttatcttccttctgcttttccattttgtttcagaatgttcttctaatcttcaggatctcctctcttgttgatttcattatcaatattttcttagctatcataattcttttaggtattgtcatgattttgatcatcaggcttaaaattttatttttcattgcaatataatgaaataaattttggacattttgaagcttttgtaa

SEQ ID NO: 218069 - DNA, 667 bp, Homo sapiens
tgaaatggagtctcgctctgtcacctaagctggagtgcagtgctgtcatctcggatcactgcaacctctgcctttcaggttcaagcgattctcgtgctttagcctcttgagtagctgggattacaggcatgcaccaccacacccagctaatttttgtatttttagtagacacagggtttcgccatgttggccaggctggtcttgaactcctgacctcagatgatccacctgcctcggcctcccagagtactagcattacaagtgtgagccactgtgcccagcctgttaaatacttttgtaggtaaatgccattactccccttttagcaaggtgaaagtaactttaaccttttaacaaggtgaaagtaacctgtccaaggtctatatttaacaaaagtcaaagctacttttgtttttatctttaaaagataaggactcagcctgggcatggtggctcacgcctgtaatcccagctacttgggaggctgaggcatgagaatcacttgaacccaggaggcggaggttgcagtgagccgagatcacactactgccctccagcctgggtgacagagtgagactctgtctcaaatatattattacttcactaactcaaactccgcctaaatcaatcctactgagcttagaagttcatcatgccccagacccct

SEQ ID NO: 218070 - DNA, 740 bp, Homo sapiens
aagtagcaggttgttgtatgtacgttcttactgataacccactggtcagtgtttttgcgttggtcttatattttggtaatttcaaaaatactcagtaatatgttgttattaatgcacagaagggatgcgtgtgtctaaatgcttagatttgcttgctttgtcttaggtttggtgtgtctttttaaacttgggaatctaggtatatgctcttaaaaagtacttcttggggaattagaaaagatttctaagataagacattgattttgttatcttagcagtgtaatcaaaacaaatattataacctcaggactaattcttaatgaactttgctgaaattgaaagttgttgctgacaacttaagagcatttcttctcatcgtcatcagccattatgaacgcccttgttttcttgctgtcagctgtttgagattgtcatgatgatgttaaattatgttcagtcttctgagtgttttgttgattaatttgtgttactactcttttattaggatttatgttgtctggtgtattgtagcatctgtatttctgtcaccattgaaaatcagttagaaaacatcagtaacttattttgttcacttggaaaagctttccaagttaacattcctctacaattatcatggttaacagaagtaatagaaagagcatggactttagaatcagaagatgttagactgtacaacacttttctgtgttcctgaagaaaaaaatagaataaagacaaaa

SEQ ID NO: 218071 - DNA, 501 bp, Homo sapiens
cgccactctcacaggcctctcctctccagaagcccctcccccagacaaaagcctagagggagagaggccggagtccccaggcctggcttgcagcctggctctgcccacgacccgctgcggagtcttgggcaagttctattctccctccgacccttgatcttggtttctttgaattgggagctgcggcaggtgaggggtctcttagagctctttccagaataccatggaagggaaaaatcctaacggctcaaagaagtttgctaagggtcaggaagcaggggatacacgggcctctcctacccgtgtaggaggcaggaagggtcaaagcagaggccagctctcccagactgtgggggaagggctgggggggggaggcccacgaggactggccacagccaccatgcaggaacgtcctggtgtggcctggcctggctctcacagacccaaggcttccgtgtagaatatgtctgtggttattaaacagacaggcctagtggaaac

SEQ ID NO: 218072 - DNA, 767 bp, Homo sapiens
cttgtaccactttaaatttgcttccacgcagaatagcagccaggcaaacagatgctccatcctaaggtgtaggaatttcttgtaggcggaaatgatttgttaggcgaaagcttccgaaacggttttccatttcacagtctcttccggtgccaaagtccagcaccaacgcctggttctggggtccgaccctcatgcagccgccgccgcgctcctcgtggctggacgagccggaactagcttcctccaggagctgctgctgctgctgccgtcactgggcgccgccgcacagccaaacggcgttcctccctctccgcttccctgagaactcgcggcccttctccaccaccaccagcatccgcggggaccgagaccggacgaaagtggcggggacccaaggcccctgaggagggggcgccgggcccgggagggggcgcgggacgggcatgggaccgggtgggcgcggcggcagcccactggcgccacttcgagctcgaggagacccagactgatagagcgcggaggcgtttccagaccgcagcgacaggcgtttccagaccgcagtgacaggcgtttcaagtccgcagcgcggagacaagcgcaattttggctttccacttcaccgcccacacttcactcggaactgtcttattttcacattgcttattgcaaatgtatagaaatactattcactcgtttttatttccacttccctctcccatcgggcagccattctaaggtgtttaacatgtaatttttgttctctttaa

SEQ ID NO: 218073 - DNA, 128 bp, Homo sapiens
tgtggattaccattattatggcacatacagtaattataaagacattgggataatagcagacaggcaaattctattctatatactttgcttaagaaattgtggtgggccggacactgtggctcatgcct

SEQ ID NO: 218074 - DNA, 550 bp, Homo sapiens
tgagaaagtgcctgtctggaatatggaatcgcaagccgctgcagaaatccaccaagcagcatctcctctatggaacaaaagccttaatctgtagggggaagaggcaacacactgaaagcacaaacctgaggacattgatggagacttgctgcagcttggtgaagagaacaagagaaaaaaagcttgacatctaagaaaggggcaagaacatttgctcggcccaacataattatggaagaaagaacaggaacatctgtgaaggccataccactaagaatcaagctaacaatgcctgcctaggaggtttaattggaacgtctgcctctgctacctatccaacaagtgttgactaaaaataatactgaaacacagtgggaatgctataagagacagattcactctggcaagcagtgcaagggaaagacacaaagccaagtataaaacacaaaaccaagcagaggtcaaactttaaatccagtacaatttctgactagattaacagaaagctccatgttgatggtctaactaaaggaaagttatgctcatcttc

SEQ ID NO: 218075 - DNA, 352 bp, Homo sapiens
aatctaatcccaacagtaaagatatacaaaatgaggcaaaagaaacaggaaaacttctgagcagtcagtggagttgtcataaagttcatgcgctaaaatgttttacttttataaaagtaaacaacaaaagaaaaatcattagggcttatagtctgatatttacttttagtttagaaacaaatgtttacagaagtaagatttcaaaagtaaaagtaaattttaaatgtgcaaagttttatcagattgtttttctggtttctagcatatccctcttccctgcaaggctaattagaatagagatagaggacatctgttggcaacagcaaaagtaataggcaaaagacagcaaaga

SEQ ID NO: 218076 - DNA, 581 bp, Homo sapiens
ttttattatggtacctgtattaatgtggatttatccaatatgtgatatggtggtatgattagatatacattaatggaggatttttttttcattgtacatattctacttggtttgatcatattataattctcacagctaatgtccatgtttctacagaggttcagcaattcaggatattattttcaaattaccaaaatgagataatttaactcccttttacttttgcattatttttagtggaaaaaaattaaatggtagtattataagaagctttatgctgtgtatgctagtcttattgtatatatgtactgaaagtacctttgacactgtacttaattggatttaatttcaaagaattgtaacaggaattatgtgagagaatagaaaatatatggaacttaattaagtgctgtccatatgtaaaggtaagattcatgactattgtttgatgtaacttatttattttacatcctgatactgttgtataatagcacaaaatgcatgtctatgaggaaaaacttgctttttctattttactttgagtttttatgtgtaataaaattatgcttaaaataggaaag

SEQ ID NO: 218077 - DNA, 668 bp, Homo sapiens
ggagattttatctgtgacacccaaggctcttaccttagaacttttatttgacctctcataagccttactagtatttggttaatgttcattatatttaggaactcagcaatttcaaagtccatggccacatattttattgtttgtgtgtgtgtgcaaagcctagtgttattgcaaatagccacatacttttaaaacaagtatattaatgtctacatttgtcatgctgggtttcaaacgcaaaggactcattaaaattagtcattaatcacttagtaatatatattaaatattaatgtttgtcatgaagtatgtaaaacaacccgtttgtattgtatcctctataatatgctcagggggtagaaaatacttgattttattgtctgtaatgtgtaatcagagattgaacgaccaagtaatgtagcattatccaaagattatttgttatatttcagttgtaatggagttaattgcatgcctttcagataaaaaaatactgtatgtacatccttaattcatctggtacaactatgtttaaaagtgcttaataaagtattcagtactatttaggtaataaaattagtagtgacttacttaattttatgtagcatcactttcttaagcctgtttttaaagtgatttattaccagacgggcaaaaaggcaattttt

SEQ ID NO: 218078 - DNA, 281 bp, Homo sapiens
agctctttatcccacttgtagggtcaggacagaggggatcagcagcaggagagctgcccacttagtgtggcagcagacctaggtgtgtccctgagctttacagatccagcgccgggttctgggcagagcaccttagttatgagcaggctctcaggtactcagtctccgctgtatttccgtgttgcgatattggtggaggggacgatggaggacccttactgacaattcccggaaacacttaacatatcttatttcaatttctaaattggtaagtaggattt

SEQ ID NO: 218079 - DNA, 458 bp, Homo sapiens
aaacctctccacttcttgtgtttcatgccaggtagtgtttgtaacttcagaacccgcccttaccttacctacctaccatgttatgctcatttcacctactgtcccctgctgtatagggagtgccttgagggcagagatcatgttagttttgttccctcttctgtacagagggtggagcccagtacctggcacagctgaaggaggaatgtgctgctgctgtctctgtatttccaggtactccttgttgacctctagccaagacaaggaacctccttatgagatgtcatcttctgagctctcttgatggagggaataccacggtgatgattgaatatgaaaagtcttggcacagtggctcacacctgtaatcccaacactttgggtggccgaggtgggaggattgcttgaagccaggcattgagaccatccttggccaccaaacgagaccccatctctac

SEQ ID NO: 218080 - DNA, 250 bp, Homo sapiens
aattctctgtcttctactcctctcaggactcctttattcaggcatctatacctcaaatcttctgcaccagtatgatgtgtgagattttaggtaaagctaacctaccatgaatagagtaaatgattgttcattgctgtattcacagtgcctgatacaggtctgacatatagtaggcacttaacaaatgtttgttcaattaatggatgaaagcaaaatgggaaaatcaattttaagttttgtgtctaacaaa

SEQ ID NO: 218081 - DNA, 385 bp, Homo sapiens
gtagaatgtgctctctcaccaggctatcttttcacgacatcctaaaatgagaattacgatggaactaagaaagtgtataaaagaacttcatgaatttctgtacacacacctaaacataaagtgtttcaatatgtttcacagtaagagaataatacaggccagattatacaatacttctgtgcacaccagatggttgtaaagaaagatcagcgagaaaggctttggaagttttaatccttctttccaccttttttcccccgcatttagtaaatcacaacctacctgactggcatccaattatcagagatattcagtgtttaagctaccctctttaaaagaaaatgatctcttcttattcctaaggtagaataaatgtgcacctgtg

SEQ ID NO: 218082 - DNA, 735 bp, Homo sapiens
ggtgtggtggtgcgcgcctgtagtcccagctactcaggaggctgaggtgggacaatcacttgagcctgggaggtctaggctgcagtgagccgagatcatgccactgcattccagcctaagcaacacaacgagaccctgtctcacacaaaacaaaacatggaagcaagcacggtggaatgatccccacccccactttttttttttccaaaagacagagcctatcacattacatccacatctgtgtggaatatggagaaaagcctggaggccacacacccaaatcccaagggcgcttctctctagctggtgatgtttcctaagcttttacactggctctgaggcagggccactacagcagtggcctcacaccttataatagttccttacagtgtttttaatcataaacagaaaagctaaacttttctaggaatacaacttctccctctgaaacccctggagactagaaagggtttatttttatgagctcccagtacctagaacagggctcggaatacagaggatttaaaaattaaatacttaaggccgggtgcggtggctcacgcctgtaatcccagcgctttgtaatgtggaggcgggcggatcacgaggtcaggagatcgagaccatcctggctaacacggtgaaaccctgtctatactaaaaataaaaaaaaattagccgggcgtggtgacaggcacctgtaatcccatctactcgggaggctgaggcaggaga

SEQ ID NO: 218083 - DNA, 501 bp, Homo sapiens
agagaaggaaataaagggcatccgaattggaaaagaggaggtgaaactattgctgtttgcagatgatatgatcatatacctagaaaatcctaaagactccaaaaaaagactcctagatttgataaaggaatttagcaaagtctcaggttacaaaatcagtgtacacaaatcagtagcactgctatacaccaacaatgactaagctgagagtcaaacaaagaactcaatcctggctggacatggtggttcacacctggaaaccaagcatttcaggaggcccaggcatgtggatttattgagcccaggagtttgagaccagcctgggcaacaagggagatcttgtctctacaaaaaagttacctgggtgtggtggtatgcatccatagtcccagtgactccggaggctgaggcagaaggatggcttgagactgggaggtcaaggctgcagtaattgcaccactgcactccagcctgggagacacagtgagactctgtcttaaa

SEQ ID NO: 218084 - DNA, 462 bp, Homo sapiens
gaggcagaggcttcagccccagtcaaaccctcagatgatggcagccccagccaacgtcatgacgcagcctctggagagaccctgagccagggccacccacccgaacttaccctggatcctgacccacagaaactgcaagtcgataaagcagcccacagggagcagaggttttcattaccatcattctcagaggacacgactggggctcagagaggggaagaaacctctccagcttgcacagctgagtcattccccaaatggatgagaccccagcacaggagaaatgcatgacagccagataataaacccgcatatcagaactgtcagatcgtcttcagagcaaaaggcaacatgctctcccgagaacccatgctcttaaccagtgcattgagctgcctattttctcacacctatagcaacatgaaattgacaaatattttgatcatagccaacttggtaagt

SEQ ID NO: 218085 - DNA, 500 bp, Homo sapiens
cacctagctttattctcaggaccgtccttcccgcggtctaacttcagtttctcctgcttcaactagagtcctctttttattcctctcacagggatatagtgaatggtcagtgcatttgcaggtggggtgatgatctattttggacactggtacaggagagggtcttgcaatataagaaacaagagctgttatgaaccaccaccttctgggtgcattgggcttatagactcagtaatttattttcttcctgatctgacatcctacatggggcagccctcccacaattattaccttattcgaagtatgaaccaacatgtccaccccacccccaacccccatcacgctttgcctcaggaagcgctgcatgctgggtatgtagcttctctcctttctactgttaactcacagccagggagtaggctgttaactgcagctggcagcttgtcctggtcttagcattgcttagccctgttggggaagctatctttggaacctgggga

SEQ ID NO: 218086 - DNA, 425 bp, Homo sapiens
ttctgcatgggggtgatagcagcctgtaccgcagtggtaacagtaggaatggtgagaggtgcctggaaacagcttgcttgtgaagaactgataggacttcctgatagatttgatgcaaagggttaaaaagacagggatcaagaataaaccaatttttttttaccggagcaactgagtaaactatgatgcctcttactgagataagaaacctttggtggggtgtggtggctcatacctgtaatcccagcactttgggaggccaaggcgagtggatctcttgaggtcaggagttcaagactatcctggccaatatggtgaaaccccatctctactaaaaatacaaaaattagccatcatggtggcaggtgcccgtaatcccagctactcaggaggctgaggcaggcagatcacttgaacctgagagg

SEQ ID NO: 218087 - DNA, 385 bp, Homo sapiens
caagaatgtgccgagccactcagctcttcctgagctttgttttgtaactaatggcatatgtttataatatagctgcccggggtaggatgtagtcataggcttggggagttttgagtagagatgggtgactcctatcagaggtgaacgtacctcctttctcactttgtttctgtgttcaagacatgctagtgttaatgtttccctatccggctatactgtcaattaattcatctgacatttttgttctgtaggcctctgctgcttgacactgaactatgtgctttgggtgattccgaaatgaacccttcttccatggcctggctttaaggagcctagtctgatatgggaactaagatagatgaacaaatagctccaacatctggca

SEQ ID NO: 218088 - DNA, 325 bp, Homo sapiens
  misc_feature (20)..(20): n is a, c, g, or t
tcactcggtccgcttggatncggctattggtgggtagggtgctaggagagggataacattaggagaaatacctaatgtagatgatgggttgaaggatgcagcaaaccactatggcatgtgtatacctatgtaacaaacctgcacattctgcatacatatcccagaactttaataaattaagtaaataaaaaagaaaaaaagaaaaaataagctaattatctgttttaatataattgttacattaccaaaataataattaattttgtttattattagtgatgtttgtagttgatatggagctttaaagagtaagtgcactttttgg

SEQ ID NO: 218089 - DNA, 715 bp, Homo sapiens
ctgcggggtgacacggggcttcgccttgggaaggggtcgagggaagcagttagacggctgccgggcggcggctgccgcgcggcacacaatatttatttaattgcccaactaccactgatgaagatatattggagtgactgctgaaattgcctttttgtttttaaccagaggacagtccatttgtttcacttctttttgctttccttactgctatgagctttactgaacggctgaaaaacttggaaaataaaatggacatgctgtagtcttgaacataatttttttaaggaaaacttaaagtgccagagtgaaagccagaatggcatccagagagaggctctttgaactttggatgctttattgtacaaagaaagatccagattacctgaagctgtggttggacacttttgtttctagctatgaacaatttttagacgttgactttgaaaagctgcctaccagggtagatgatatgcctccaggaatatctctgcttcctgataatattctgcaggttctgaggatccagcttctacagtgtgttcagaaaatggcagatgggttagaggaacaacagcaagccttgtcaattttgcttgtcaagttcttcattattctttgcagaaatctatcaaatgtggaagaaattgggacttgctcgtacattaattatgtcatcaccatgacaacactctatattcagcaattaaaaagc

SEQ ID NO: 218090 - DNA, 661 bp, Homo sapiens
ctgcggggtgacacggggcttcgccttgggaaggggtcgagggaagcagttagacggctgccgggcggcggctgccgcgcggcacacaatatttatttaattgcccaactaccactgatgaagatatattggagtgactgctgaaattgcctttttgtttttaaccagaggacagtccatttgtttcacttctttttgctttccttactgctatgagctttactgaacggctgaaaaacttggaaaataaaatggacatgctgtagtcttgaacataatttttttaaggaaaatttggatgctttattgtacaaagaaagatccagattacctgaagctgtggttggacacttttgtttctagctatgaacaatttttagacgttgactttgaaaagctgcctaccagggtagatgatatgcctccaggaatatctctgcttcctgataatattctgcaggttctgaggatccagcttctacagtgtgttcagaaaatggcagatgggttagaggaacaacagcaagccttgtcaattttgcttgtcaagttcttcattattctttgcagaaatctatcaaatgtggaagaaattgggacttgctcgtacattaattatgtcatcaccatgacaacactctatattcagcaattaaaaagc

SEQ ID NO: 218091 - DNA, 166 bp, Homo sapiens
ttccctttctgttgtagggtagatgatatgcctccaggaatatctctgcttcctgataatattctgcaggttctgaggatccagcttctacagtgtgttcagaaaatggcagatgggttagaggaacaacagcaagccttgtcaattttgcttgtcaagttcttca

SEQ ID NO: 218092 - DNA, 308 bp, Homo sapiens
ggtagatgatatgcctccaggaatatctctgcttcctgataatattctgcaggttctgaggatccagcttctacagtgtgttcagaaaatggcagatgggttagaggaacaacagcaagccttgtcaattttgcttgtcaagttcttcattattctttgcaggtatctagtagaaaaaataagctagttttcactcataggtgggagttgaacaatgagaacacatggagatgaggaggggaacatcacacactgggcctattggtgggtagggtgctaggagagggataacattaggagaaatacct

SEQ ID NO: 218093 - DNA, 416 bp, Homo sapiens
aatacatctaaattgttcagcacagtgccaagcatgaagaaaaatcacccttttgaccattgttattattagaagtgtgacatatatgctgtgtaatctacaggagggcacctgtctcttcacgtgagtgctattatccaaagagaggtagaaaagaattctgtctatatcatagagcaatgataagcaaagcaaccccagactgtagctaatatatattttggggcatcactctgtaggttctagtttgcttttcagtctgtcagttgggtggtagctactctccagcctggcatcaggcacccagcagagagggaccggcaatcaccaggctagtgcagcacgaatgtatattggtttatgaaagcagctacctcccacatgcaagagaagagtaaaagagaagaatagaagag

SEQ ID NO: 218094 - DNA, 442 bp, Homo sapiens
gaaaaagttaatttaactaaatgttaagcttgtagtaggaacggtgactatattaccatgtataattgctcacctatgttggaagttaaaaactaaactggaaaaaaggcagtatttttagtagaggaaagggatgaatataaaattatttatggtaagccaggcacagtggctcacgcctgtactcccaatgctttgggaggctgaggaaggccactcacttgaagtcaggagttcgagaccagcctggccaacatggtgaaaccttgtctctattaaaaatacaaaaattagccaggtgtgatggtatgcacctgtaatctcagctactcaggatgctgaggcaggagaattaattgcctgaacccaggaggtagaagttgcagtgagctgagatcatgtcactgcacttcagcctgggcaatagagtgagctccatctc

SEQ ID NO: 218095 - DNA, 1326 bp, Homo sapiens
tgtcttggcaatcctgtggaaaatcagtggccacagacgtatgaatttacttctgtattgtcaattctatttcattgatctatatgtctgtcttgttactggtacaacacagtcttgattactgtagcttcacagtacgttttgaaaatgagaaatgtgagttctccaattttgtttttatttttcaagattcttttggttgtttgtagtcccttgcatttctgtatgaattttaaaattagctcatcaatttctgcaaaaaaataaagaagccagctgatattttgataagggttatactaatctgtagatcagtttgggaagtgtcattatcttaactatttaagttttccaaatttatgaacacaggatgtcttcccatttatttaagtcgtctctaatttctttcaatgatattttgtagttttcaatgtagaattcttctgttgctaaagtatttcactctttttgatgctaaattaaatcgaactgtttttaaatttcatttttagattgttgcttgtgaaaaaatatgccatgatttttgtatattgatcttgtatcctgccaccttgctgaactgatttattagctccaagtgtttttgtgcattcctcaggattttctatgtttaaaaaatcatgccatcttgatggttttacttcttcctttccaatatagatgtcttttctttttctggcctaagcacccttgctagaacctccagtacaacgttgaatagaagtgatgagagtagatatctttgtcttattccttatcttagaagaaaactttttggtgtttcactattaagtatgttagctatttttcacagatgccctttataaggctgaggaaattcctttccattcttagtttattgagtggtttttatcatgaaagtgagtcaaatcgtttttctgtgtctattttcttgtgccctttattcattaaatatggtgctcatgttaatttttctatgttgaaccaacattacatttttgggctaaatatgactttgccatggtataattccttttattagttgctggattcagtttgctagcattttattgaggatttttgcatatatattcacaatggatattggtctgtagttttcttttattgtgatgtccttttttggttttggtatcagagtaggcctggcctcacagaatgagttggggagtgctccatcttcttttattttttggaagagcttgtgaaggattggcattaattcttcattaaccctttggtagcgttcaccagtgaagtcatctggtcctcaacttttctctgtgggattatatcaataactag

SEQ ID NO: 218096 - DNA, 462 bp, Homo sapiens
gttctcagtggaatttttctttaataaaaagcagcccctaaaacatttctaacaaaaagcaccctgagaaatcaagctgcaaacatagataagcaagctagaagtttgcataggtaaatgccggcagctatgtcagaagccaggtacattcaacatggaggatatctcctctcttctctttgtcgcccccgtgtgtgggtgtcatggcaacggccaggtaaaccccatttgcataataaaagattcacgggctatgtaaatggcacacctgacacctggtcaatccaatctcctgggccctatgtgaatcaaatacggcctccttaagcccctctataaaatggaccacatctctccccaaacccagaaatccgcttgaacatccccttcctctgcatgaggaagcgcgctctctctctccctcctttcttttgcctattaaactttacgctcttaaaccca

SEQ ID NO: 218097 - DNA, 212 bp, Homo sapiens
gcatgatctcacgtatatgaaatccccagagggctggggagctacattcattcatttattcaaaatatatttattctaaatgcaacacagtatcctggattgtatgtgtatactggaatagaaaaagaacatcagtgggaaaactggtaaaatccaaaaaataagccaataaaggagataaaatgagacaatcggcaatacttatttaatac

SEQ ID NO: 218098 - DNA, 580 bp, Homo sapiens
agaggcttttacctcacatatgaagcctcttcctgtttattgcagattgcagcttgttctggtgaaaggagccagaattgctagcgcttctaagttcattcgcctgttgggaagaataattttattttgagctaccaaacaaaataactgtgaacctactgatgatgagatcaggccagcttttaacctacaggattctgttggtgtcttttcattctgggctttcattgtattcactattaaatggtttggatacaaaaattacctggagagacctaagatttgtttttgatggtgaatgttggaccaggctgctgaagcggagtgtgcagctgaacatgtgggacaccagtgtccattctgcattgatgctcagactcctctttaaaacactccgcccacatttatgtagctgttaaattacaaataatactctcctcctttaagcagcataaagatggtgttgcaggctgggcatggtggctcatgcctgttttctcagcactttaggaggctgagatgggaggatcacttgctcaggagtttgagactggcctgggcaacacagtgagacttctgt

SEQ ID NO: 218099 - DNA, 321 bp, Homo sapiens
tctttcataaccacccccaatcccctgtccttatctcatttcacttctaagcttccaggcccagctcctccaggcctaccacgtgatcttagagaagccttcccccaccccatctccagttaattacttcccctctctgtaccttggtttcctcatgggcatatttaggagttgggttagatccatggtttgcagactgtgtgcccaggagccctggggtgttcaggaggaggaaggttagaggaatgccaaggcatagggctttgagaggcattattttatctgttttagatattgtgctttggcttaagatgtcatctg

SEQ ID NO: 218100 - DNA, 429 bp, Homo sapiens
ttataaatttaagggataataacagtgcaaaaatgtagcatatgaactctgtatttaaaaagtgtccatttatcttctgcatgattttattttcttatttttaggcaaattgtattttctataaatttaataaacagtacctatgtgccattatgtttacacatgatagtaagtattcgtgaatgtggctaatgagttcttcccaaagactaagcattcattaatagtaaatctcttttccccatgagttatattttatgtgaacatttaccaaacatccaaataactggatttctcttctagaggttttacagtttcgggacttacatttaaatctttactccattttgagtttacacttatatgagataatggtccaatttcattattctgcatttggatagtcagttttctcaatggcatttatta

SEQ ID NO: 218101 - DNA, 737 bp, Homo sapiens
ggagagccttagaatttatctatcctgtttatgtttaagatgaatcttcctaagaaccacacagcttatccagcacattgttgaagtaaaatgaaataactctaactcaaattttctaatctctaaccatgtgtttttttaatcactctataattcagtgtactgaatgatttgtttgtgttgccataagccttttgcaactatctttacattaaaagttatgacatatgcattgaaataaaagtttaaatattttagattggatgattaataaatactttaaaaagtaaaaaatataatttttaaaatgtatcataataaatataacacgaccttatatcccaaaatgactcatgtgattttaaataaatctattaacaaattcaagatgcaagaaatatcagatcaaccggaacaacacttattataaaggaaaccagacaccaaatcaaataaccaaagttatagcactgcctactcagcaaaacaaaaattgcagcacaagtgctgatagcagtaagcctaacaggttatctgagttcatgtggtaaacaaagtattcattcatgttgtgaataaatttgggcactcaatattccacacaacggagtaatctagaaaagaatcaggttcacctttacctttttcttttgttctctctcatttttaattttgtaaagcaccttaaggatacttaacagaaatctctaagaaacaaacaacgtgcaaaacaatag

SEQ ID NO: 218102 - DNA, 566 bp, Homo sapiens
tttatggatcctcaagacagttttagcctccagctaacgcatcagtgtcactaaaccagaggtcaaaaatcagtggtccgtgggctgcacctagtcccacaaatgtgcctttttggcccacattttttctgtgaattggcatttttttaatgcaaatgttttatattaaattccagatttctggcttcctttggaaacctgaaaagtctgacattggattcacatggcagcagtcagtcagagccacacgcctggcccagaaactacttttaacttgtttttagtagccaaaacatgggagcttcatgctgagaaaggcattcttgttcagttaaaagggccaaaataattctcttttatatgaaaaatatttatagatttttttaaacaaattgcacatattatcaccaaatataaagaagaaaaatgtgctgtaactgctacaccttaacagagtgtttctgtactctgttctcccctgcaacttttgcagcctgtgcatgcgtgtgctctttgtaggtgtagcaatactataggagcagttgcaaatctagttttaccaatta

SEQ ID NO: 218103 - DNA, 3349 bp, Homo sapiens
gcctgcgggggcggaaacgctttgtctgtccggcaagccgacggcccgctgctggcctccgtgacgcggcctcctccgcgcctcgcggcatggcgtcggaggggccgcgggagcccgaaagcgagggcatcaagttatcagcagatgtcaaaccatttgtccccagatttgccgggctcaatgtggcatggttagagtcctcagaagcatgtgtcttccccagctctgcagccacatactatccgtttgttcaggaaccaccagtgacagagaatgtttactcagtgcctggctcccagtatctttataaccaacccagttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggttatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattatt

SEQ ID NO: 218104 - DNA, 3469 bp, Homo sapiens
gcctgcgggggcggaaacgctttgtctgtccggcaagccgacggcccgctgctggcctccgtgacgcggcctcctccgcgcctcgcggcatggcgtcggaggggccgcgggagcccgaaagcgagggcatcaagttatcagcagatgtcaaaccatttgtccccagatttgccgggctcaatgtggcatggttagagtcctcagaagcatgtgtcttccccagctctgcagccacatactatccgtttgttcaggaaccaccagtgacagagcagaaaatatatactgaagacatggcctttggagcttcaacttttccacctcagtatttatcttctgagataactcttcatccatatgcctattctccttatacccttgactccacacagaatgtttactcagtgcctggctcccagtatctttataaccaacccagttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggttatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattatt

SEQ ID NO: 218105 - DNA, 995 bp, Homo sapiens
gcctgcgggggcggaaacgctttgtctgtccggcaagccgacggcccgctgctggcctccgtgacgcggcctcctccgcgcctcgcggcatggcgtcggaggggccgcgggagcccgaaagcgagggcatcaagttatcagcagatgtcaaaccatttgtccccagatttgccgggctcaatgtggcatggttagagtcctcagaagcatgtgtcttccccagctctgcagccacatactatccgtttgttcaggaaccaccagtgacagagaatgtttactcagtgcctggctcccagtatctttataaccaacccagttgttaccgaggttttcaaacagtgaagcatcgaaatgagaacacatgccctctcccacaagaaatgaaagctctgtttaagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaat

SEQ ID NO: 218106 - DNA, 3220 bp, Homo sapiens
gcctgcgggggcggaaacgctttgtctgtccggcaagccgacggcccgctgctggcctccgtgacgcggcctcctccgcgcctcgcggcatggcgtcggaggggccgcgggagcccgaaagcgagggcatcaagttatcagcagatgtcaaaccatttgtccccagatttgccgggctcaatgtggcatggttagagtcctcagaagcatgtgtcttccccagctctgcagccacatactatccgtttgttcaggaaccaccagtgacagagaagaaaacctatgatgagaaaaaaacgtatgatcagcaaaagtttgacagtgaaagggctgatggaactatatcatctgagataaaatcagctagaggttcacatcatttgtccatttacgctgagaatagtttgaaatcagatggttaccataagcgaacagacaggaaatccagaatcattgcaaaaaatgtatctacctccaaacctgagtttgaatttaccacactggactttcctgaactgcaaggtgcagagaacaatatgtcagagatacagaagcaacccaagtggggacctgtccactctgtctctaccgacatttctcttctaagagaagtagtaaaaccagctgcagtgttatcaaagggtgaaatagtggtgaaaaataacccaaatgaatctgtaactgctaatgccgctaccaattctccttcatgtacaagagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagcctcaagaaagaataagaaaaagaaagaaaaatctacatcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggttatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattatt

SEQ ID NO: 218107 - DNA, 563 bp, Homo sapiens
acattaccgtatctaaggaatttaacttatctgctatctaataatcaaaatttatgctacaacaccgcttcaagttgcacttcactgcatcacttgtactgtttctgtcccatggttgctccacttaattcatcccataccacttataaggtaattacgtgtatctgtgcatctcacaaaatacgcacatactctgttgtcagtacactgacttcacattatgatcctattttcttcatatggccatttaaataaaactggcttatccaacatcaccttcttcagaacaacaaattaatatctgcctcataccaaacagggtagcgaaacttccacctaccatctattgtttgataaggcaatgccaatgtcaaccaaaccaataataatcctaaatggcagatggaaatccttaacaaggaatcctgatactcaatctctatgcacatcactacatatccttaagaaaaggactccatggtgtgcatacaaagatttcctcatcacaggctgaaaagcaacctagaacaggtattctggaaccgagcccaggggaggcggat

SEQ ID NO: 218108 - DNA, 863 bp, Homo sapiens
gggaagtgtgcacagtaaacacaacaaggacaatggcatcacagggcgatggcatcagtccaagagtaccttgggaagagcaattctgtggatgaaccgcagtgcaggtgcacaggcttctaatggtctcgcctggcagacctagcgtcaccccagctagcctgaccataagactcacctgaacagttcattaaatacacaggttcctgaaggttatggtgaacttgcaactggtaggaaatgtccatatggaagagcccagaatcatagtccacacacaaagctgatccctccctaccctccaccaggccctgtactccccagttcatagaggccagaaatctatgttgttaacaagaatccctggcaagtctcattgggcaaggttagggaatactggcttagtgaagaatgatggcttgcacatctatagtgaagtattacaaaaacctcgcactgtactgtctcccaatcaaaccagccaaactctccactctggccagatggttctcaactcgactgcacatggaataacctaaggagctttaaaaacactgacgctaaacacacagatcaatggaagagaattgagagtcaagaaataaaccacacagttatggctaatttcctcaatgaggaaagcataatcattgcaacaaatgatgctggaacaactggatatccacaggtgaaagaatgaagctgggccctttcctcacatcacacacaaaacttaaccaaaagagatcaaagtcatagctggtagagctaaaactataaagttcactaaagaaaatacaggagtaaatattcattaccttgggctaggcaacggtttcttaaccatttcttaaatacaacac

SEQ ID NO: 218109 - DNA, 696 bp, Homo sapiens
agcccctggcgctgctggtttgaggaccacactgagcagggaggccctgggatgttgggatgggtgtgctgtgcccgctaccatacgccaactggattgaaggaacagaacagtacaggcggttccatcttcctgggaagacagggagttacagatcgttttaagggaatcccaggactctagaagtctccttcatgggtttctctttctgcacctttcctgtgaatggtgtatccacccgggtcccctcctgcctctttgcacactctctgtggtgtaacttgcacccagggcttcagcaaccatctatgcactgagacctttctgttcttggggtggcattcctcgggatttagtgccaggacacacctgtgtgcgcattcactgggaaaagtctgcagaatctacaccaggccttcctggagggcgtgttcctccatctacattcgtgatggaacaaccagttattgtcgccgggacaccagtgcctcatgcacaccatcagccacgggagttttactgttacaagcttgtcctcttaggcacattccctcatcctgaacctgctggcagcagctcctttaggggagcgagggtggctgcttgtcccttccgtccttgggcagccagcgctcagctggatgcatgcagtggaagtcaccttctgcctccactcctgagcaggatgtgctctcc

SEQ ID NO: 218110 - DNA, 521 bp, Homo sapiens
ttgattttggagcatagtgttaataaaggttagtctcttcagatatgagccagttgacttggctatataaatagctgttgtcacgggcaggtcagaggtatgtgtgtggatagactggatctgtaaccaccaatcagaaatcaatcagcaatcatttactgagcatttgctatgtgcctggcactatactaggagtggagctttgaaagattttttaaaaatacatgagctataggctaggtacagtggcttatatctgtaatctcggcacttcgagagaccatgggtggatcatttaaggctaggagtttgagaccagcctgggcaacatggcgaaaccccatctctacaaaaaatacaaaaattagccagaagtggtggcacacacctgtagtccagctacttgggaggataaagtgggaaaaatcacctgaacccgggagtcagggctgcagtgagccatgatcgtgccactgcactccaggctgggtgacagagcaaaactctgtctcaaaaaaaaa

SEQ ID NO: 218111 - DNA, 565 bp, Homo sapiens
gcgtggtcgcggccgaggtacatatcgttttcttctgcttttgaagaactacccctaagacacaaacatgattggtttcataggaaaggttaagtggtttgcctgaaatacacgtcatgtaaactcctagggtcaagaagagaaaaaaaaggaaaaagataaaccaaaacgagtgagagagagaaaaaggagaaagaggaagaaggatgaaggagaaggagaagaaagggaagaagagaaaaaagaagatgaaagcaaaaaaagtcctttactaggaatataattatttcttttttctttcagccacacaaaagtgtaaaactaaaatgatctttaagatctacagtgagttcttccaatttccctttccttaaaacaggccttcacataggagccacatatcttctatggctggaagaccttatggtaatgaaaaagggaggagggagtttcctctgaatcacaggtgcttttcattttcaatacctaaagtaggacactccaatctatgcttgtcactggtgcttttcaaatgaggtgacaactgtcttgctgacttctatac

SEQ ID NO: 218112 - DNA, 437 bp, Homo sapiens
caagatgaatgcaggaaagaagggcttgatcagctctaagaatgcagcaggcaggagacaggacacagctcatgaactggaaaacacctggtctgaagggagccctcctcattcggggataagtaactcaaacgagaaacaaccacagtaccgaggggccggaaaaacaaccccacagtctaaggcagctggaagtctgccccgtggattcggagaaaaggtatgctgtatggaagagtttattaaaggcagccggagagaattttggaaatgatatgcattttgccttgatgtaaaatgtaagaaaatatgccctctttgaaacaagattgtacaaatctgcaggctgagtagaaaggaaagtctttgaagtaagaggagcaaggaaagtgctgatgtatgagcagaattaaaatgtgcatgaaaaggctaggcgc

SEQ ID NO: 218113 - DNA, 496 bp, Homo sapiens
ctctccttgtaagaatctgcattagccaattctgattaattttcctaaagtcgtgtcacaaaatgcaagagtcaacatttcaggacagacaaccccgttgaggattctcaggggaagtgtaaactcagcagggagttcttcaagaggaaatttaggcaaagagttcaggctttgggttcaaactgccttctttttttaaattttattattattatactttaagttttagggtacatgtgcacaacatgcaggtttgttacatatgtatacatgtgccatgcttgtatgctgcacccattcattcaaactgccttcttgcacagccagctctgcctaccctctgggtgaccctgggaacctaacccctatgcacctcagtccctgcctctgtagaatggagatcacaacagccctacctcacagggcttggaggatgtaggagatgatgcttcacaccatgtacacagcaagtgcttaataaatgttggcaaccatc

SEQ ID NO: 218114 - DNA, 455 bp, Homo sapiens
tgtctgctgagatcgccctccagtgtgaacgcctcagcatctatggtggaggaaaatgagctgagccacagggctgctaagtaaaattttacttggaatttctttaagcctttctgcatcaatgggatctcacacttaatcacaagtgaagttctttagattttaatttgtatgaaaagaaataccacgtcacactattcaaattaatactcaggctattcgaaatcatctcatcctgccacatctctctttaagggtatgtaggataccatgacctcggctgtcattcatgtttcccccacaaattatttttaaggtggaagagactgcactagcttcctcacagcaccttaagatttcaagagatcggctgggcgtggtggctcacgcctgtaatcccagcactttgggaggccgggagctggtggataacctgaggtcgggagttcaagacc

SEQ ID NO: 218115 - DNA, 370 bp, Homo sapiens
tggacaaggcagcaaatggtattaaggatacttttggtaagagaatagtttttatcagagcaggctgcaggtagaatatttctcaattactatttacagctgagtaactgttttcctatggacataaaaatatacactctgcaaatgattttttaatgaaaaatgacagcctattttctgcaacttggttttttacataataatcatggacatacatctaagattgcatatgtagatctcctgttttgatgatcacctagaattctgttttgtggttgtgcctttaattgaccaatgtcttgctatttactgtaaatggtgcaagagtgaacatcttgaaaagggcggcagagtggtcttagcaaaaaaa

SEQ ID NO: 218116 - DNA, 561 bp, Homo sapiens
aggatggtctcgatctcctgacctcgtgatctgcccgcctcggctcccaaagtgctgagattacaggtgtgagccactgagcccggcccagttgtcctcatcttaacccattacttctgcaaagaccctatttccaaacaagttctaaagtactgggagttggtacttcaccatatggtttttggaagggacacagctcaccctgggccgcggatgctggctcctgttagaggactgtgctttacaggcagcgcctgtgcccctgtgagaactctcgctgcaatctttgctttctcacttttacagaccaacaagccctaccacagaccaggctgggccttggctctggccacttcgtgtcgcgtgcctgctgactggcgcttgtctcctgtgttgccagcctgcttgttagagctcagaggcagggaccttgcccccacatctcctgaatctcccacctcgggcagcctggcaaggccatagagatatgaacagcctgcccttccagctcctggggtacagcccgatgctgttgacattgcctccacctcccttccttgt

SEQ ID NO: 218117 - DNA, 518 bp, Homo sapiens
gcactggccacacctgataaaccaacctatataattagtatgggttggagtgcttatgaagctcacctagcaccaagtagtgctatctacatcaccttagcactttgggaggccgtagtgtcaggcatatcgcctgagtgtcaaggagttcaaagccagcctgtgggcaactgccttgagaaaagggaaacttagatggaaaaattaaaacttgaacttctgggggaacttactttgttttttaatctttgtatgactttctcccataagcctacccatttcccgaagtgatttgagatggattgttttcatccaggccagtcttggaatagggatgcccagcagggcccagggtctggcaccctctccttggccttaaggccagatacctggggtaagtgttgagtccaggccagaggtaggggtgaggtagggggagaagggatggtaacacctgctggtgctaaaggctctcatctactggccccatagagtttgtgtgtctgtttgcacacatg

SEQ ID NO: 218118 - DNA, 297 bp, Homo sapiens
ctggggacttgaacagtgccttcctattctttaaaaaaatatcctcttaagacatttaacgtggagccaccagcacacaaccaaagaaaatggtcttcaggttgagatatggccaagtgaagcaatttgtgggagaggaagagacccaaccattagcacaaattattctgtcattcaggaaggaagctgtggaggcttccttatttctcatttgtctgggtttaagtatcagtctactaaatgctcgtggagtgaaaccctgtctgtttttgattcttggtatgaatatagataatg

SEQ ID NO: 218119 - DNA, 396 bp, Homo sapiens
gcagagactgcagtgagccgagatcatgccactgtactccagcctgggtgacagggaccctgtcaccaaaggaaaaaaaaaaaagggtctgtgttttggagtaagggagcatcaggcattaggctggaatcccatctctacaacttcctaggtatgtaaccctgggcaggtttctcaacctctctgacccccagtttcatcaattgggattttttgccgaccaggtgtggtggctcacgcctgtaatcccagcatttttggaggctgaggtgggaggattgcttgagcctaggagtttgagaccagcctgggcaacatggtgaaaccctgtctctacaaaaaaatacaaaaaattagctctagcctaggcgacagtgagactttgtctcaaaaaaa

SEQ ID NO: 218120 - DNA, 336 bp, Homo sapiens
agcaggctgcccccatccacctgctcacatgccacctggggcatgtttcccattagattctaacctcctgtgcttgtcagagcctaacctctgagagtctacctcctaagccagttcctggcctggtagggcagaaaggaaaggaagtcaaggagtggccatatctgagtggggctgaccggggaaggcggtctgcgagagtggcgggggcggggcggggggtgctgctgaattgtgcctggtggacttgctgggaggggatgagctccaggttctgacctcttggccatgtagcctcagggaaatgcaaactgaaaattttccctggtttcaagc

SEQ ID NO: 218121 - DNA, 347 bp, Homo sapiens
tttgagcggccgcccgggcaggtacgcggggaatggagtggaatggaaggcaatggaatggaatcatccggaattgaatggaatggaatggaatagaatggaatcaactcgattgaaatggaatggaatggaatggaatggaatggagtggatgggaatggaatgatggaatgtaatgaacccgagtgcaggggaatggaatggaatggaatgcaatggaatggagtcatcctgaatggaacggaatggaatggaatggaatcaacccgtgtgcaatataatggaatcgaaaggaatggaatggaatggaatggattcaacccaaatggaatgaaaaggaatggaat

SEQ ID NO: 218122 - DNA, 245 bp, Homo sapiens
ctttcccctagttgatctcaacagaaaaaaaagaaacgaaacaaacaaccaacgcctgtcattcccagactgtgcctctcttctgtggcagtaagtggagaacctggcctttaagcaaaaccttttacctctctttattaaatgataggattgatgataaaaatcaatttttgagactcgagtgtgtgacagtaatggagtcgttaatgtttgaaatggtacatgtcaagacagatgagatatac

SEQ ID NO: 218123 - DNA, 263 bp, Homo sapiens
aaaccagctgttttgtgaccatttgtgcttagaggtcgtgccagcccatggcaaagacactgtgtactgtatttatttattctgttagtggaaaaaaacaagacttaattcacccctgcctgtcccctcgcctgccccctgtgtagtgctgcatgacactctgtgtatctgtccttctgtcagtctcattccctgtgatgttgtgacctgttctttgtcttacttggcgaataaaagagaacccagcagcccagacctcagtc

SEQ ID NO: 218124 - DNA, 517 bp, Homo sapiens
taaatacctttcagtaatagtttttcattttctccattaaaaggaaatttatgattttatagtatttatgctagtataattttgtttttccccctaaaatgtcgcagtttattttgtgtctagcaatcttattaaacccccttattaatgatgttcccttgtctatatgatcacaattatttcttactttctagtccttatacttcttgtttaatttttttcactggctatgatatgtagcacatggttaaattgaagtattattggtgtacatccttgtcttttttctaatctttaatatttttaagtttcactagtaagtaagatctttgttgtaggtttttgtttttgacatctcctttcctcaccctcacacttgtgaatctcatgttctgttctgaggaaaagaaatgaataggaaaataaatacttgtgtatctagatcctatcactgtgcgtggtacattgtggctctcagtttgttgtgtgaatgaataaatatagcagaactacttga

SEQ ID NO: 218125 - DNA, 830 bp, Homo sapiens
gaggtggaaggagccctggacagagtcccagctgtagccctgactcgctgtgtggccttagcaagctacttgccctctctgggcctctgacttcatttgcaagaagaaaagatgaaatgtgccaggcatggtggcttacgcctgtaatcccagcaccctgcaggcggatcacttgaggtcaggagttcgagaccagcctgaccaacatgataaaaccccatctctactaaaaatacaaaaattagccgggcacgctggcatgtgcctgtaatcccagctactcgggaggctgagccaggagaatcacttgaaacagggaggtggaggttgcagtgagccaagattgtgccactgcactccagtgtgggtgacagagtgagactcttgtctcaaaaaagaaaagaaaagaaaagatggaatgaatgattgctaagggccttgaatctgtgactttaacatcctggggccctgacaccctgttccacctcaggctcttatgacacctggttcacgggcacaattgacctggattcaattcccgtttctgatacctgtccactgcttgacattgggcgggtggccttgcttttttaagctgcaatgttcttatctgtgaaacaggaataaggatagtgccctcccaggatcattaggaagaatgaatgtctgcgcattataaaatgcccggcccagggctggcacacagcaagtgcttggtagatgtgaatcctccccttccccgacgtgtcccggacccatcagttgtagagttgctttgctgtctatatatggtcaagaatgtgtagaaggaaataattctggtaacctgg

SEQ ID NO: 218126 - DNA, 354 bp, Homo sapiens
tatgtagcatttaaatttttaaaaaatactgtttattttctggccacaagtgaaattcagcagtagctgaacaagacagatatgccaggcatggtggctcacacttgttatcccagcactttgggaggctgaggcaggtggattgcttgagcttaggagttcaagaccaagctgggcagcatggcaaaaccccgtctctacaaaaactacaaaaattagcacatacctgtagtctcagctgtgaggctgaggtgggaggattgtttgaaacccaggttgaggctgcaatgagcgatgatcacaccactgcagtccagcctgggcaacagagagagactctgtctcaaaaaaaag

SEQ ID NO: 218127 - DNA, 425 bp, Homo sapiens
agttggcttcttttggaaaccaaaactcactaacttgagcccctaaactcaccccacctccttattttttcctttaaaatacctttttccccacttcctacagtcactagtcttaggtccccttgtaaccattgcaggcagctgctgttcgaaattttaaaaatgaaatttgggccgggtgcggtggctcatgcctgtaatcccagcactttgggaggccaaagagggcagattgcttgagcctagaagttcaagaccagcctgggcaacatggtgaaaccctatctctacaaaaagtacaaaaattagcctgtagtcacagctactcaggaggctgatgtgggaggatcacttgagtccaggaggtcaaggcttcagtgagctgtgatcatgcctgagtgacacagcaagagcctgcctcaaaa

SEQ ID NO: 218128 - DNA, 819 bp, Homo sapiens
tgcctaggtcttatacaatatgttaattgcctttacaaagatgcataaatttgaagacatagaaactgtcgacattttggctggatgtgcccgattcatcgttgtggggcttggaggggtattgtttggcatcgtttttggatttatttctgcatttatcacacgtttcactcagaatatctctgcaattgagccactcatcgtcttcatgttcagctatttgtcttacttagctgctgaaaccctctatctctccggcatcctggcaatcacagcctgcgcagtaacaatgaaaaagtacgtggaagaaaacgtgtcccagacatcatacacgaccatcaagtacttcatgaagatgctgagcagcgtcagcgagaccttgatcttcatcttcatgggtgtgtccactgtgggcaagaatcacgagtggaactgggccttcatctgcttcaccctggccttctgccaaatctggagagccatcagtaagagacggcagggctccagagtctccggtcctgctgcattttcagttctcttattcccttccgcaatgttaaaactggaggactgagtagatgctaactggttttaccggttagggtagactaggaacctggtcgtgagcaggaatcttttctgtttgttccctcagtcagctcaaagtaattagtggttgataaggttctgcattgaagcaaggctggggcaaggagtacttttttttaattgaagaaagaagtttcacatctacctatttaaatataattcagtcaatggaaaaatacatgtttgttactttttatttggagttgcacc

SEQ ID NO: 218129 - DNA, 484 bp, Homo sapiens
agaaagagtattattttagacataactggaaaacaaatctcctgggcaaatcaaagagaaaattgtttctaatatagtaaccaggttttagttagattcaagttaatgcattcaggacaaaattcaaaccatattttgtttacttattcctacatgttgacatagagtaagaattgggtcttttcagttccttttgcaatccaaaagtaaatgaaatctcaataacattaacatatatatccactatacaccagatatttttctaagcattttgcgtatgttgactcattttatcaccccaacaaccctatgaggtgggcagtcttattagccacattttaaagacgaagaattgtggcacacagagtttaaataatctgtccaaagtcatacagcatgtgaaacggcagagccaggatttaaactgttactatgtgactccagaaaccattcttttctatacctaagcagagctggagaggtg

SEQ ID NO: 218130 - DNA, 355 bp, Homo sapiens
aaagtatcaatagtgccaaggctgagaaactgtgatccacaataaggcagtgagtagagatcaatggaacagaatagacaatccaggtatgaatccacatgtatattactgatttttgacaaatatgccagtgtatatcaatgagggaaagaaaagtcttttcagccagtgaggcacaatagctatccaaatggaaaatatagataaatcttgctcccaaactcaaatagcatcaatgaactcaaatggaatcacaggcctaaatataaaagctgaggctatagaacttgaaaaataaggtaggaagaaatgttcacaatcttatggtaggcaaagatttcttagatagcataca

SEQ ID NO: 218131 - DNA, 309 bp, Homo sapiens
gaaggccaaaaaggaggattacgggctgctctgcctatggagtaatcattcttttattcctttactttcttaataaacttgttttcactttaaaaagaaaaaaaatggattacgggacaggttttgactatccagcaactgtcataataaatttttaataaggagataacacactcctctttttatcttcaaataaaatgtaaaagctgataactaatattcataatacttaacatctaaggaaacaaaaaagttaaaatttttctttttttttttctttttttttgagacagagtctcgctctgtcac

SEQ ID NO: 218132 - DNA, 413 bp, Homo sapiens
tagctacttcagttattgatttctaatttaagcttattgtgatcagagaacaaacctgtgtactttcaacccttttaaattctatggcttaaattctaaacttattttatggctcactatatggtttatcttggtgagcttctcatgtccccctgaagattatgtgccctcttcagttgttgggtgtagtattctataaatatcaattagttcaagttggttgataggctttttgaaaattttatattcattttttcttcctttttctgttgagctaatacaaaggattagattgcagatcaaacattcacatatcagataacctacatactgccgagatttatcattaatttcaaggatacagcaggcaatcaagaggctcaaacaaagcaaggagagacattgattgtggc

SEQ ID NO: 218133 - DNA, 455 bp, Homo sapiens
aggggcaaagccggttgacacagctggtagagaaagagaagtagaagaaatgctacagaacaagagaagttgcagcgtcagctggatgagccataactagaacgacggcctcgggagagacacccaagctggcaaagtgaagaaactcaagaatggaacggtcgcggacaggaagtgagtcatcgcagactgagacctccgccatacccagcagaaatgcacgaaggagagagagtgagaagtctctagaaaatgaaacactcaataaggaggaagattgtcactctccaacttctaaacgtctcaaacctgatcctaccagacccaaaggtaatgccagcccctccaccaaaggagaatgcttcggtgaagtgaagttctaacgctcctgctccatctcagagctcagacacagagcagcaatcccctacaagtggtgggggaaaagtagctcc

SEQ ID NO: 218134 - DNA, 138 bp, Homo sapiens
attacaggtgtgagcagcgcgcctggcctccttgaggttttatccccactgtttcctccactcaccctgtgctagaaccagatggaacaactccatccacaatccacttgtctacaataaagctttccttaccatgtc

SEQ ID NO: 218135 - DNA, 1091 bp, Homo sapiens
ggaagtctatgtattgattacatatttgaaagtgacaggcctgttgtgtatgggcagagggttccgggttaaatctcaaaaataataatagcaggggctagtagtaatacattctgaaaaaccagcgtatcaaaaagagagggaatactcccctctcttagatctgctcccctgggtgctgattgtaagtagctttgtatgttttattttagaaaatacatatagaaacacaatattttaaaaaaatagaattgtattcttcttattctgcaacttgttacttgtatttaatagtgtgtcttgggcctcttccttgatcttcattatattttataatggtcttaggattttattgttgaccatcatgcgtgactgcctttcccatatcaatgaaagtttagattatatataacttttgtcttaaaaaaaccaatgttttgaggattgaacatcctggttcgtgtatcttggtacacttattctaagtatttctatagtatgaaatatttgaatttggactgctgattatgaggcctgcatattttagaatttgttaaaactgagaaattataatgatgagagtgtccatttctctgcaactccaccaacatcgttatcaagcttttaattttttctgataggtaaaaacaattcattttattgtatcaattctttgtcagtggagttttgcagcttttcatgtgtttgtttactatgtttctttttgacctttaaaagttgttttgtgggtttttgttgttgttgttgttgttttgttttgttttgttttttttgtctcgctgctgtgtatgcagtggcacaatctcggctcactgcaacctctgcctccggggttcaagcaattctcctgccccagcctctggagtagctgggataacaggcacccgtctctactaaaaatacaaaaaattagctgggcatcgtggtgggcgcctgtagtcccagctactcggtaggctgaggcaggagaatggcgtgaacccgggaggcggaggtttcagtgagctgagatcgcgccaccgcactccagcctgggcgacagagtgagactccgtctcaaaaaacaaaaa

SEQ ID NO: 218136 - DNA, 602 bp, Homo sapiens
cttacttagtattttaacagtgcactaactggaaggcagagtaaagacagacagatcttgtttcggtaactctgttcttgaatggagaagcgtgatatttcattgccctaacagtggagtctgggccaagggcatgtgagtgagagtgtgctgctgactggtgcagttagtggagcaagactagagaaggcaccagcccttctgggcacacatcacaaacacagacctgcctaggttcctctctccttcccatcagtgtgtgcctgccatgtaactcagcaagttggagaacttcttagcttatttaatcttcttaaagtacccttggattttgccttccccatcaagttcctacaacccaaacctgtggaccagccgttctcttcttcacggttgacaatgtgagaagactcttctcgtcctttttttggacaccagacatatattggtggagaatatcagccatttaggcaggtgtattgaggtgtaacttatatacagttaaatgtactgttattagtatgtagttctatgatttaaaaactgcatataggcctgtaactaccaccatcatcaagatatagaacaatccatcttgcaca

SEQ ID NO: 218137 - DNA, 578 bp, Homo sapiens
cttacttagtattttaacagtgcactaactggaaggcagagtaaagacagacagatcttgtttcggtaactctgttcttgaatggagaagcgtgatatttcattgccctaacagtggagtctgggccaagggcatgtgagtgagagtgtgctgctgactggtgcagttagtggagcaagactagagaaggcaccagcccttctgggcacacatcacaaacacagacctgcctaggttcctctctccttcccatcagtgtgtgcctgccatgtaactcagcaagttggagaacttcttagcttatttaatcttcttaaagtacccttggattttgccttccccatcaagttcctacaacccaaacctgtggaccagccgttctcttcttcacggttgacaatgtgagaagactcttctcgtcctttttttggacaccagacatatattggtggagaatatcagccatttaggcaggtgtattgaggtgtaactttttcctaaatatattcaagaatacctgctttcagttcagattttaacaatcataattttccagtggccacagataattgttgtag

SEQ ID NO: 218138 - DNA, 422 bp, Homo sapiens
tatgcctttgacatcacccaatattcaggaaattttgccctgtgattggtaccataaaaatgtaagaactaatcaaaagttcatttctgttaaaaacccttcttttcccttaagtagctacatctggcaagattctcatttacattaagcctgtagtcaacaagtctgttacaaggcatacacactatactttgatcattaaataatgacacaaccagcaaactcctttggtctaacattttttattccctcaaatttgatccgaatttgtcagtattttaaaaagtttttaaaatttggtatttttctcttaagttgactagagacgaatttttgccatgctctccaggctggtctcaaactcctgggctcaagtgatcctcctgccttggtctcccaaagtgctgggattaccaggccga

SEQ ID NO: 218139 - DNA, 234 bp, Homo sapiens
atcatcttggttacttgtctcttgtttttgttttgttttttgtcttgtaagaatttaaattccatgagaataaggaccatgcatgttttgttcattttgtatttccaatgcttggcactggactcagtaaatattgttgattgatcaaatagctggctggatgaaatccattgaatgtatcccttttgttcaacactgacttttagtcttcattaataaactatttggatgatt

SEQ ID NO: 218140 - DNA, 443 bp, Homo sapiens
ttttttttttttgaaacagggtctttgttgctcaggctgaagtgcagtggtgggatcacggctcactgcctcatccttacaagtagctgggaccataggtgcatgccgccacactggactttttttttataaagacactgttgcccaagctggtctcaagtcctgtgttcaagccatcccccggtcttggcctccccaaagtcttgggattatgggtgtgaacactgcccctggcctgtagctggtttctaagcagtgctttgttgttttccaaaattccattttgtacagaatcaaaaatactccaagagccccttctggcttcttcctttcccaatgacctcagcttatactcttaattaccctccttccctccctaatgaccctccccaaattatgctctttcccaaattaattaaaaattaattttaacttttgaatac

SEQ ID NO: 218141 - DNA, 240 bp, Homo sapiens
actgaggagttgaaaagtactataattgacaaaaaattcactagaaggactcaacagcaagtttaagttgacagtagaaaaaaatcagcaaacttgaagctaggtcaatagagactatccagtatgaaaaccagaaagaaaacctgtaagataagacagcaaaagattgataatatatagttagattactaatttttgttattcataattaaaaaaatttcaacgagtaatccatttatt

SEQ ID NO: 218142 - DNA, 348 bp, Homo sapiens
cgcagtggctcatgcctgtaatctcagcactttagcaggctgagacaggcagattacctgaggtcaagagttcgaggccagcctgaccaacatggagaaaccccccatctctattgggaggctgcggcaagagaattgcttgaacccaggaggcggaggctgtggtgagccgagatcacaccattgcactccagcctgggcaacaacagcaaaactccatctccaaagagtatctaattcaaatcacaatgcatttcataataccttaaataattacatcctcttcaaaagatcaaaagtattaaacaaataaaattcacagaatacaatctttgcaattactagtaa

SEQ ID NO: 218143 - DNA, 457 bp, Homo sapiens
caacaaatgagtgcaggcaaaatctgacaaaatcatgctggccagggtgacatgcacctgtattcccagcatgctgagggtgctgagggtgctgagtttgagaggaccacctgagctcagaggttccggaacagcctggacagcaaagctgagaccccatctcttaaaaaaaaaaaaaaaatctggctgggtgcagtggcgtagtcccagcactttgagaggcctaggtgggcagatcatgaggtcaagagatcaagaccatcctggccaacatggtgaaaccccatctctactaaaaatacaaaaaattagctgggcatggtggtgggcgcctgtagtcccagctactggggaggctgaggcaggagaattgcttaaacccaggaggcggaggttgcagtgagctgagccccactgtactccagcctggtgacagagtgagactctgtccaaaaaa

SEQ ID NO: 218144 - DNA, 418 bp, Homo sapiens
gatctatagtactgatttgtaattatattttactcctgggatgcaacaggctttgagtgaagtatagggattgcacatcagtttatgtgtagatttttttaactatacatttcaccttttaattctaaggcaataaacagttaatgaagggattttgagttaatgtttattattgacaataattcctcattctgcaacttcaattatgaacaactctaacttatttccagaaagtaaacatcccgtccttacaccaaatataaacagtagccagatgtggtgaggctgaggcgagaggatcgcttttgagcccaggagttcaaggctgtagtgcacagtgatcgtgcctgtgaatgaatagctactgactgcagcctgggaaacatagcgaggccatgtctctaaggaaaaaaaaaac

SEQ ID NO: 218145 - DNA, 438 bp, Homo sapiens
tttattggttgcacgcacagtcagttatttcatccagaaaatctgaaggccctacaaactaaccagaacagtaagggttgaaactgaaggccgattgtgaatactatccaccgggagcttcttatgaattgactcatgttcctcagataataaataacactaaaagacaccagttagcttctgacctcaaggagtgctactttcatctcctgcaagctttgaaaagggatctgatacctgacaacatcttgacaaaagcacatcccatcttctgatggaagctgaaccaaaattattgatgtcgctagtgattcagggtactctagattgtttggagtcctatataaatacatttaatagacaaaaaaattgctgccttaatctaagcagaaatgaccttagtagatagatactgcttaccccactgatgcattagag

SEQ ID NO: 218146 - DNA, 602 bp, Homo sapiens
ctagttatggtgctgcaggttgaaatccaggtggtcccatgcctgtgccagaccagatggttcctcagccaaaagagcctgcccttcttcatcagagctttttcttttgctccttcaagtgccacacagggacaccacatgattctgtagcttgtaaaagtgaggattcattcctggagggatgagaattcattctcctgcttcaaggaatggtgtcatgtggtgttcacagaatgtgaacaccggcactgacagatttgtacgcatgcatacatactctacactgtgcgcaatggtattactccccatctactaactaggtagcaaaatatttatttcagttctcagtctccaaatctcagcttggtcattttaagcacgtgttgtttcttcagttttaactaactaggctaataacacagcatcttcctctgttcctaagttctgtcgaaactgcccttcattctacaccgcctaactggatgtagagtctggaaaatgggacactaactttcagggcttggtctaggaatctgctcccacgagcaacatcagttatgactctagaggaagctgcagaagtaagggaaagaaggatagta

SEQ ID NO: 218147 - DNA, 611 bp, Homo sapiens
ggttgggagcagaatgttctcgatgacagatcgagcctggtcgcagcaccgcctgcacaaagtgggttttggtcatcagaggctgtggtcgaccacagggtagtcatttcctcattctgcaggctctgtcatccctctcgaacacctcagaggcgtggaagtaaatgttgtctcagtactgagtaaataaagtagccagggagatgatctctatttgtcttattgtatagatgtattttaaaagatttttattgggtctcttatgatgagccaagtgctgtgttgagagttgaagattttcagagataactaccaaggcctcacattgttgttcaataacaagataaccttggcaaattaattcacttctcaaagtctctgttttctcatctataagaccgaaaaaagcatgtatgttattttgcttatttcacctactacaatgacgacaaggattcagtaaagtcaggtagcacaaaataccaccacagagtaaaagtcactaaatagtagttgtgaatcattatttaaatttcttcttattccgaaaatgacttggaacatcttataaattgtttgcaacaaagaaaaaaggaaggaagtgaagaaat

SEQ ID NO: 218148 - DNA, 406 bp, Homo sapiens
caaaataatttacatatgcaaaatgtaactttgaatcttctttatgatttttgttccagaactaataacaacagcaataagtgcaaaaaggaatagattatttttagaaagttgtgcgttttcatttatattatagtaacagattttaaaaacaatctggtcttatccactaaaataagctaggttgtttctttgcacagatggataagaaaggactgctctagaaagtaaaattgaaggcattggatagatcatacttaattttcaatgttgcagagatctcgatttattggttgtagtaatcatagtaatagcaattgcaagaatattttggacaatttcttaattatagtagattattgtatttctgtattaatggatttctatttgtaaatcaagtcgacgc

SEQ ID NO: 218149 - DNA, 390 bp, Homo sapiens
cagtgcactccagcctgggtgacagagggagactccgtctcaaaaaaaaaaaaattgttgttaaagtataaatgtctggtggcttgggtcgaaggaggcacgttagaagtgacaagctccacagaaagcagcgagtctctttcctgagtctgtttctctgagtctcttcttttgggtatgtggtcataacttgaagttcagtggggtgtatacaaattgtggtggtgctggtgaaatcgcaggatagcgactaagggggctgtgaaggattttgcccccaggacactgaggtgtatggggcataacaacgtaaagtcaggagaaacaatgttgtagggccatggtcattagcggctgggataggagacccggatgcactgcacctcaggc

SEQ ID NO: 218150 - DNA, 449 bp, Homo sapiens
aatagtttcttagatttcttaggattttttataccagataatgtcatctccaagtagagatcattttacgtcatcctttccaatctggatgcttttattttttttttcttgcctaattgtgctggttagaacctgcagtagaatattgagtagaattggcaaaagtggacatctttgtgttgttactgataggaggaaagcacattttgtcttttgccatcaagtacaatgttaactgggggggttttgtagatattctttatcaggttgaggaagttcccttttattcctagtttgtttagttttagttttagctttttttttttttttcatgaaaggatgttagactttgtcaagtagtttttccacatctattgagatgatcaagtagtagggtttaagtctttttaaaatcccttcagtgatattttagcagaggttttggaggg

SEQ ID NO: 218151 - DNA, 210 bp, Homo sapiens
gcaggaggattgcttgagcccagaaggttgaggctgcagtgagctatgattgcatcactgcactccaacctgggtgacagaatgagaccctgtctcaatgaaaaaaaaaagaagacaaatgccgcatgattgtgttaacatgtggtagctaaaaaagttaatctcagaattagagaggagaggccaggtacggtggctcacgtgtgtaat

SEQ ID NO: 218152 - DNA, 398 bp, Homo sapiens
aagtagtttaagtatttcttcttagttttttcttctaagcagggaagagcatatttagatgagcatttggggaggtatttgagctgaagcctaaaggatgagaagcaagtagccatgagaagaactgggggaacattttaagcagaggagtgagtaagggcaaaggccctgatatgtacaaaagtcaaaaaaacataaggcaggcagtgtgaccgatgagcaagggggagtggcagggctgaggtcggagaggtgggctgggtcaggtcacttggtatgaattttattctatgttcggcaggaagccattgaaaaattttattataacttcaggcttgcatgatctgaatttcaatacagtggcatttcatttcatgaaataaacatgattcttagtt

SEQ ID NO: 218153 - DNA, 714 bp, Homo sapiens
ggttcaagcgattctcctgcctcccaggttcaagcgattctcctgcctcagcctcccgagtagctgggattacaggcgtgtgccactactcccagctaatttttgtatttttaatagagataggatttcaccgttttagctaggctggtcttgaactcttgacctcaagtgatctactgccttggcctcccaaagtgctaggattacaggcgtgagccactgctcccagccaataatgctttgttcagaacagcagtacttaaccattttctttttctttctttctttctttctttccttccttctctttctttcctcaccttttttatatttatttttatagagacagtgtcttgctatgttgcccaggctggtctcaaactcctggcttaagtgatccacctgccttgacctcccaaagtgctgggattacaggggtgagccaccacacctggccttgggccattttctcacaagacaacagatgatgctcacaatcgacacagacccggaggctctcctgcatgtcaaccataatcccacccttttctcacacactcaataaaacacttcaggctgggcgtaatggctggcctgagtgaagagacaacctatacaataggagaaactatttgcaaactatgcatctgacaagaggttaatatccagaatatacaagcaactcacacaactcaatagcaaaaacaaacaaaa

SEQ ID NO: 218154 - DNA, 488 bp, Homo sapiens
ggttcaagcgattctcctgcctcccaggttcaagcgattctcctgcctcagcctcccgagtagctgggattacaggcgtgtgccactactcccagctaatttttgtatttttaatagagataggatttcaccatgttgcccaggctggtctcaaactcctggcttaagtgatccacctgccttgacctcccaaagtgctgggattacaggggtgagccaccacacctggccttgggccattttctcacaagacaacagatgatgctcacaatcgacacagacccggaggctctcctgcatgtcaaccataatcccacccttttctcacacactcaataaaacacttcaggctgggcgtaatggctggcctgagtgaagagacaacctatacaataggagaaactatttgcaaactatgcatctgacaagaggttaatatccagaatatacaagcaactcacacaactcaatagcaaaaacaaacaaaa

SEQ ID NO: 218155 - DNA, 777 bp, Homo sapiens
  misc_feature (562)..(562): n is a, c, g, or t
  misc_feature (626)..(626): n is a, c, g, or t
actttaacaattcctttattttatccacacatgctttcaatattttgtagtgtaatttctccaaattaatggatttaaactcatttagaatatttgctatcattctacatgctggacctttgttatttttagttttgttctacttttataagtatggatattgttttcttaaggaatggatatgaaacaaaacaagagcagagtagttctgcctgtttgttcatgtactgtgatttgaatatctttatccagtgtgctcttcctatatctaataaaaatgccattatcaccactttatctggcaatcatagcaagaattaaaaggacattttttcttttttttataagcttcaacttattttatgtcttatattttataacactcttcttagagactcagccactattttgtacttctctcaataaagtttattatggattatgcttgtcactgaggaagatacaaagcaaagtttatgacacacactccttgacttgaaggaatttaaagtctgcatgaacaaaaccaagaaatagtctcagaattatacatgtcagcctnccaaagtgctaagccgccgcgcttggcccgatgattaggtttttatgcacgtgtgagaaaacgncctccttaaacttggtgggacccttgcgcattaactgtctatatgataagacccgctcatgttgcttctgcctgtatatcagcattttggaggctatgcaagaggactgctttagccaccagtttagacccctggctaggtcccctttttt

SEQ ID NO: 218156 - DNA, 331 bp, Homo sapiens
gggggttgaaggattccagcgactggggcaagaatctgtgttctgtgtgctcttgctgaaaggatattgctgggatattgagggttgtggatgaagtaaccttccaggggcagaattgtgcagtaaggtccctcagcctaggatgaaaaaggcctctaacgaaaagcccacttgttcatgtttccgttttaactaaatgttcctctctaaattccataccctctggggcataagctgaaggaaaatttggaatcttattatctgaaattgtacgtgcatttgacctatattgctatgtctttaataaaagcatctgaggaatagttcctaa

SEQ ID NO: 218157 - DNA, 313 bp, Homo sapiens
tgcctgatgatctgaggtggaacagtttcatccccaaaccatctacacctgaccactccgtctgtggaaaaactgtcttccattaaaccagttcctggtgccaaaaaggttggagaccactgccttatgggattcatcaaaatttctctttattgtctagaagaaatttcattcctcagcctactgtgctggctttgctaggttgctcatcagcataggaactgatccctatccataaactgatccctcttccacccaataatagcctttgtttgtgctgagcactggctagttatttcaactctttgcttcc

SEQ ID NO: 218158 - DNA, 409 bp, Homo sapiens
acctgggccgtgaaaagcctccctcaagccattctgcaggccctccgtcattagggttaagcctcctctccctgagcaatatcatgcctttcccaatctatttggccttcgtatttggacctgtgtcagtgtttccggtatcagggaggggtggggggagtgaagtctgtgctgcccctcctggagaggtctggggagaaagcagatgttttgaaaaaatgatccagtgtcccactcccgaagaaacaaataaacaaataatgaattgaggccagagtggcaggtggctggagtcacaatgacagggagcagcgtcaggcggcatgtggctggagaagggacttgccctgagcatgagtgtccaccatagcactgtggctgagcctgatgcccacggcaaggtaggggc

SEQ ID NO: 218159 - DNA, 384 bp, Homo sapiens
ccaccgcacccggccaaaagctgtcttctaaggggagcatgggagctggagcgtcagtgaggcccccgccagccatcctaaccaccgctcctgaacaccatccactgtggaaattctgggcaggtcctgcgtgatggggagccccagtgcaccccgtgttaagagctggtgcctgcagcaagggccagaggacaggcctgcccgggttacggctggcacacacttggtgcaggagcacccggtctgactcgcttcaacactggccagttatttgccgcaagcggctgtgacttatgtcatttttacaagatgttttcaaattattataggaagctttgaaaaatgatgggttagggctgtgaggcataaaagttcaatccagga

SEQ ID NO: 218160 - DNA, 376 bp, Homo sapiens
cagaagttccatctcacatttgaaaaaagcagcaagtgaggaaaagcctttaggggttggtgaaatggaagaagaatgcactctagaaccagagttggcagcatttccaaagcaggatggtgggacacaggaatatacagatgccactttggaagaccacagaggtgatgttcaggaagctgacacactccatagacagctctccctgagtcagtgcttcccactcttgatgactgaagaacaacagaatccaggtgaacaaataagtacaaacattcatgcctctggagaagaaaaatgttatgaagaagttcaagttcagaatgaagcttctttctccactttagaaggagaaatgatagaaactagtttttct

SEQ ID NO: 218161 - DNA, 186 bp, Homo sapiens
gggcatcataaaatattccttataaaaaggcagtattaggtttgacagaattgaaccaataagttagactatatcatttctcccctggaattctgcaatatttctcaattaggtctctctttgtttaatcaggcctagacactgcttacccttaccagtaagccttcctaaaagataagtttgatc

SEQ ID NO: 218162 - DNA, 433 bp, Homo sapiens
gtgtctaatttcatcacaccactcactttgctcatctgttcttgtcaatcagttttaaactcctacgaatataatgcaatgtaactatcacaatttttatgtctgtcttacttctcaccttcaaatggacttgaaagcatcatgcctagaattttacggttaaagttgtatgtattatatgaagatctggagcattttgtttccactaataatacctaagaaaatgccatcgtgtcctgtggagagaggatattcctattcgtgtgcctgtttagaacatgcacccattaactttgctatatactgagtcagttgctcaccacaagataagcacaaaactatcatttccttctatcatctcaaagctttgtgcaatgtcacaaatacagcagacctcgatttttcaattaataaagttttatttcattccagt

SEQ ID NO: 218163 - DNA, 484 bp, Homo sapiens
gagtgtcgaggaggagaagagaaataggagcagaagaaatatttaaaatgatacttactcagaattttccaaaactgataaagtacattagccaacagattcaagaagctctctgactctaagctgaataaaaataaaaccactttagcaaaaaatctaactctaagctgaacaaaaataaaaccactcctagcaaaaacaaacaacaaaaacttcaaagaagcaacagtataactgattactgctcagcaaaaaatgatgcaaaccaaaagacaataagaagaaatctttaaaatactgtaagaaaattactgttcacctagaattttatacccaattaatatatccttcaaaactgaatgcaaaatagagatgtattcagacaaaaaccaagaaaactttgcactagcagaccaaacatgcacagaatgagaaactaaaggaaattcttcaagtagaatgaaaataatgccaggtaaaacat

SEQ ID NO: 218164 - DNA, 508 bp, Homo sapiens
cagtgatttcatttttttagatgctaaaacttatgggtgaaagtggattaaatgtagccaaatgcaacatcaaaatcttcaggcacaaaaacccattaactttttcatactctcagaagatgaacctaatttcaaatgaaagctgcctccagaatatattaagcgtattctagatacaattcattttggcaaacatgctgtagaaattcacataacattttactgtactaaaagtaaattgcccatgtaacaaaaaatatcttttcagagcttcaaatgaattttaaaggatgactgatggtccttggaagagaaacagtaaacaaataaggtttctagcaatgatgtatgagttagaaattgcagttccagatgatctctttattaaagagacgatctacacttaatttggtcaactgttatgaacatagttcatgttaagtccccatttaaatacaacctgaaataccaaagttaattttcttttctttcttttttttttttttta

SEQ ID NO: 218165 - DNA, 3034 bp, Homo sapiens
ttaaattctaattagagatgcaggaatcaatgatagggaggttggacagctcagttccccagtgccagcccaatagacggatgagttattgtcatgtaaaaagcgccagcaataagaccaaccgctttgctattgtccaagtggaaagagccaagtttattatgaggactatatgctctagagacctcagacaaggcatctcataggaggctttttcataaaactaggctctgctggtagtaaggaggccagtttggaggcaggcgttgagctgtgcacatctccccactccagccaccttctccatatccatcttttatttcatttttccacttggctgagccatccagaaccttttcaatgtataaaatggaatattcttacctcaattcctctgcctacgagtcctgtatggctgggatggacacctcgagcctggcttcagcctatgctgacttcagttcctgcagccaggccagtggcttccagtataacccgataaggaccacttttggggccacgtccggctgcccttccctcacgccgggatcctgcagcctgggcaccctcagggaccaccagagcagtccgtacgccgcagttccttacaaactcttcacggaccacggcggcctcaacgagaagcgcaagcagcggcgcatccgcaccactttcaccagtgcccagctcaaagagctggaaagggtcttcgcggagactcactaccccgacatctacactcgggaggagctggccctgaagatcgacctcacagaggcgcgagtccaggtgtggttccagaaccgccgcgccaagtttcgcaagcaggagcgcgcagcggcagccgcagcggccgcggccaagaacggctcctcgggcaaaaagtctgactcttccagggacgacgagagcaaagaggccaagagcactgacccggacagcactgggggcccaggtcccaatcccaaccccacccccagctgcggggcgaatggaggcggcggcggcgggcccagcccggctggagctccgggggcggcggggcccgggggcccgggaggcgaacccggcaagggcggcgcagcagcagcggcggcggccgcggcagcggcggcggcggcagcggcagcggcggcagctggaggcctggctgcggctgggggccctggacaaggctgggctcccggccccggccccatcacctccatcccggattcgcttgggggtcccttcgccagcgtcctatcttcgctccaaagacccaacggtgccaaagccgccttagtgaagagcagtatgttctgatctggaatcctgcggcggcggcggcggcggcgacagcgggcgagccagggcccgggcgggcgagtgggcgagcgggtaggcccaaggctattgtcgtcgctgctgccatggctttttcattgagggcctaaagtaatcgcgctaagaataaagggaaaacggcgtcgccctcatttcaaccccactcctacccccttcctcaacccccaaacaaaacaaacaaacttccctggcttcgcacctgcctggggcctcgcagcggggccagggctccgcctgctgatcgggggttgtgagcagcgcggcctggacgcggggcactctcagggggctgtgtctgcgtgtcagtttgtgtctgtctcggggaatgtgtgtctgtggcccaagcaggtgacaggaagagatggggggcctcaaccaacttagtgacttgtttagaaaaaaaagacaaaaaagtaaaaataaaaacaaaaaagttggaaggcagaaaccattaaaaaacaaaaagccaacaacccagaaaggtttaaaaaacataaggaaaaaaaagacaaattaaaggaggggctaggggagaagctgcagctggagctgaaggctcgatcttgtgaacccctaaatccgctccctcctaacagcacggattctcttggggctcttcttcagggaagagtagggacgccgttccagccccccttcctatcgtgtccttgggttcgggtcactgcggcgacgacttgctcagactgtcccggcggccggagtgactttctcgcacccccttgcctgtcccacctcgctgaacaccatcccgccattagcgcatcggaaccccacacagttgcaactcccaaccccgaatctttgcagccgttcggccctgaaagatgccctatccatgagatgccttttcatctgcaaactctgcaaaatgtgtctcatgtttcgcaactctttttttccccctcgctcccgcctaccccgtcggcattttcttcttccaccagcttttactgaactttttggcactgctttggattggggtcaattgcagtccacgtaactggctgcagagaaatctaccgagcaaggaaaaggcacacacacacgtttgcaggggtgtctcggtttgcatttctgttggaatgatccgaactggactcacatcctgtatggtggatggactgtatattgagggttccattcttcgcgcagtttagacatctctgttttgattctttgttgttgtttttattttaaaaggcacaaactctagatattagttgaatgttgaggctttaactttttcggtgtctttctacaactgtgttctgtgactcaattgtatcgtgttaatatcagtgcagactgtctcctctacgtgaccgtataatgtttttctcgtcttgtagtctctatggcgtgtctttatggtgtaataaggttctcacggggtcaatcttttgtgtttagagaggccacggttcagacaatggtatatatttttgttatcaggtgcatgtctgtctgatttctttttttttcctgttggactatgtttgtgaacataattgtcataagttatgtttcagatttttgaatttatttatatgtgttataatgaatgcttctatttaaaagggaaatatttctacatgtgcatatagttttccaagagtgtaccattaacttgattgttgataataaaaaccaaaagcaagtctagcaa

SEQ ID NO: 218166 - DNA, 2837 bp, Homo sapiens
tgctctcacaaacaatgtactaggggcggtcctgggttgtaattttcatcacctggcctggcgtctgtgctgcatcatccccatgtccatgggaccgtctcaattcaatcatccatcttttatttcatttttccacttggctgagccatccagaaccttttcaatgtataaaatggaatattcttacctcaattcctctgcctacgagtcctgtatggctgggatggacacctcgagcctggcttcagcctatgctgacttcagttcctgcagccaggccagtggcttccagtataacccgataaggaccacttttggggccacgtccggctgcccttccctcacgccgggatcctgcagcctgggcaccctcagggaccaccagagcagtccgtacgccgcagttccttacaaactcttcacggaccacggcggcctcaacgagaagcgcaagcagcggcgcatccgcaccactttcaccagtgcccagctcaaagagctggaaagggtcttcgcggagactcactaccccgacatctacactcgggaggagctggccctgaagatcgacctcacagaggcgcgagtccaggtgtggttccagaaccgccgcgccaagtttcgcaagcaggagcgcgcagcggcagccgcagcggccgcggccaagaacggctcctcgggcaaaaagtctgactcttccagggacgacgagagcaaagaggccaagagcactgacccggacagcactgggggcccaggtcccaatcccaaccccacccccagctgcggggcgaatggaggcggcggcggcgggcccagcccggctggagctccgggggcggcggggcccgggggcccgggaggcgaacccggcaagggcggcgcagcagcagcggcggcggccgcggcagcggcggcggcggcagcggcagcggcggcagctggaggcctggctgcggctgggggccctggacaaggctgggctcccggccccggccccatcacctccatcccggattcgcttgggggtcccttcgccagcgtcctatcttcgctccaaagacccaacggtgccaaagccgccttagtgaagagcagtatgttctgatctggaatcctgcggcggcggcggcggcggcgacagcgggcgagccagggcccgggcgggcgagtgggcgagcgggtaggcccaaggctattgtcgtcgctgctgccatggctttttcattgagggcctaaagtaatcgcgctaagaataaagggaaaacggcgtcgccctcatttcaaccccactcctacccccttcctcaacccccaaacaaaacaaacaaacttccctggcttcgcacctgcctggggcctcgcagcggggccagggctccgcctgctgatcgggggttgtgagcagcgcggcctggacgcggggcactctcagggggctgtgtctgcgtgtcagtttgtgtctgtctcggggaatgtgtgtctgtggcccaagcaggtgacaggaagagatggggggcctcaaccaacttagtgacttgtttagaaaaaaaagacaaaaaagtaaaaataaaaacaaaaaagttggaaggcagaaaccattaaaaaacaaaaagccaacaacccagaaaggtttaaaaaacataaggaaaaaaaagacaaattaaaggaggggctaggggagaagctgcagctggagctgaaggctcgatcttgtgaacccctaaatccgctccctcctaacagcacggattctcttggggctcttcttcagggaagagtagggacgccgttccagccccccttcctatcgtgtccttgggttcgggtcactgcggcgacgacttgctcagactgtcccggcggccggagtgactttctcgcacccccttgcctgtcccacctcgctgaacaccatcccgccattagcgcatcggaaccccacacagttgcaactcccaaccccgaatctttgcagccgttcggccctgaaagatgccctatccatgagatgccttttcatctgcaaactctgcaaaatgtgtctcatgtttcgcaactctttttttccccctcgctcccgcctaccccgtcggcattttcttcttccaccagcttttactgaactttttggcactgctttggattggggtcaattgcagtccacgtaactggctgcagagaaatctaccgagcaaggaaaaggcacacacacacgtttgcaggggtgtctcggtttgcatttctgttggaatgatccgaactggactcacatcctgtatggtggatggactgtatattgagggttccattcttcgcgcagtttagacatctctgttttgattctttgttgttgtttttattttaaaaggcacaaactctagatattagttgaatgttgaggctttaactttttcggtgtctttctacaactgtgttctgtgactcaattgtatcgtgttaatatcagtgcagactgtctcctctacgtgaccgtataatgtttttctcgtcttgtagtctctatggcgtgtctttatggtgtaataaggttctcacggggtcaatcttttgtgtttagagaggccacggttcagacaatggtatatatttttgttatcaggtgcatgtctgtctgatttctttttttttcctgttggactatgtttgtgaacataattgtcataagttatgtttcagatttttgaatttatttatatgtgttataatgaatgcttctatttaaaagggaaatatttctacatgtgcatatagttttccaagagtgtaccattaacttgattgttgataataaaaaccaaaagcaagtctagcaa

SEQ ID NO: 218167 - DNA, 474 bp, Homo sapiens
caaagaaaggattagaatctttaatagattgcaggaaataaaggagaaacaacaactgaaggtaatgtgggatcctggatgggatcctggaacagagaaaaatacaggaggtgaaaaaccggtgaaagtcaaaaagggccacagtttagttaatggtattataccagtgaatttcctgataatttttttataactgtgctatggttatataagtggttatcagggaaactgcataaggttatatataattaactctaccctattttgacaactttcctataaatctaaaattatttcaaaataatttttaaagtgcttggctgacttgaattattgtgtcaaattgtagaaacataacaaagaagtgttcaggttttttgagacagggtctcggcctgtcacccaggccaaagggcagtggtgtgatctcagttcactgcagcctgggcaacaagggcaaaactccatctcaaa

SEQ ID NO: 218168 - DNA, 309 bp, Homo sapiens
tgtgtcttcctccatgtatcacataagggggcacgtgatgtcagtctgttcttttattggtgatgttaagtttgactcttttcttaagggagtcaaactttaccttctaaagcatgtgtgtttacgtaagagcggtatacacataaatacgtttttttaaaaagacatttttctaaaacataagatttagctgagtttcatgaaacaacatatacccttactaagtgcaatgaactctaatcttttctgttctattctaaaaatatattttttttaaatgctggttttgacctacttaatctctttggc

SEQ ID NO: 218169 - DNA, 988 bp, Homo sapiens
catggtggcacacacctatagtcctagctactcggtaggctgaggggtgaggatcacctgagtccagaagttggaggttacagtaagccaacactgtactactgcactccagcctgggtaacagatcgagcccctatctctaaaaaaaaaaaaaaaaaaaatcaatgtaaaaacaagaagcttggccgggcttggtggctcatccttgtaatcccagcactttgggaggtcgaggcaggcggatcacaaggtcaagagatcgagaccatcctggctaacatgatgaaaccccgtctctactaaaaatacaaaaattagctgggtgttgtggcgcatgcctgtagtcccagctacttgggaggctgaggcaggataatcgcttgaatccaggaggtggaggttgcagtgagccaggaacgtgctccatctcaaaaaaaaaaaaagctttatgagtgattctgacaccacacccaccgctggttaacccactatgccctagagctctagccgggagcctctgtctattcccatagctcctacaaccagttttgtgagtcccatgtccattttctccagcccagatatacctcccagctagccttcagtcccacatgatggacatcctactgcaagttctccatcagcctctccacctccacatgctgccacaccactgcccaactaatcgtccagcgggaaatgcctcaaaaggccacaaggcctgacattcaagagtctccctgacctggtccaaatctggggccacctactcactaagtttatgcctgtcacacatgtacccaccaaacagaagtatctgcaatttgaggcacaaattctatctccacccactggcccaactcctagtgttcacatgtctatgatccagccactttgcaaagcacagctcaaacatcttctgctacacaaaggctggtaccaccaacagccccagcacttcctcaggacctgtcctctgtactttcca

SEQ ID NO: 218170 - DNA, 928 bp, Homo sapiens
catggtggcacacacctatagtcctagctactcggtaggctgaggggtgaggatcacctgagtccagaagttggaggttacagtaagccaacactgtactactgcactccagcctgggtaacagatcgagcccctatctctaaaaaaaaaaaaaaaaaaaatcaatgtaaaaacaagaagcttggccgggcttggtggctcatccttgtaatcccagcactttgggaggtcgaggcaggcggatcacaaggtcaagagatcgagaccatcctggctaacatgatgaaaccccgtctctactaaaaatacaaaaattagctgggtgttgtggcgcatgcctgtagtcccagctacttgggaggctgaggcaggataatcgcttgaatccaggaggtggaggttgcagtgagccaggaacgtgctccatctcaaaccctagagctctagccgggagcctctgtctattcccatagctcctacaaccagttttgtgagtcccatgtccattttctccagcccagatatacctcccagctagccttcagtcccacatgatggacatcctactgcaagttctccatcagcctctccacctccacatgctgccacaccactgcccaactaatcgtccagcgggaaatgcctcaaaaggccacaaggcctgacattcaagagtctccctgacctggtccaaatctggggccacctactcactaagtttatgcctgtcacacatgtacccaccaaacagaagtatctgcaatttgaggcacaaattctatctccacccactggcccaactcctagtgttcacatgtctatgatccagccactttgcaaagcacagctcaaacatcttctgctacacaaaggctggtaccaccaacagccccagcacttcctcaggacctgtcctctgtactttcca

SEQ ID NO: 218171 - DNA, 322 bp, Homo sapiens
aatgattcataaatgtaagcctttagaatagtgcagtggttctcagttgggcctgattttatacccagaggacagctggcaatgtctggagacatttttgttgaaatgactggtgggtagaagccagggaggttgctaagcctcctgcaatgcccaggacatcccctgagagaactgcccagccggttgagaaaccccagaacaatgcatggcacaaaatgtgaactcaatcaatattcgttattttttaagagctgcagtgaaaattattttccttatcatcgatgtacaagtgtgagagtgtctcacagaaactatcact

SEQ ID NO: 218172 - DNA, 848 bp, Homo sapiens
actagaatatattttcatttggggaagcattttcatttctcaagcattactgacattatctttcggatctccctgtgagaagataagagggcaggcctgggaacatatgctgacttttaattctggaactcagtacctccgctggggatagtgccaggaaccccagagtcttccaacctagtaggtcagggtgttggcaaatcagagtgttagtgagaatgcagccagcagttgatccggcaccaattccagtacacactggtaattatggcaggctgatgtcagttttccaaaatggaagaacgtgaaaggtcttcaagcaacatacaaggtcaacctgatttcttcacatgggcccatttgtgaaatagatcctatttctaatgatcagcttcattatgtgcgttacctacgctcacacctctagaaaaaggacttgcttcatacaggacactgtttctttccacttacatggtgtgagagagacagatcgtctgcttccttaggtcattatggaagaacggggaatgattttctcttttgcctgttgttctgtttatcgccctattttacaaaactgattctgacctggagggaaaaaaatagatgttaagaatgacttggctttcctgtggtcctgttttgaatgtttggcagtagcttatctgtctttttgagatattgtcctctgtaaactcccattcgtgttcctgagaaacctcttgctggagtgccctgcaggagaaaggctctccatgctcattttatgcccagaaagtggaggttgcagtgagctatgattgtgccactgtactcctgcctgagcaacagagcaagaccctgtctca

SEQ ID NO: 218173 - DNA, 224 bp, Homo sapiens
ctaaaaagcagactaacttttaacccctaatatgctaaaacaaataaattttttaaattgaagtgtaccaaatgcttgataggacacaaacaacttcaatgtccagaaatacttttaaaacatggcagggcccaaatagcagaaggtgagagtaaggaaaataattggggatgataaatttgaggtatcaggagcttcaacaggtagttttagataaaggacaa

SEQ ID NO: 218174 - DNA, 360 bp, Homo sapiens
cacaagcttgtagtgaagcatgaatgggtgagtgagtgctcaacaaatgctggacctggaaagagaaaacctctccaaactatttgatttaggctctttcaccctctcaaagcaggctgctatttatccaacatccattctatgccaggcattgcgctaagagccttgcccgggctatctctttcggtctgcacagcaatcctataagtaggtatgatgaggaaactgaggctcagagaggtcaacattctcaaattttcacagctaggaggtggagatgttgagcgactccagtgcacacagttttaaccgtgacactaaaataatccaccaacaaggtaggagtgaaccccatttcta

SEQ ID NO: 218175 - DNA, 403 bp, Homo sapiens
agcacagattgttctggcctgctccttgctaattttagaatgttgcattcccagcacatactatagttattcttgaaaactacaagcaaaacaaagggagaactaggttggtccaaaatccccagaaaatggtcctgcagcaaccacatcccattttatagacaccaatctcatttctctcccactgtgagtaagcaggattacaaggtcctagagcttcagagcttctcagttttaagtatagtatattttagcattcctggccctaggatccaggcttccccagcaattctgtatccatgaagccttaattctgtgactgttataggctacatttactatgtattatgtatttattcatttccatgaaaatgaaacacaaaataaaacaaaaatgaacaaa

SEQ ID NO: 218176 - DNA, 518 bp, Homo sapiens
agcctccaaatgctgatgccccatcatcaccggggaattgtgatctgcggccaggaccgagatccacgggcccagagtgaaatgacagtactgtgatcacgactggaatatgcacttcgccgaacgtggatcacagtcttgagaaagcaagcagctgggtttttgttttgttttttttccaagaagacagggacctaatctggtttgctcgcatttaattcctagtgcctagaatggtgcatgtcccaaaacatgcaccattgattaaataatttctgattacttcccgacctatttggagggttttcattatatttgttttaaaattattatggaaaccttcaagtcatatatgaaaattgaatagtaactgaactcccaattcatgatcaattctgtttcatctgttaccctctcccccactgtagtattttaaagcaaatctgaaatgtaccattccatctgttaccttgttcatgtttataaaacacaataacacctttttaaaacataaagcc

SEQ ID NO: 218177 - DNA, 335 bp, Homo sapiens
taagcacatccacacctcactaccacagtacacacaggctctgctctcacaaggttggctctttctttgtgcctgaagagcacacatgagttctcatcttgtgtccatgccattgctcacatccatgccccgactggaatcctctccctactcctctctgtctacccagatgcttgctattctttaaggagcagcatgggtcctactactatttaagcactgaagctcacattgatctctcccttctctccatttctacaattacctccatgaatggccagtttgtattattcttgataattataataatacattatttcaaagcatttcctctc

SEQ ID NO: 218178 - DNA, 509 bp, Homo sapiens
tcccaccatgttttcactgaatttacaattcacattttccgtttttaggtcttttatgttgtaaacactttggtcaataaaaaataactctcttaattctgtacttggaagggagggattattccagccatatgaacacctactggaaatagatttgcaacaatataaactttaagactctgtttaatttgtcaaataacacttattttctgatagtaataatagaaacttaaaaggtcttttgtttcatttgtcaaataacacttatctaacaacaaaagagtataatctgtgtgggaaattgctaggtgttcaagtagtattatatgtttgcttctagcttggatttcagaagttgcttgctcctctgtgtttagataaatgcaatgtccaacaacttgtggtgatgacaattctagtcttttattactcagcttgtttttgtttgtttgtttgttttaccatttggttttctttgacccgtaatcaaattatcaaagacttggaag

SEQ ID NO: 218179 - DNA, 448 bp, Homo sapiens
caggctggagtgcagtggtacaatcagggttcactgcagcctcaatctcctgggctcaagtgatccaccctcctcagcctcccaagcagctggcatcacaggtgtgcaccactgtgcctggcccaaacttctcttaaattcattttccttatggaacaacaacagcaacaacaacaacaaaaacttttgagagaaagttaggagttacatcccaccaagagagctgccttcagaaaatatcaattgttaggcaatttcacagtattcagtgtcttcttcaaacttaaaaaaaattatacaaattatttttaaaatatagagatggggtctatgttacccaggctggtcacatcttctttaaacttgtttgacattttttctgaccctctcaaacagttaactgttatttataataattaattggaagcgaataaagggcaagtattgg

SEQ ID NO: 218180 - DNA, 359 bp, Homo sapiens
ataaactcctaaggaatataatgtgtgaaaggcaatgaaaatgaataagtaattcatagacattcctcaaggtaacatacattttctatgaatgacagttgacatttataaagtattctttatatgtgattaatgaactgtgattagtaagtgatttcctgctaaacgatttctccctcaaggggcaacacaagaggatttatttccaactagagaagttgaaaatgaaagcacagctgaaggaaatgaagttatctgggtcagcaacagatactgcaaccgaaaacggggataatttttgcataccctgtgctttcaaactgcatgtcatataaaaggtgttgaatgaatagtgatca

SEQ ID NO: 218181 - DNA, 351 bp, Homo sapiens
ttaagaggaaaggcctccaagacgttgggtctacatctctgagtttctttctccagtctactatatccctgtaattcttcacagccctgttcattctccatgccttcaaacgatctcttttttttttcaaatagattttttaaatatttaaaaatattttctaggtttcctagttgtgttccagcaagaggttggtctgaattagatagtctgctattccagaagtgtaaccttttgcttgtaccccataaagagttatttctccccttgcccctttttcttagactaagcccataaaattgaatttgtgtcaattaaatgtgtgtgtgatgcaactccaagagagcttca

SEQ ID NO: 218182 - DNA, 450 bp, Homo sapiens
ttcatagaattacgtctcacggcacacatgtccagtttccagctgttttcattgcattgcatttgactgttttactgttctgttttgctaatacattttaagtggctagtaaataatgttaaagtaaatgttagccattactgcgtgcaattactgttttaaacttatccttattttacaaggttacttgaccaagatggtgacattgtaagatttgaacaaaggaaatgtgacttcagagtcatggttgttaactatgctatgaagtaggaaaactttatgaggtctttttaactcaaacagtcgagttttaagttgagggttagcaatgatgaatgagtggccaaaaaatgtattcatatttttagtctttcttagaattactggtagttgtgcacaactagagggtatttatttgtgtgtgtatgtgtcgtgtgtgtacgagtgctg

SEQ ID NO: 218183 - DNA, 677 bp, Homo sapiens
agctgttggaattttgataggccttgcatgaacctatcacttttggttagcatgcattgctagtatatagaaacactctgatttttgtgtgttatcctgcaactttgctgaatttattagctttagtagcattcctgtggatttttcaggattttctatatataggatcgtgtcctatatatagaattgtgaatgagtagtgatagttttacttcttttcaatttggatgccgtttgttttttgtctaattactctggctataacttccagttatacacttcacaattgagtgtattagctgtgagtttttcataaatgtccttatcatgttgaggaagttctcttctattcccagtgtgttgaatgttttaatcatgagttagattttatcagtgccttttctgcattgattgaggtgatcctgtggttttcctttctttgatttttctaatgcaatatattacattgattgattttctcatattaaaccacccttgtattcctgggataaatcccatttggttataatccttttagatgttagatttggtttgctcgaacagccaatcctcattattcatggattccatatttgcctatttgctaaaatttatttgtaacccaaaaattaataatgcagtggtttcatggtcatttatacatacacctagaatgg

SEQ ID NO: 218184 - DNA, 187 bp, Homo sapiens
gggtctcccatcaaattatatttccattctaaccactgctccccaaggagcaggctcttctccaagacccatcatctctgaatcaatcaatcattgccgaggcctcatcactagtcttcctccttgtaaccttgtccctctacaacgcccaaggtattccttttaaaatgtcaagtcccaaaaaaaa

SEQ ID NO: 218185 - DNA, 545 bp, Homo sapiens
agagggttcctgtctacaccctctcctccacactcagtgaggttttaagtactcagatgtggaactcatgaactactgaaagaagaaacacaatcttgtgaataaacacagcatttctaacctgcagagctgctgagacatgcaaggaaataatgaaatcagcattttaagtagatcgtttgtcatctttcgaccataggttattaataaaggcaaattactagatattttaattgcttagcacttttaatcattcaaataagaagcaaaactagtgaggaatgtttatgttatagtttaatatactttttttttttagtttaatataattgagtaaaattctaagaatagctagaattttctaattgcctacctccttttctagttgcttctgtcctgggttctcattctagtctagaccatttgtccagaaccacaaattgattcttaaaagctacctgtggttgcagtatgggagcagagtgggaactctattaaactgtgtgtggtttcgtctttctgcagctaaatccttaatgccttta

SEQ ID NO: 218186 - DNA, 732 bp, Homo sapiens
attgtttctatatgaaattccaaacttgaataacttctctaatttttccaaactctaatttattatcatatgtttaaaagtatttcagaagctactcgtattttaatggtaaatatggtacagatgcatatgtgtgatctgttttaaaacagcaatcacatttttccatattcttgattttcagagttgagtgattgttataaatatataaaaatgagacttgtgaatacagaaagatgtgaataactatattcactgcatttaattttattgacattagctatgatgttaaaagtcataaagtaacatttaacctaatctcaactgtatttctagttatgatcctatattattctccggaataccagaatgagaaaacttaccattactggtaaacaagagagactcaattaagattaccatgagacttctcatcttgaatctcctgagcaggcatatttatatttataatgttgttattgaaatgtggctattaaattcaacacagagttttaaatgaatagtaatagtttgtacattcaagtctggaatgagtagcataggttggtcatatgggttgtttttaaagcgtgctgctttgtaaggcaagaaaaaatatatatgtaaaatatgtcttctttgtatgttagaactattaaagaaaaatcacagaattttagagttcatgaatggcaattcctttaattatatagaaatccagagagatgattg

SEQ ID NO: 218187 - DNA, 297 bp, Homo sapiens
aaataaaaatttagatatatatgtgtaaaaatgtttattgtgttatttataatagtaggagggaagaatgaaaaggaagaaagaagaaagaaaaggggaaaggaagggagaggaggaggaaggagagagaaaaaagaagaaaaataaaaaataaaattagaaacaatctaatattcagtaaccagggaataattcattaagttttgatgccctcatatgatggacaattttgcagccatgaagatgattttatttatctatagttatggttgacatttttcaggcataaaaacttct

SEQ ID NO: 218188 - DNA, 272 bp, Homo sapiens
gtattagggtgatgctggcttcacagaatgagttaagtaagagtacttcctcctggatttttgaaatagtttcagtagaattggtaccagatcttttttgtacatctgttagaatttgggctgggcacagtggcgcacacctgtaatcccagctccttgggaggctgaggcaggagaatcacttgaatccagaaggtggaggttgcagtgagccaagattgtgcccctgcagtccagcctgggcaacagagtgagagtccatctcaaaaaaa

SEQ ID NO: 218189 - DNA, 786 bp, Homo sapiens
gttaggacattgcctcatctttgctttttgttttcaaatgtttcccatcaaagttgttgcatatgtcaattgaatgcaaatgaaagtggaaccagtatgtgttgcctagagggagatgagtaagaggtaacttcctaatgatttcccagaataatcactgttgctgaatgtttttgaagatgataccactgaaggtgctagctgtttgcatgtgtgagtgggggtgacttgaagggctcacatgtgactatcattttacttcccccatcccatcatcctcacggaacatctgacctgtgaattgggcttgtggtcactcttgcagaatcaggtaccacattgagttttatctgtacattaaagcctgctaatttgtggaggacatatgttgttttccatagccactgaagacctagcaggagaaactgggcttaatattccaccagagagaatggaactagacataaattccagataggctaattggatgctataggttactaagagtgacattttctagaatcttcattagatatctcatggctttagcaagttctacatgaaggcaggagaatggaccttccaccatgggccttcccaactatatgcttttgagatttgctaatataataaaagatattataataagagcagtgaatgtttaagatggcccagtttaatcctcttttctcagtagttatacttctaaggatatcactcataagatgaaagtgctaggtctaaacatagtcaccctgttacttagtatattgccataagatgatg

SEQ ID NO: 218190 - DNA, 685 bp, Homo sapiens
tctacttttctatccttgagcggccagtaccacactctctgaattattatagcatttgttgttgttgagaacagggtcttgctctgttgcccaggctggaatgcagtggcaggaggatggctcattgtagcctcaacctcctgggctcaagcaatcttcccacctcagcctcctgagtggctgggactacaggagtcagctgccatgctcagcctagtatagctttttaataagccttaataggcgttctgtattgttcttcatgaatgttttggttattcttggccctttataattttatgtgctttatgtgaaattaaacttctgtatcttagtccgtttgtgttgctataaggaatacctgaggctggataattttgctcctggttctgcaagctgtgtaagaagcatggtgcacagcatttgcatctggtgagagcctcaggttttttccacttacggcacaaggtgaagaggacccagtgtgtccagatgacatgatgagagaaaaagcaagagagatgggaaaggaggtgccaggctgtttttaacagctagctctcagggaactaatggaatgagaactcactcagtgctggaaagacagcaccaagccattcatgagggacctgccctcatgacccatgcacttcccattaggcccacctccagcactgggtgtggt

SEQ ID NO: 218191 - DNA, 294 bp, Homo sapiens
aggtaaaccaccagctgtttcctgttctcccaagatttagtggggaagaaagggaagagaatctctaggggagaatcaagctagaattgctcaccactctaggcagaattcaatacttatcagaggcaaagacactctgagagcctgtgagtcccaaaagaaactggatccagctggacatggtggctcacacctgtaatcccagcttttagggaggccaaggcaaggcgggaggatctcttgagcccaggagttaaagacaagcctgggcaatacagggataccttgactctt

SEQ ID NO: 218192 - DNA, 389 bp, Homo sapiens
ggctctttgaggtcttttccagtaaaacagttacagtaaagctgcttggcagtgattttcctagacactttggctagtcatctcctgtgactgctgttaattaaatatggtttgtagctaagcagcctgtaaggagaagactatggaagtatttgcatattctctccttgaaaatactacctggtctttggctttaagttatacttttattttcccctgtagaataactattaaagtattacctatggtgattagactaagaagtaaaacatgaaatcagtcattgttggtgccctggtgccttcttttttttttttttgagacagagtctcactctgttgcccagatcgccccactgcacaccagcccgggtgacagtatttcatctc

SEQ ID NO: 218193 - DNA, 434 bp, Homo sapiens
cagcaacatgatgaacaaacaatgggagattctagcacaaaaaaagtgattggaggctgggcgcggctcacacctgtaatcccagcactttgggaggctgaggaaggtggatcacctgaggtcgggagtttgaggccagcctggccagcatggtgaaaccccatctctactaaattagcccagcgtggtggcacgtgcctgtaatcccagctactcgggaagctgaggcaggagaatcacttgaacccgggaggcggaggttgcagtgagccgagatcaggcccttgcactccagcctgggcaacagagcgagactccatctcaaaaaaacaaaagtggcccggctcagtggctcacgcctgtaatcccagcactttgggaggccgaggtgggcagatcacgaagtcaggagttcgaccaacacagtgaaaccc

SEQ ID NO: 218194 - DNA, 287 bp, Homo sapiens
gtagaacgtgcaagaaaagggcaaaggagtgaactgggagagagtcggaagatggtgttctgtactttgagaattttttgagattttaaattatttcttgagaaccaacttcgtccttgttcaagcatggaacgggtatgttcattctttgatttgttcaatcattcatttaatagatctaatttttgggaaggagaagcacatagggagccataagaatgttgaatgggaatccaaacatgcaggtgacttcagaaggtttccttgaggtcatgtttgaagccagt

SEQ ID NO: 218195 - DNA, 757 bp, Homo sapiens
caaccttgttgcgactccacatgggacatcctaattcagtccaggacagatatttttaatcaattactatagagctgaaaaacagagagagagagaaagcagccgggttgggcaagccgtcgacagtctgcgacatttttgcgcttcctgggagggaattcctccaagaagaggggtaaatgagaggcccacacgctggatggcaaacacaaacactgtcagatcagatggcaacctttagggttcctttacgatcagatcagtttaaatgaaaaaaaaatcgggtgtaatttttatcaccagggagcactggcctggagtatttccatttctaaagagcggttcccgctgtggtttcattagcatttggggctcatcctccctccccctcccttgacccacccccctccccccgccggacctctgccaggggcagaagagaaaacagccagttattatacaaacatcctcagtttggagctggagtgtctgctctggatacagtcgattctgacatcaattaaatatataaccagacacgtgcagtggcggggagggtcccctcacccagggtgcatctccagaaacgccgcctgcccttcccctctctttagctcagtgttgggagtttgaagatggcctcttcccgtcctgtgtgtattttccccttagcaattatactcctccactgaaatctatatgttccataccgctgctgcctgttactaataaaaaccgtctaccttgcactattaaa

SEQ ID NO: 218196 - DNA, 458 bp, Homo sapiens
attttggaatccccgaaagccttaagagggccagcgttaacatagtttcaaggaccagaatatgttgctagacaacaaccccacttgattcatttttgtctttaagtaacagggtgttttcctgtcatccagagtggagtgcagtgaaacaattatagctcacttcagcttcccaagtaggtgggaccacaggtgtgtaccatcatacccacactttgggtggctgaggtgggcagatcaccaggtcaggagttggagaccagcctggccaatgtggtgaaaccccgtctctactaaaaatacaaaaattagccgggtgtggtggcgggcacctataatctcagctactcgggaggctgaggcaggagaatcgcttaaaataggaacgtggaggttgcagtgagtccagatcgcgcagctgctctccagcctgggcaacaaatcgagattccatctca

SEQ ID NO: 218197 - DNA, 181 bp, Homo sapiens
aaaagaataataagacagaattagggagacataacttgctcaaaagtccttaatgcgtaggaaaatatgggaaaaacagactcagtttctcctgctttgcttccataatacaaatacttctgtgattttggatgtattgggttttcctctacacatcaaataaacaattctgcaacagaca

SEQ ID NO: 218198 - DNA, 210 bp, Homo sapiens
tgtgagaatctgatgccgccaccggcctgacaagaggcagagctcaggtgttaatgaggatggagagtggctataaatacagatgaagcttcactcactcacctgctgctcacctgctgctgtgtggcccggttcttaacagaccaaggacgggtactggtctgtggcccagggattggggatccctggcctaccagatctgggtttaaa

SEQ ID NO: 218199 - DNA, 449 bp, Homo sapiens
tcttaacaactgcatcgttttccattcagtcctctgttgacattgaggtttccagttttccacattcgtgaatgatggtgtgcatctttgaacatgggtccttgcctgcctaagtatttttgtaggttgatcattgtaaacttggaaagcacaaagacagaagccaggcttgctgactcttgactgatgttgccccagtgatgtcactcctgcaaaatgcaaagcctgcgtcctggctgtcggagcatgtgtggacatttggcagcttctttctcttccctcctgctcttctgtttgttttgattgggaaggatatggagtggggatggagaagggtgttgagtaattatcgatggtttctgtatgtttattgctcctgactagcagtgctgggtttcttctctcagaggaaagctgaaagagattgctttgcttttttccagagtttt

SEQ ID NO: 218200 - DNA, 462 bp, Homo sapiens
tgggaacgaggatccctgctgctgactatttgttgtaaatctaaaacttttaaaaaagaatgtctattaattttcaaaaatattgtaaatatgctgaagagacatgaacatattttagaaaactaaacactgacaattcagaaaagtcttcagaattaactccgaaagttcagaaacacattaaaattatataaaaggtaggtcacaaaacaaatctgaataaatttaagactgaaatcataccaactatcttctctaatcacagtgaaatgaaactaaacaccaataacagaaggaaaacaagaaaatccacacatgtggaaattaaaaaacttactcttacccaaccaatgggtcaaagaaattacaaagaaattttttaaatatccggagacaaaaacaaaaacacaacaaaccattacgttatgagatgcaacaaatagtcagcagagggatcctcta

SEQ ID NO: 218201 - DNA, 466 bp, Homo sapiens
atagggcataggggcgggtgcctgtagtcccagctactggggaggctgaggcaggagaacggtgtgaacctgggaggcggcatttgcggtgagctgagattgcgccactgcactacagcctgggtgacagagcgagactccatctcagaaaaaaaaaaaaagaaagaaagaaaaagaagggaaattcccaatcagtgaaagaaaaaccccactgaaacagcagcaaaaaggacaaaatacctcagacgaaacattacaaaaaatgtacaagacttttaagaggaaaacttaaaaacactactaaaggttataaacaaaaagagatgctatgttctcggataggaagatttaatatcataaagacataaatttgttaatttaaaactaggccaatttaaacagaaagttttgtttttaacccagccaactcaatttgaaagtttatttaatgagagtaggaagggga

SEQ ID NO: 218202 - DNA, 772 bp, Homo sapiens
aatgccagaattaggaggacactgaccccccaacaggcatttttcccctcaaacgcttagaagtacctttctgaatacatctgtattatttgcatcaggagtttcagttacttcggctcatcacagcctgatagaaggaaatcgaaagcaaataattctagcactatccatcacgattaccttaggtatttacttcaccctcctacaaatctcagtactttgaggccccttttactatctctgatgggatctatggctcaacattctttacagccacaggctttcatggatttcatgttattactggatcaacatttctcactatctgcttcctccgccaattaaaatatcactttacaagatgtctgaataggaatagctccagtctgcagctcccagcatgatcgacgcagaagatggtgatttccgcatttccaactgaggtacctggttcatctcatcgggactggttggacagggggtgcagcccacagagggcaagttgaagcagggcggggcatcacctcacccaggaagcacaaggggtcaggggatttccctttcccagccaagggaagccatgacagactgtacctggaaaatcaggacacttttgcccaaatactgtgcttttccaacagtcttaccaaatggcacaccaggagattatatcccatgtctggcttggcaggtcccacacccacggagccctgctcactgctagcacagcagcctaagatccacccgtgaggcagcagcctggcaggcggag

SEQ ID NO: 218203 - DNA, 528 bp, Homo sapiens
ggttctaggacctcccaaggataccaaaattcacagacactcaaatctattatataaaatggggtagtatttgcatgtaacctgtggatatccttgtatatatttgaaatcatttctagattacttataatccttaatacaatgtaaattctatgtaaatagtggtcataccatgtttagatataatgacaggaaaaaaggctatatatgttcagtatagttgctgttttttttccctatgtatatttaatttgcctttggttgaatccatagatgtggaacccagagatatggagagtcaactgtacttatttccacagccccagtctgtaactccctgtgctgtttcttagcctaatgcttttatacgtggttcagaatgggcaatatgttctatatccttaggtgtacaaataagagtatgcactatgtgaggatatgtgttcatgtgtgcatgtgtgtgcacacaaacggtgtatatgggagtcagggagctgcctaaaacagattgacagtgggagttgggca

SEQ ID NO: 218204 - DNA, 168 bp, Homo sapiens
gaggatcccgtgctttcttggaggcagcaagtcacctgcagaatccttggatcaggggccctcatcctttttgctgagttcttgagcaagaaaaccctccagccaagtgtgccttgagccatgtggttgtccccaagggctccccttcttgttccagtctggctctgt

SEQ ID NO: 218205 - DNA, 528 bp, Homo sapiens
gggctcaagccacctcagtctcatgagtagctgagattacaggtgcacaccaccatgcctggctaatttctaaaattgttttttgtagagacagggtctccctctgttgctcaggctgttcttgaactcctgggctcaagcaggccacccatctcggcctcccaaagtgttgggattacagacatcagacatggtgccctgcttcatcctctttaagtttttatcagttttctggtatgagtatgatactttttcccaatttttaaccaaaacctgaaagttcttctattgccatattggtggccattgccacctcctttatagagtaagtcagtgtgccaacctcattatcagaagttggatttgtgctaggatagaatttgaccacactgaaaatcacaaatgagttctaactactattaaggaaaagaacaggaaaaagtattggcagggtaaaatatatctgaaacagttttttaataataggggtggctattattagattggttggggtgggagaaatggggg

SEQ ID NO: 218206 - DNA, 415 bp, Homo sapiens
aggaagaccaggatttacaccgtcttgtgcctaacgggagagaagagagggagccaggtcttccactcattttccatgtgctttccgtgggctgaaggcctaaccacgtgtggtcacaaaacccagcactgaaacagctgtcccctttcatctcggtccccacatgtcgaacactagattgtgtgtgtgttttcaatactctcttccagggagttcagaacacacgtgttccttttaactcctaccagaccctgagatctgcaggccaaaaggaccattctggaaggagtttggaaagatcaggggtcagctgttgagcaacagcctgagaatcaggaagcgcaggtctcccaggtcagcccctaactcactcaccctcagctgtgggggctccatgaccttgatgtatcttggt

SEQ ID NO: 218207 - DNA, 722 bp, Homo sapiens
cgagatggctcacacctgtaatcccaacactttgggaggccaaggcaggcagatcatgaggtcaggagatcgagaccatcctggctgacactgtgaaaccccatctctacaaaaaatacaaaaaattagccgggcgtggtggtgggcgcctatagtcccagctacttgggaagctgaggcaggagaatggtgtgaacccagggggcagaggttgcagtgagccgagattgcaccattgcactccaccctgggagacagaccaagactccagctcaaaaaatctcaataaacttaggctagaaggaaactttctcaacctaataaagggcatctactaaaaaccaactgtgattatgcttaatggtaaaagacaaacactttacctccaccccctgccaagatcaggaacaagggaaagatgtgtgctcttatttcttccatttaacacagtccaggttgagtaccctttatccaaagtacttgggaccagaagtgtttcagatttcaaagtctttcagattttggaatacgtgaattatatctaccagctgagcatcctaatatgaaaatcaaaaattctaaatgctccaatgagcatttcctttgagctttgttaactttcaacaaagactttgttgatgctcaaaaatgttttgggttttgcagcatttcagatttttgacttgggattctcaatctgtcctggaggttctacacagtgc

SEQ ID NO: 218208 - DNA, 406 bp, Homo sapiens
gaattgattcactttgcttggggtttttacccattgttatgacttctactcttttcctgagtagaaataattcaatcaggagttcaggaattttctgcccaagccagttcatccctcagtggcaaagcagactcccagaggcactcatttcatcccacacttgccttgaaattaaaagctccaacccctgagctttgtttgtgttttttgttttgcagaattttctctttttgtcatttcattaagcacactgaaaaaatgaggagggaatttttgaggcaggtggtttcagtcattgatgccatctgctcctgtgggcagacctgataagatttgcccacgtcgtcctcattgagtacgtgcccctttttttcagtccttgcagtgaaacatacttcttaaagga

SEQ ID NO: 218209 - DNA, 966 bp, Homo sapiens
ggtgacctggtcacagcacaggcttcttttgtgttctgatggtgatatttgaccaacaataatcacaaccactctgcacatttactatatgcaaatttctgttcatctctgatctcctttcctgcttcaaacacccagtgagcttggagttttaccaaaggggaaaccaggacttaggaagtaatgagggatgttgttgaagacttcttgtcattagaccaggttattggtccaaagtaatgaaggtaaatctagtccctgaggacaggctcactaccaggctataatgggaatttgtgctaattagagaaactttccctttctgctgcgctttgtcccaaggacccaaatttggccagtgttccccctctctataaccaaaatatgtcttatttccctctcttttaataccaggaggggtccctctactccagtcgaaagacaatctttgagtgctttgacccgaatacatcctcccacatctcagggtcccacaacttccccatcagggcccaaccccagcatagaagccattaaagctgacattcaacatcctttgtgattctgctactcttctaatgatggctggggcccaatcttctattctttctgccctgaggctccaggaaataagaataaggactcaggttccttccaaaacaccctatgatgtttgcgtcatctcctgggtcagtgctgagtcacggatttgttcatgtccctgcctgccagaagaggaaagacacgaaatagaagacaaacaatgtccccaatcatcagagatgtgtggaaggtgcatagtcacgtccactgaaaacttgctcacgcatgcacctgcagttgcacattgagggatcatgtgatcaaggacatttttcacaaaaccagtgtcattgtccacttaaattttaagtgttcaaatcactaaatttcataaagttattaaaataatttcctcatatcatc

SEQ ID NO: 218210 - DNA, 351 bp, Homo sapiens
caattttatgctattttcaagttaaaccttggtaacaacctcttcccaccttctacttacttctctcaatatattgctgtttaacatctactataccactttttgttctcatcaaagagcagatgtacatctcagaatttgtaaagataaatcagcagaaaagcaaaaagtcccttgaatgaatttccactacaaaatcaaaaccttataaatacatggttatgaaaagcactggagaaactaaatagacttggttagcttttaagaattatgggatttctcaagaccatcctggccaacatggtgaaaccctgcctctactaaaaaaaaaaaaaaaaaattagctgggtg

SEQ ID NO: 218211 - DNA, 519 bp, Homo sapiens
tcacccaggagagccagcagagcatttgtgtatgacataggacccccctaccaccacccttgactgttcaaactggagaagggctgaaaacacgtgggcagccaagcaccttttatgggtttctggaaggtcatctcagccacagcatcaagtacaccacgtgatgctcactcacagtatgagcccccatgaggaaagcaatgaccccaacactgagagcatggtagggtcccatctgctcccacatggcagacaggccccgaggaatgagcatgactgggtctgccaaccagatgcagatgcagggtggtatggttgaatcaggcagatggctgtaggatcaattctccatctcaccatttttttgttgggtaattctgattaagttagtgaacttccttagcttgctttgtaccatggagacaaaacatccacctcacacaattgctagagcatgcaggcgaggaaggacttgacatctattgtagctgataataaagacacactagtgctctcttc

SEQ ID NO: 218212 - DNA, 434 bp, Homo sapiens
atgtattcaaatgtgtgaatccatctaccaagaagaaatactacaaaattgaattgttcattttaaaaagccactgtgcactgttgttcttagtggtcataaatctctcaaaacaagactttgcatctttttatgatcaaagttaaagttttgctgtcagttcagccagtgacaggtttaatgtttttccttgttccttttttggggaccacctctttgactaggatctcttagagtatcaggatggggaaaaaggagggataaattaaatatgtgcttatatgttaaggaccaaaattgtaaacaagtcaaatctaagagtcggtatgagttatttcttctcttgtaattttgtttatttagataatcttcaattaatagattggtaggcaggatttgacaatccttttgtcatataaaagtgatattaaatt

SEQ ID NO: 218213 - DNA, 386 bp, Homo sapiens
ctctggtttctccttcccgagggcgggtgggactgccgggctgcactagggatccccgctccacgtcgccctctgcagccctctggcccctccactctccgggggttcctttccagcctcctctctgaccagctcctcccctcggaggataagtagcctctgggaacggacccggcgggaaggagacgcggagggaaactgagcgggggcgcagtccggggtgatcgcacgggtccttccagaagcctcccctcctctgaagcccacagtccacagccccccacggttggcctccgccccgcttaggctccatccccgaactcaccggccagcccggtcctgcaccagctggacagcaggagcagaagcgggaggcgtagaaggaa

SEQ ID NO: 218214 - DNA, 470 bp, Homo sapiens
gggcctactttttataaacactgtatccaggatagctttctttttgcctttggttgggatatgtgtaaggaaaataaatcttaggaccccaaatcactgagccaagggaaaagtcaagctgggacctatgtcaggcaccctgcctcccatttcattcctaaataagatagctacaaagataaaaagtgacatacctccctcacaatttgcccacaaggaaattcttggtggacaacggaaagatagaactccaagtctccttctgaggctcaccttagacaaatgcatatctgattgcttcctctgccctattgtttatgtaaaaatgaagattcactgagccagactatattttgtatccagtggaaggctcatcaaggactcaaaataatgcaaccttttgttttatgacctggaagcccccacctcaagttgttccgccttaccagaccaaaccaatgtacatctta

SEQ ID NO: 218215 - DNA, 562 bp, Homo sapiens
agattaacacacgtgaccatgtgtttgctttagtctgagtgtagaactcaaatttctgcagtatttaatttctacagtttccttctgagcagaaaaagaataccataaaaatatttgcaaacattatatatggtgatctagggtcacgtctccaagttctaagcttctgtggctccacgcacacaggttccctaatgtttactatgcatctgtcactgttctgttctattagattgccttaactataggcttgtcctaacgtaaccatccaaacctaaggaaggagaaacttaagtgactctgtgaacttagtgaagtgaccagatttaggaaggctaaaacccagaggaaataaaatggaaaacttgaaggtgacaaattaaagtggaaaaatagattaatttttttaaactttattgtcctgagaaacaaatctataaattcattaattttattttagagactatctctagattcctggaaatgaaggattcattatactcttagatcagatataatactgatttctgtgtatacgttaataaacttttttagaacaagt

SEQ ID NO: 218216 - DNA, 656 bp, Homo sapiens
acagaatttgatagaataatttttgacattttaatttgacaagaaacaattcagggaaacgattttagtcttgggcctgaagtggagtcttctcttgctgtttgtgatacttagtgtggggaatgcctttgaaacagcactttataaaccctgtgatccatttaatgtgatagttcaagctgcttggctgtttttttcataggagcctcacctaaaatagtctaacacagtggaaagatttttctgtattttagagggtaatgcagtaaattctaatctttgtgagaaaaacatagctttccagaaggacaataaatttaggtgtaaaatgtgtgaattgtatgctcctttatcctttaattgtattatagtctacatctttctaactcaaaaagtactctttgttttaaaaatatcccttcccacacttgaaaatggtagaataagactaattttagttacaggttctttgtgtgtttgtgtgtatatctctatataacagaaaacttacatttttaaataatgaagttaaagctttaaacaagtagagtatatacacacataaacatgcgtgctaatttgtttctgaaaaattatcttagaaatctgtgtttctccaagtatttggggggatatttaaatagccaaactagaaa

SEQ ID NO: 218217 - DNA, 433 bp, Homo sapiens
gagactcttaagagtgtttttgcagagttaaaatattaggtgtcgatcctcttttaaaatgtttgcctctaaggaccttgaccattccaattccagttccatccctacacttgtctaagctagcagggggaaaaatttttttgtttttggaggaatattttaattaacataactctgtgtgtttgtatatgtgtgatttttaataattcacaatagtgcatttagattgggggacagtaacctatattattaaaattcttttgcagttgtatataattgtaaattttattctttttcaattaatctgattttagttaaaataattactggagcattttagttacactaaacatatttcactagtacaactacatgattgtttaaatatactcctacgaacttactgggaaattcaaggaccatatgtttttct

SEQ ID NO: 218218 - DNA, 535 bp, Homo sapiens
accttgagctgcatccatgttgctgcaaagagtattacatgattcttcttcagtggctgcatagcattggatggtgtgtaattacctaatttttaaaatccatctgaagatttatgagcacatggtttcattccacatttttgctattgtgactagtgctgcaataaacatacaagtgcaggtgtatttttggaagaaaaacttatttgtatttgggtatatgcccagtagtgaggctgctgggtcaaatggtaactttagttttagtcctttgagaaatccccaaaatgcattctacaggagctgaactaatttgcattcccaccaagagtatatcagggttctcttttctacacaattttaacatctgtttttttttttcactttttaataatagtcatttagactggggtgagatggtatcacattgtggtttggatttacatctctctaatcattagaaatgttgatcaattttccatatgtttgatggctgctttttttgtcttttaaaagtatatgttcacattttttg

SEQ ID NO: 218219 - DNA, 704 bp, Homo sapiens
aaatccccaaatttttcataaactcagttttaaactaactttttttcaaaccacaatctgatttaacaatgactatcatttaaatatttctgactttcaaattaaagattttcacatgcaggctgatatttgtaattgtgattctctctgtaggctttgggtataatgtgttcttttccttttttgcatcagcgattaacttctacactctaacatgtagaatgttactacaatattaaagtattttgtatgacaattttatttgaaagcctaggatgcgttgacatcctgcatgcatttattacttgatatgcatgcattctggtatctcaagcattctatttctgagtaattgtttaaggtgtagaagagatagatatggtggatttggagttgatacttatatattttctatttcttggatggatgaatttgtacattaaaagttttccatggcagaaatcttttcaaaaactttttttttccgggatggattgaaggccctgatttcaccacaatgcaatatattaatgtagcaaaattgtacttgtaccccatgaatatatataatcttaagaaaatttttttagccaattattattacttactagatattaggctgtgttctgaatcttaatttaattcctccaaagaatcttatgaggtaggtaggagctattgctgctattctgttatgcttatgt

SEQ ID NO: 218220 - DNA, 341 bp, Homo sapiens
atatacaacacttaagtgcactatttaattttccaatggactttctaagcaatctaattttaaaatccatggtgtcacctgaaacaaaatcttatgtaatttttaataaaattatttatttaaaggaaatttacctgaatagcaaagaaaaattttcactcaaaggaagtatttaatactaaggcaactattaaactcataatatttattttaatttgaaagaaaaacataaaggcatgtaaaataaaagcatctaaatcttgcaagtccttcatactatcacataggtagtctaacatatatctcaacaaggcaataaacacttttcttgaaaactgata

SEQ ID NO: 218221 - DNA, 230 bp, Homo sapiens
cgcttgctgctgcatgtcgaatctatatgatccccctgctcacggtactcaaaggaagtatttaatactaaggcaactattaaactcataatatttattttaatttgaaagaaaaacataaaggcatgtaaaataaaagcatctaaatcttgcaagtccttcatactatcacataggtagtctaacatatatctcaacaaggcaataaacacttttcttgaaaactgata

SEQ ID NO: 218222 - DNA, 447 bp, Homo sapiens
gtatatcttcttgcatgagtggattcagaaacttcttgacagggccaaactgcaggatacaagcaatgtagacatagcagtagcctacctaggaatgaaaaaaatgaatagttttattaaattttattctacaactgtctatctaagctgattaattttaaacagtttctctgatgagaaataaattatatatttattggaagtgtcctcacaactttgtacttcctaaataataggaaaaatagttggacatgataaatgcttgtagtataatggtgtaattggatctgaagtactgcattaaagataggccatagcatcctcccatcagctttgacacttactctctcaggatcatgatttgctattctttataaggatcatttttcttattatcagtcaacatgtttacattggaatagacacactcttctattttagttatag

SEQ ID NO: 218223 - DNA, 285 bp, Homo sapiens
gcctgcgtctgggtccctcaacctgcctgcctatgtaaggacccagtggggcacaggacaggagatctggggcaccagtatttgccttcagcgtcagacgatctacacaggacaggaggcaggtgggaggactgaaggaaacagcctctgaaacggtcagtctggaggcagcaggttgagtgaactgtcacgctccaggggagtctttttctcttgcttctaaggggtggtggccaccaccccttagaagcaagagaaaaagaaaaaaggcaaataaatgcagaa

SEQ ID NO: 218224 - DNA, 91 bp, Homo sapiens
aataaagaatgtggtttatacccagttgatgaggaaaaactcttctttactataggatgccagctaataagtataaaataaaatatagaat

SEQ ID NO: 218225 - DNA, 545 bp, Homo sapiens
agaggaatttcctcatcagagctcacactgcagtcatgttaaggctaatccagtttcacccccattctttcttgggggcagtggttggagttggggaaacctcaggatctggcttcaatatttttcttatcatacacagggactatgcattacatatttttactctctgagtgaagtgatagaaaacagaagtaggttctcaaacagttaattgattgatacgcttggtcacaatgctttttaatgggaaacctgggagagctgtgaggcattgtttaatttagtttcattatggaagctcttgttctttttttgggtacttactatagttaacttttcctattttctgagattaaacttgaattaaatgcttaaaggagttctgttaggaagaacagagtaaaagaaacttctaatatgtatgggctgttgttgaatgaggcagaatataaatactttatgggttttaatttgttaatatataaattttactattaactgaacagttgcctattctctgttctgcttttttaattttatttaaa

SEQ ID NO: 218226 - DNA, 132 bp, Homo sapiens
acctaattgcctttccattactttcaacaaggagtgaatgtaggagggagaccaaaatttcaaaaacttggagaaagaaaaaggtatcccttttgtgttccgattaaaaaggcaaaacaggttcaatcccga

SEQ ID NO: 218227 - DNA, 605 bp, Homo sapiens
aaaggatgacgtggaaactcctgggtggggagaattgagagggcttagggtccatctgaatgtaggaggcacaggaggggaaggagttcaagtgatagcataaggctttccagatggttttaggagcagctgaaaggaacaacttgacaaaaatgtcctacttttagaccaacaatgaaataggttctaacctccagcaaagccttcagaagccactagcttatccttctgaaagaaatctattctacctaggttcttgagaaaagagccctcatttaacattaactctgacttaaacttgggtaaaatatagttttatcataggaatttttccgtggaaaacataatctttttagtaactgctgtacccatcccactgtccccaccttttaacttaagggagtgacttgggtttttatttttcaatctgaaaacttgggataacaacaccttcctcaaagagctgcttaagcttctggaaaacaatgaaatatgaaccacacacacacagctagaagaaggaaggttattaaggtttctgtactaatcaaatatgatgttagtggataagaaggaggtcggtgggtagacgttacagggacaca

SEQ ID NO: 218228 - DNA, 496 bp, Homo sapiens
taaatgtctcaaaacattctggcggaaaaaggtacagatgatatggaatgataataggccatctatccatgatatggcattcagagtttttcttgtttttcttttccatattggtaaaaattatggactttattcataatatccaaaaaatagaaacaaccaaatgttcatcaatgggtagatggataaacaaaatgtggtctacccagacagtgggatagtattcagccatgaaaagaaaggatgttatggccggcggccatggctcatgcctgaaattccagcactttgggaagctgaggcaggtggattgcttgagcccgggagtccgaaaccagcctgggcaacatggtgaaaccctatctctacaaaaaaaaatgcaaacattagctgggcatagtggcacaatccctgtggtctcagctactcaagaggctgaggtgggacaatggcttgagcccaggaggtggaggttgtagtaagccacgactgcacc

SEQ ID NO: 218229 - DNA, 432 bp, Homo sapiens
atcaattagaaccaactcttctttcattttttcacttggagcaagaccagatccgtaggaacaaaggtcctcatttccttctcactggagatgcctaggccactgctggttccatggtggactttaattcagctaggcctcatgctttcttccttcacatgcatgcaccacagtatttgtcttgaacttgagcctctggcttcagaattcagagaagacgcatgtggaccaatcacggtcacatcaaccctatggccattgtggattcaaagcagagttcctcttcttttatgtgtttttctgtatttgccaaattttctacagttatcatgtgttacttttgcaattagcaaatgcaaaccccaaaatagacaggatgaaagcacatactcaaaatgcagacccaaaccatgtacctaacattgtgatggg

SEQ ID NO: 218230 - DNA, 332 bp, Homo sapiens
  misc_feature (1)..(1): n is a, c, g, or t
  misc_feature (27)..(27): n is a, c, g, or t
ntaccgttatgtataaagaactatggntttaattgtgtcttaaatataatgcaagctatcacggtaaaattttgagttacttactaattcctaaaagtaagccaagtacagctttaattatttttcctaactttggtctaaaaatgacagtcaagatttaggtaggttttacataaaattctacagattcagtaaaatacactcagtaaaataaacctttggggaataaaacttgtttttcactgtaatacctttaacatgacttgtgtactttttgccaggctcaatactaactggtttatacggattgcagacagatgtcgatatataac

SEQ ID NO: 218231 - DNA, 321 bp, Homo sapiens
gatctagaggatcccagtcgaggttgtcttaaatataatgcaagctatcacggtaaaattttgagttacttactaattcctaaaagtaagccaagtacagctttaattatttttcctaactttggtctaaaaatgacagtcaagatttaggtaggttttacataaaattctacagattcagtaaaatacactcagtaaaataaacctttggggaataaaacttgtttttcactgtaatacctttaacatgacttgtgtactttttgccaggctcaatactaactggtttatacggattgcagacagatgtcgatatataac

SEQ ID NO: 218232 - DNA, 377 bp, Homo sapiens
agtaaaacccccactctcagggcaggtgccccatgtatagctgccttgccaagctggcctcagccttgcatcacaggcctgcatcagaggatgcaatgtgatactcactatcatgttccctgcagagctgtgtcgagaacagtgctgtctcctccagcacattgccttggcccctgtataagggcctgtaggagaaaagcccttcacacccaagaaggctggacttcccttaagctcttaatttattttcaattttgggtcagtgagaatcttgaaattaattggttctctttttgctctggccactaggaagctcagagccaaatgtatgtcccacttctgaaagtagtgtgctttaatatgggtatcattcggga

SEQ ID NO: 218233 - DNA, 1836 bp, Homo sapiens
  misc_feature (232)..(232): n is a, c, g, or t
  misc_feature (502)..(502): n is a, c, g, or t
  misc_feature (885)..(885): n is a, c, g, or t
actaatcatggaagcccagaggcgaaatcagcttcccggggacccagaaaattgctggagtctggcgaggggcaaatcaggaagtgtctttgtcggagatgggacggaacccggctttggggcgcaaccgggctctgggggagaccgcgtttgtccaggtggcaggccgcgccttctgatggctgtgaagagaaggagcgggggttttaagagccacagcgccaccgagagngtggaaaggagtagattagctcgcgcctgctatgcgaggcgactccccccgagacccacccgcagcccagcgcccttggccaggaggcccggaaagccaccgaggcggccgaaaggggccgcggggcacccctcagcccctcctgcggcggctccggctgcccctgctcagcctcccgctccccgcccggagtcccagctctcagatcggccgcagagctgggaacagaagccgcggggtccaggccgttccgcccgctcagccggagcngcagcgccgcctgccgggggcctcgcgcaggcgagacaggccagacgccggaggccgcgggcggctgcagctttgacgggccgaacacaccagcgctcccgttccgccttttgaaaatcaaatcccttgggcctggtgccaccatcgctcagcccaggtcttcgacgacgggtcgaaggccagtgctccaggccttcttcaccgagtggcttcggcgcttgcggcccaggttccccgcacctccgcgccgtagttgcgcgcaccttttgaaaagcttggcgtcttcaggtataaggacaaaaacaaccgcggacatcacaccattccaaagaagaaaaagaaagtgcccggaatctcagggcgcgacttccggggcgacgggnggcggcggagaggcgctcccagggcttcctacccggcaggaggccgcggcgccgggacctcgcctgccctcaccgcgcgccacctctcgggagacgccgcgaatctctccagggaatcccgggcagcggcgcagacccagcaaggaccggcagcaggccgagaccggccgtcttgggcgagagcagcgggacacgagcccccgggcgcccgctgggagcgcggggaggctctgggctcagggaagctgcgctccgagtggccttggaggacggtcaaggagcccgggccccgcggcggccgggagtggacgcgactggtccgcgccggccgcaggggaaggggcgggtcggcgctgcctgagctctatctgctctaatggctggggtagatccgcggagatacttgaataccaggccgaacgcttccccaaggcgtgttgtagacaacgggcccatttgagcatgtgcaaagaacaaatttcatccatttttctgtctaaaacattcaaagactcaaatctagacaatagtttctctgaggtagaagtgttgggggtgggggtgggtgggaataaactaaaagttggggtaatgagcttgtttcttgtctattttgtctgactatagatttacaaaaggagcaccctgctttactcagtaataccaggccctcctagaaacttacccaccagcttcacatggcatgatcatttgatgaatcgctttttagtttcccattccggacaaatatccacccaagagaaccaatcataacactggatgtattaacgcatgtcaagactctcacttctctgtagaaatgagaaataaatgtcgattgttggttttctgtagacttgtgatcacgcccaggaactgtcattttccagttaccagaatctgaatcattgtctaatgtgccacgtatataacaatatatcactaacagcg

SEQ ID NO: 218234 - DNA, 414 bp, Homo sapiens
tggcagtgaccctgcacctggctgtgaccctgcacctggctgtgacctgccctctctcagaggctcagccaccaccagggggcactcaggacatcaggagctgctcagaatcaccagacggcggctgggcgcggtggctcacgtctgtaatcccagcactttgggaggccgaggcgggcggatcacgaggtcaggagatcgagaccatcccggctaaaacggtgaaaccccgtctctactaaaaatacaaaaaattagccaggcgtagtggcgggcgcctgtagtcccagctacttgggaggctgaggcaggagaatggcgtgaacccgggtggcggagcttgcagtgagccgagatcccgccactgcactccagcctggggtgacagagcgagactccgtctcaaaaaaaaaa

SEQ ID NO: 218235 - DNA, 255 bp, Homo sapiens
gctagtcacttaggaaggttaggttatttatataagatttttttttaacgtaggcatttaaaagtataaatttccctctgagcactgctttcattgtatctcatagattttggtatgttgtgttttcatgttcatacatctctattttctaaatccccttgtgatttcttctttggcccattggttatttaagagtatgttgtttaatttccgcatatttgtgaattttccagtttcccttctgttatagatttc

SEQ ID NO: 218236 - DNA, 498 bp, Homo sapiens
aggactgtctgcctttagtttgctgcatgtctttgagagacagattccatctgttcatgagtcccactggcggattgtttaaactttcttatgaacattttcaaaagcccatacaaataaagagtatgtcaaccagcactttttaagatgaactgtaaccaactagcttctcacatgcttctcatatggtaagagttaattttagctcatgaaacttttggttctgtgaaacacctgctgaacagactcctgggaagggggtctgtgggagtcgacatttatacaaccttccaggtgattctgagcttatcagagctggagaggcacttgctacccaggggcttggtgtggaacgtgagatgccaaagccaaattcaggcctctcagctcaaggcaccctgaagcacagctagtcactccagcacatgttgaagctgtgcatgtttacttcatgttgaactgttcatgttttatttttggaacactggggattggcaa

SEQ ID NO: 218237 - DNA, 346 bp, Homo sapiens
ccaagcaaagatggccttgctgttgagtgagtgaattgcagctcatctctctgttgtgaccttgtccatttcatgcgaagcaacacttatgggtgggcccagtgcctgtttgctttcagggaaacagcacagaaatcaggatcagtaaatttgatgttgaagtctttttatcccttggactctcccatatcccactcaggtccccatcagcacattgtcacctcatccctgcaatggtctggcagctctgctgtgcctcaaagaggctctgacaagcctcgctgggatgtgcaagccactgcgcaaggctaataatttggtgattctttgaataaatattaaaaat

SEQ ID NO: 218238 - DNA, 485 bp, Homo sapiens
cagccattactgattcccaagttcatcactgatagcagtgatgagacctgtcttgctcacttggaggtaaagatactaccctcggcaatgatatttctttggactgctgcagacatttaattgggcactaagcctgatgctgttgtgaaggaagataaactaaagagcctttgtttatgaaaatattgtcaaagattatatttaaagtgagctttcattagggattgaatattttctaactctctataggatagaaatttccattgaaatacgtaaagctatttttaaactttcataatttgacttttttgtatattttcaggaaaatattatacattgaatctttctttccaggcattaaaatccttgaggactagatagtcacctatttttttctcatttctcctagtaattcacatatatactgtagaagagctataaatatactataaatatattgaataaaacgcgttctctctcatgat

SEQ ID NO: 218239 - DNA, 403 bp, Homo sapiens
tgattgggaacatgttgaccaaatgataaaaaatttcagctaaacaggaggaacaagttcaattattgtataattgactgtaattaataacaacatattatatacttgaaaattgctgagagagtagactttcagtgttcataccataaaaaatgataagcatgtaaggtaatagatatgttaactagtttgatttagccatttcacaatatatacatatttcagaacatgttatacactgtaaatattgtgtcagtttaaaaataaaattaaaaggtacttttacccctaaaatcaaatttattttacaatgatattacgaggaacttaactattttctgagtatcggtatcaccaatcccttgttgttaacttgagaaaaaaaataaaggtggaataatgc

SEQ ID NO: 218240 - DNA, 559 bp, Homo sapiens
agtactacctgtactactagtagtagtaattactgaatacttttcattaatttgttagatcctcacgaccaccccctatggtaattatattagtatctccattttatagatgcgaacactgaggcatatagatgtggcttatctgcttttatgtggtcacatagctgctgagtgatggagtgaagacttgaacccacactggtaactatcacaacaacccaaactttgcatctgtcagattgttggcagttggtaaggaccagggaaacagaaagcttcatgccctgctggcagaatataggctggtgcaggtgtcctggagataagcctgggaaagttgagctcaactaaggatgctttgacctgaggactgaagccctggtcaccaggggatgcgaacaagaaattgggtgcagatgaggtacatatccccacgggtatggtaagacaaaaggaggcatgtggaccacagaacaccaggcagctgcagtcaaaactgagacttagagggtcatacagcatcacaagcaagtctttaaaacataaggtaagttttttg

SEQ ID NO: 218241 - DNA, 502 bp, Homo sapiens
tgcagagcggagggcaggtataacagctgctttggaaagcactgagcccagagatgatagctgtgtgaggaggtcccttgatcccccagtctgggttcttaattatctagggcagggatgctatacaaagtgagttgttcctgaccccagggaatttttaaacaaggttcacctgcccagccacctctcctgagaagcctcatagacagagtcgactcaggagtacttaggctcttagtgaagatctcttctagaaaacggcctctggttttccttctttccaaaccaatcatttttttgtgaacaggaaaagacagagttattcccagtcccatctctccctgctgttacctgagcggaggaagtgatatctaagtggctgagttagcaaaggggaaacagctgtggtttctgccactccactgggctgctttctctgtccctgtgctgtcatttccctttggctggcgaggaagccaccctccccaagcctgggcggagg

SEQ ID NO: 218242 - DNA, 210 bp, Homo sapiens
ctggtttgtaatattggagagccatttgctaactacaggagtatgaaacagcatgactggttggagaaaaatcccataattaagagagatgagggctgggcacagtggctcacacctgtaatctcagcagtttggaagaccaaagtgggaagatcgcctgggcccagaagttcaagaccagcctgggcaacatagcaaggctccatctct

SEQ ID NO: 218243 - DNA, 170 bp, Homo sapiens
tgtacattatacaaatcaactctcctcccctgcaaaagtaacctctatactgctttttatagtaataacttcctagagttcatcacagctttatcacccaagtgcataccactagacactgtaattgtccatttgtacattcatttttttactcaatgtattttttagta

SEQ ID NO: 218244 - DNA, 470 bp, Homo sapiens
ctttgaattgatctctttgttatgagcttggaataaagaaaaaaatgatatgtgaggaccaatttaaatagcacttggtatctgtattttaaacttataaaccatggtgttaactttcaaatgtgactgttcagctgccgtcctttatgcttatcatgtgtcttgggctttctaagcttgggtctgcatgctcctcggtgttttcccaggaatttcagtgacgctttttatgttacctaattgacgttgtcaaccatttaactgtgtagcgcgtgtgctttaacattccacttatgtttatacctggggtctgcaaagaggaaaacattcaagcttttaagaattaaatcacctagaaataatgattacagttcgatcatgagaggagggtgtgatggtagcaattcatctttaatgctctagtggcagtcattaaattttgtgaatagcaagtatttggcaccactttt

SEQ ID NO: 218245 - DNA, 382 bp, Homo sapiens
atttccccatgttggccaggctggtctcgaacttcctacctcaggtgatccgcccgcctcggcctcccaaactgctgggattacaggcgtgagccaccatgcctgaccctgcctagctccttttaatatcccccacaacttgtcacacactttatccaaaccagttccctgctctgagtctatagccatgactcactactgcctgtatttccagatgactggaattactgctccattccagactgctgccagaattaatgctattgctttctctgtaatactttgtacttttcaaaggatcataatttatctcatttgtgcttacaacccctttctataatgagagctgttcattcctatgctctcattcctatttcattgg

SEQ ID NO: 218246 - DNA, 473 bp, Homo sapiens
gaggtggcggagggattgcttgagcctgggacttagaggttgcagtgagccacgattgtaccactgtactcggcctgagtgacagagtgagaccttgtctcaaaaaaaaaaaaaaaaaaaaaagttaatggaataagaactgccaaaagcacatattatcttgtgggaaaatgttcataacattatcagatgaaaaagcaggttataaagcatagagtatggactcattctgtttgtgcaagggaaatacacacagaggaagaatatacgtcaacatggtgacaaaatgtagcagacgtctttggttgttggatcacggatgaatttctctatgcctttttgtctctcaggttttaggcattgagaatataatacttttattcttaaaaaattgctttggttttgtttcattttgaaaaggtgaaagggtatatagccgctgctggtaatttagccttgggggaggggaggaa

SEQ ID NO: 218247 - DNA, 438 bp, Homo sapiens
acaacaggttgtaggaatgctttgctgggattcccaatttgggatatattagaagtgaatatgtctttcaccaaaaaagaaactaaaaggttaaaaaagtggaatacaattacacactaaggtagtgtcaaagccagaattacaacttaagtctccaaaccaattccattttggaggcaaaagtcttcatatatgagtagtaagtacaaattgtttcatgtgctttgttcaaattgcaagaaacagagctgctgtcttcacactgccttaaggccaagtccaagggtactcctggagtcaggccttgcccctactgaagcacagggcccacttagggccatattctgcctcctttggcttggagagtcacagttcctcctactggccccaaatctgggtttctatcatggcaatggcatgatccggcactgccaaaaa

SEQ ID NO: 218248 - DNA, 431 bp, Homo sapiens
ctaatttttgtattttttgtagagacaaggtctcaatatgttgcccaggctggtctcgaactcctggcctcaagtgatcctccttgccttggccatccaaagtgctgggattgcagacgtgagccacagtgcctgacagtaatatttttttttttattagaaacataagaacccacctcaaagcttgggcttggaagtctatggaggctttatttattttagccacagacatggataagaggcaatctaagttaaatatgtgcactttggtaccaggccaacctgagttctaaccaaatttttcatgttttagatgtgagacaagttaatcttctaggccttacttccttcatgtataaagtagttattattacttaattcaacaaatattattagtcactcttctatgtgttggggtattccagtgaata

SEQ ID NO: 218249 - DNA, 224 bp, Homo sapiens
tgggcactctcaaaatctagaaaacactcaataattcacaaggccataaggcaatgttattatgaacagagcatacaaaatcagagtgacagattctcatatcaagggaagtagagaagaattttgatttttcagaagcatcaaggaggagtgaattcaataagaacggctataaaattcaggatccatatgtataactgaggttggatcagtgggcaagttca

SEQ ID NO: 218250 - DNA, 339 bp, Homo sapiens
gcactaaaatctcagaaatcaccattaaacaacttatccatgtaacaaaagaacacctgttcccccaaaactattgaaataaaattaaaaaaagatagcctcttctccattgtccaataacatgttcctcatttccatctgagatctcatcagagtggtcttactatctatatatttaccaactttctgtatgtaattacttttatattctctaagaagatggaagctttctatccagaaatcttttctttctgagcctttaccagaatcatcttcaaaaatttcttcatggcatcactggctttatctagcatgcacctcaaaactcttccaacttct

SEQ ID NO: 218251 - DNA, 491 bp, Homo sapiens
taatgctattgcacacttaataaactatagtataaacataacttttatatgcactggaaaccaaaaaattcatgtgactcacttattgcaatatttgcaaattggggtagtctggagcaaacccacaatatcttagaggtatgcctgtattatattctttaatcctctcaactcagtgaggtaggtactcttactagccctgctttacagatgagggaaacctctacagagaggttaagtgatttcccagaggactgacagctagtctgtggtggagctgggatccaaacccacatagcaggcttcagagtgtatgttcttaatcataattatacagaaaatctcaaattaatagtttcaatccattattttggatttttctcaagagataaacatatcatttgcaaataatgatatgtttcattctcacttttctttgccaatagtgttactactacttatcttggctaattatattggctagacatttg

SEQ ID NO: 218252 - DNA, 672 bp, Homo sapiens
ctggaatcaagcgattctgcctgcttcagcctcccttgagttaactgagacttacagagcacccgccccatgccccactgatttcggtattgttagtatagacagggttttgacatgttggccaggctggtcttgaactggcctcaagtgatccacctgcctcggcctcctgaagtgctgggattacagatgtgagccactgctcccggcctaggctagatttttaatcacagtcaaaattttcttctcaatctactgtgacttactattttaaaattccttttggattattatcagacactgctctgaaagttcatataatcacatttgttccctcccattgcccacaggtgtatgtgtcccttaaagaaccctgatgaatgagatgtaaaagccccttatcacagctgtgcctttccccagtgacggtgtacttctgcatgtgtgagtgtttccagtatgatcctctcctgtgcactctaccagccgtgaacctaggagccaccaggctataataggccaggagccaggcctccacctttctggtaaatcaaagtcacggtggccacccagtatccacaaccgaacatggtggtggtctatgtatgggagacccagaacaggaaagagaaagggaaaggagaggaagtggggaagtttggggcaggatct

SEQ ID NO: 218253 - DNA, 232 bp, Homo sapiens
tgtgccactgcagtccagcctgggtgtcacagtgacactctgtctcaaaaaaaaaacaaagactaagggtataggggaaaccattgtaggagaataaggggatcagattggtattttgaagttagaaggattactttggttttagagtggagtctagattggtttggtcaagactggaggaggattgagtaataatagaaaaactaggctggctgggtggctcatacctata

SEQ ID NO: 218254 - DNA, 162 bp, Homo sapiens
tatttcagggtaaaaaggaaacagatctcttcttatttctgcaactcccagcacagctgcaaagaatacatcaggtgggatatgaaagttaggaaatgctcaatggagcagctgctttttgcttaaaatctccacctctgtgttgcttagatttgaacccaa

SEQ ID NO: 218255 - DNA, 417 bp, Homo sapiens
ttgtaacactattatggctcatctaatttcatgcttttctggcttctgaaaatttcatttgcgaggcatacggccagagtcccagctacttgagcagctgaggcaggaggaacccttcagcccaggagttcaagcccagcttgggcaacatagtgagagactccctcccttttttaaaagcacacaaacctgatttgtggttgctcttccctttattcgccattgctcctgttgcttcatggcaactcatatgtttctaactgcaggagattggaagtccttgtggcctctccacatcactgctgcattgaccactctgtcctgttttaaacacactcttcctttgccttctggtttctttcccccaacccccagcccttccctgtgttccattaaaggctgttctcctcagcatgg

SEQ ID NO: 218256 - DNA, 321 bp, Homo sapiens
ctggtctttgaggggagggagactgaggggtcattttctcacctgcaccaacgtgtttattaaagctggcttgtggatcatttggaggaaaacccgcatctgtgactttcagatgaatggaagtcattttaaaaaacttttttttgtctattatggagaagttttgtccttgtgatctgtgaatacagtcactggagagcagaatgttgaccgtgtgagtgcttacagtgtacatacaaagtcacatcttcacaagtattacattaaaaagtgacaaataatagaaaactatttttctcattacaacctcggtaagaagct

SEQ ID NO: 218257 - DNA, 517 bp, Homo sapiens
taggatgaggtataggatacaaatctagttcttaggttgtattaagcatgatgggtacaagatactaggttgaggctcagtgtttacccaagatttatggagtgaagaattcagacaagcatttttctaaccctggactgtgaatccaaagatcctgatctacatttctaccaaaatgaatgcctgagactcaggttttttgtaaatatttgatcagttctcaaggaaatcttagaccaaaaaggagatgggcgtgagagagtaaagaggagcagtgacccagagtcagataaaggaaggtagagacatggaataggctcttcttatataatctatgtctgatttatgactctaagtattttgtaaggtattccagtataaaaacttaatctcttttactattgtgtatcttaaagaatgttttaaaatatcttttcataaattatagatattttggctaagataccctttgaagccaatatcatctccttttaaaatggaaaatgagcctcaaaaa

SEQ ID NO: 218258 - DNA, 484 bp, Homo sapiens
gctaattttgtattgttagtagagatggggtttctccatgttggtcaggctggtctcgaactcctgacctcaggtgatccgccctcctcggcctcccaaagtgctgggattacaggcatgagccaccacccccggccagcgagccggctgctttgtcctcagcgacagcctgtttcctctttgaatttatctttcaattcttttttctttttattttccccctttccacaggtgttaaagaatttctctttaaattcaatgtgacttgtagtatggtttatttatttatttatttatttatttattttttagacggagtctcactctgtggcccaggctggagtgcactggcgcaatctcacctcactgccaccgccacctcctgggttcaagtgactctcctgcctcagcctcctgagtagctggggttacaggcgcctgccaccacgcccagctaatttttgtatttttattagagatgggg

SEQ ID NO: 218259 - DNA, 941 bp, Homo sapiens
atgcagggggacctcaagaccactgacctccgcattcaggccccttccgccgacctggaggtccaggctggccaggtggacttgaaacttccagaaggccacatgcccgaggtagccggcctcaaagggcacctgcccaaggtggagatgcccagtttcaagatgcccaaagtggacctcaagggcccccaggtggacgtcaagggccccaagctggacctgaaaggcccaaaggcagaggtgatggcccccgacgtggaggtgtctctgcccagcgtggagacggatgtccaggccccaggatccatgctggatggtgcgcggcttgagggggacctgtccctggcccacgaggatgtagctgggaaagacagtaagtttcaaggaccaaaactgagcacgtctggttttgaatggtcgtcaaagaaagtttccatgtcttcctctgaaatcgaaggaaatgttacattccatgagaagacttccgcatttcccattgtggaatctgttgttcatgaaggtgatcttcatgatccatctcgcgatggtaacttggggcttgctgttggagaagttggaatggattcgaagtttaagaaactgcattttaaagtgcccaaagtttcattttcttctaccaaaactcctaaagatagtttagtcccaggtgcaaagtctagcataggtctttccacgattcctttatcatcttcagaatgctcaagttttgaattacaacaggtttcggcttgttcagagccatccatgcagatgcctaaggtgggttttgctgggtttccatcatcccggcttgatctcactggtcctcactttgaatcttctattctctctccctgtgaggatgttacacttacaaaataccaggtgactgttcccagagctgccttggcccctgagcttgctctggaaattccttctgg

SEQ ID NO: 218260 - DNA, 309 bp, Homo sapiens
agcagcaactgccacgatgacacttgggctggccctgtgttacacgtttcacgtgttttatttatttcatttaattctacaaccccctttgaagacaggtattctgttacccacatttgatagctgacttggcacccaaagagccagctcacagcaacccacattgtgtcagactaagaatcaaaaactatgggacctagaagtagactcccatcttgcagatcaaaaactgaagccgacagtgaagtggttgcctgatgtcctatgcaacgcataatttcagtatctcccctaatttccctctttctc

SEQ ID NO: 218261 - DNA, 570 bp, Homo sapiens
aagattatttattagattaatcagatatagaagagattcagatataagaggtcaaatcagtttcccagggacataatacatggctaagagagacagaacattaaaggacagcagggctggcaaatgttttctgtaaagggccagaataataaacattttaggcaatgtaggtcctatggtctctgtggcaactacacaactttgccatttttatcgtgaaagcagccacagacagtatgtaagcgaatgggagtgaccatattccagtatattgtattttaaaaaacaaacagatggtgggctgcatttggcccataggccctggttggtcaactcctgagacagaggcttgtccttttgccaaggaagatttataacacaaaaagccaaaagtaaaaccaggtggtggcatgaaatggaaaagctgaaatcaataagtaaaagtaaagctctccactaagtttcaaaaaccaaaggtaaacagtatgtaattggagagagaagaggtttcacataaaatgtctgctgaactggatcagggcaaattttattctgtaaatttaaaaagaa

SEQ ID NO: 218262 - DNA, 191 bp, Homo sapiens
agtttgagaccagcctgggcaacatagcgagactccatctctacaaaaaataaacaaaattaggctggtgtggtggcgagtgtctgtagtcctgtctactcaggaggctgaggtggaaggatcacccgagcccaagaggtcagggctgcagtaagccatggtcacgccactgcactccagcctgggccaca

SEQ ID NO: 218263 - DNA, 250 bp, Homo sapiens
cactttatccccctcgctgcgtggagggtggaagactgagcccagcagcttgaagctcagaggaccccaccccacctcttaagggcaaaaacgggataccgcccaggaaggtcccccaggccacccctcactgagctgagtcagatggcccagggacagatcctgggtctgctacttaagccctgtgcctcagtttccagaaccaccatacggggactggctgccatctggggaagtcggtgtcatgagc

SEQ ID NO: 218264 - DNA, 529 bp, Homo sapiens
gtcatttttagaatgttcctagtccatccaagaaaggctaaaaaatgttctgtgtgattctggacttaagaagtctttttcactgaattctggccctagatgctcactcaactagtaaccataatgccctgtttttcccaaatgctgaaatggaacatttactgcattggcaatgttttctagtgggattggttacagaaactgtcattcattcttactgtgcaatattacacagccataattaatgatgtagttaaaaacatttgatggcatataatatatacattgaatacattgtaagtaagaaaatatacaggttagaaaactgtaggtatagcatattgtaaaaagaaaatatatatacacgcatagcgaaaaatgtcaggaagaatataccaaaatgttaacgattatctttaagtagtatcatcttttttacttcttgtctttctgtctctcctaaaacttctaaaataaaaaggtattatttttcatgtaaaagtttaataaacttatgtgtccatttaaa

SEQ ID NO: 218265 - DNA, 969 bp, Homo sapiens
ctctatgaggatccgctagtgaacaaacaggaaacgactacatagaggaatgacatctaagccaagatgtaaagaacagataggatttggctagagaaggaagggccgtaagaatgttccaggtagaaggaagcctcagaggtttaaaagaatatattacatgtaggggtcctggaagctcagtgtaacaggaggagtttgagggaaggagaggcatcagatgactctggatggggaaacagggactaggtaatgaagagctataatgaaatataattccacttttctttttaaaacagatttattgaggtataattcacatcatacagtttacccctttaaagtgtacatttcattgtttctttagcatattcacagttatacaatcatcaccacagttgattttaaaacattttgtcacctcaaaaagaaaacctgtaccttttagctagcacccctccaactaccctagtcctaagtaactactaatctactttctgtttcatacagtttacctatttggatatttcatataaaggaaatgataacgtggtcttttgtgactggcttctgtcacttagcataatgtcaaggttcatacatattgcaacatgtatcagtacttcatttttattaccaaatgatatttcattgtatagatataccacattttatttttccattcatcagtaagtagacatttgggtcctttctactttttgtgactattacaaataacgcctctgtgaaccatgtacaggtttttgcatggacatacattttcatttcccttgcatatatacttagcaatgaaattgctgagtcatacagtcattgtatctttaactttttgaggaactatcagactgttttccaaagtggttgtaccattttccatttctgttaccagtataggagggttccagtttctccacatcctcaccagtacttgttatttgtgtttttgat

SEQ ID NO: 218266 - DNA, 1816 bp, Homo sapiens
gagaagtatactcattcaagtaaaggatcagtttcagggttcaggctgaagtgtcttaatgactagaattcaggttccaaggagaagcccacaaggctaagggtattggatataacggaaagtggaagctatacctgacttccagagaatgtggaccggatataagatcttaatcttctcttatcttactacagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctgcacatgctcaggacagcaatggaaatgttcccagcatgtatgccttgttcgtccagaattaattgaacaggtcaataaaggagactatggatggacagcacagaattacagccaattttggggaatgactttagaagatggttttaaatttcgccttggcactttgccacctagtcccatgctcctgagcatgaatgaaatgacagcttctttacctgcaacaactgatcttccagagttttttgttgcttcttataaatggcctggatggactcatggcccattggatcaaaaaaattgtgctgcatcctgggcattttccactgcaagtgtggctgctgaccgaatagcaattcagtctaagggtcgatacacggccaatctatcccctcagaatttgatctcttgctgtgccaagaaccgtcatggatgcaatagtggaagcatcgatagggcttggtggtacctgagaaaacgtggactggtatcccacgcatgctacccacttttcaaagaccaaaatgctaccaacaatggatgtgccatggcaagcaggtctgatgggcgaggaaaacggcatgccacgaagccatgtcccaacaacgtagaaaaatctaacaggatctatcaatgttctcctccatacagagtctcttccaacgaaactgagataatgaaagaaatcatgcaaaatggaccagttcaagccataatgcaagtccgtgaagatttcttccattataagacagggatatacagacatgttaccagcacaaataaagaatcagaaaaatatcgaaagcttcagacacatgcagtcaaactcactggatggggcacactgagaggagcacaagggcagaaagaaaaattttggattgctgccaattcctggggaaagtcatggggagagaatggctatttcaggattcttcgaggagtaaatgagtccgacattgaaaagttgattatcgcagcttggggccaactgacgagttctgatgaaccataacatatcattaaatttccataaggtcatgcctttaagtaaccccctaaattgaagtttagcaatatgacattcttggtgacagtggaatctttgtctcttcaccgtgttaacataatctatctattttcttattttcccctctggtctatgcttctgcttccttcatattactgagcattaacaacaccaataaaggacagcagagtccctaaatgtctttaaagttcccaggttgcc

SEQ ID NO: 218267 - DNA, 2471 bp, Homo sapiens
gagaagtatactcattcaagtaaaggatcagtttcagggttcaggctgaagtgtcttaatgactagaattcaggttccaaggagaagcccacaaggctaagggtattggatataacggaaagtggaagctatacctgacttccagagaatgtggaccggatataagatcttaatcttctcttatcttactacagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctggtaataaatttaagtggcacagaactgagttctactgtgtgtgtatgttttcttcaaataaaagaaatatttgtgaaccaaagtatacatttatgtacatataggcagaatcatacatcataagacatcatgtacctgtaactttgtataagcatatttaattttaagggattttgaaaatttaatcatgaatatcttttaatgtttgaggttgatgttcttggacaatgggtcttcatcatacaacaggtcttcattaaatgtacctcttaattataatattctgataccctaaggcaaattgtgttttttgagcacagtaactatataaaaacaggctgctttaaaaggactagcctgcagaaagtttccaaatacaagtacattgaatctactgtccaatttggcttgttttcaaacttcaacagatgtgtgatcatatcatttgttaattgcctggagtagaggattacagcatattgagtggtagctaacgtatgttttacaatttatttttgccaagaatcaaataaccatatggctaacattaatcaagaaattatgttttatgccttaacaatgtacaactctttttactaattgaaatatacttcataaagaccaagccacttttgtaattgtcatatctttgcagcacatgctcaggacagcaatggaaatgttcccagcatgtatgccttgttcgtccagaattaattgaacaggtcaataaaggagactatggatggacagcacagaattacagccaattttggggaatgactttagaagatggttttaaatttcgccttggcactttgccacctagtcccatgctcctgagcatgaatgaaatgacagcttctttacctgcaacaactgatcttccagagttttttgttgcttcttataaatggcctggatggactcatggcccattggatcaaaaaaattgtgctgcatcctgggcattttccactgcaagtgtggctgctgaccgaatagcaattcagtctaagggtcgatacacggccaatctatcccctcagaatttgatctcttgctgtgccaagaaccgtcatggatgcaatagtggaagcatcgatagggcttggtggtacctgagaaaacgtggactggtatcccacgcatgctacccacttttcaaagaccaaaatgctaccaacaatggatgtgccatggcaagcaggtctgatgggcgaggaaaacggcatgccacgaagccatgtcccaacaacgtagaaaaatctaacaggatctatcaatgttctcctccatacagagtctcttccaacgaaactgagataatgaaagaaatcatgcaaaatggaccagttcaagccataatgcaagtccgtgaagatttcttccattataagacagggatatacagacatgttaccagcacaaataaagaatcagaaaaatatcgaaagcttcagacacatgcagtcaaactcactggatggggcacactgagaggagcacaagggcagaaagaaaaattttggattgctgccaattcctggggaaagtcatggggagagaatggctatttcaggattcttcgaggagtaaatgagtccgacattgaaaagttgattatcgcagcttggggccaactgacgagttctgatgaaccataacatatcattaaatttccataaggtcatgcctttaagtaaccccctaaattgaagtttagcaatatgacattcttggtgacagtggaatctttgtctcttcaccgtgttaacataatctatctattttcttattttcccctctggtctatgcttctgcttccttcatattactgagcattaacaacaccaataaaggacagcagagtccctaaatgtctttaaagttcccaggttgcc

SEQ ID NO: 218268 - DNA, 2477 bp, Homo sapiens
cagtttccttcacaacaccctccccccatagttcattcacaccgagtactgacttttcttgactataagctgccttcaagatactgaaggttcccagtgtttgtgctaagcagggactcaggtggagagaactaaggtcaccctcagggaatttcttgctgaattaggttccactaagccttgaaatcaaaacgcttctgaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctggtaataaatttaagtggcacagaactgagttctactgtgtgtgtatgttttcttcaaataaaagaaatatttgtgaaccaaagtatacatttatgtacatataggcagaatcatacatcataagacatcatgtacctgtaactttgtataagcatatttaattttaagggattttgaaaatttaatcatgaatatcttttaatgtttgaggttgatgttcttggacaatgggtcttcatcatacaacaggtcttcattaaatgtacctcttaattataatattctgataccctaaggcaaattgtgttttttgagcacagtaactatataaaaacaggctgctttaaaaggactagcctgcagaaagtttccaaatacaagtacattgaatctactgtccaatttggcttgttttcaaacttcaacagatgtgtgatcatatcatttgttaattgcctggagtagaggattacagcatattgagtggtagctaacgtatgttttacaatttatttttgccaagaatcaaataaccatatggctaacattaatcaagaaattatgttttatgccttaacaatgtacaactctttttactaattgaaatatacttcataaagaccaagccacttttgtaattgtcatatctttgcagcacatgctcaggacagcaatggaaatgttcccagcatgtatgccttgttcgtccagaattaattgaacaggtcaataaaggagactatggatggacagcacagaattacagccaattttggggaatgactttagaagatggttttaaatttcgccttggcactttgccacctagtcccatgctcctgagcatgaatgaaatgacagcttctttacctgcaacaactgatcttccagagttttttgttgcttcttataaatggcctggatggactcatggcccattggatcaaaaaaattgtgctgcatcctgggcattttccactgcaagtgtggctgctgaccgaatagcaattcagtctaagggtcgatacacggccaatctatcccctcagaatttgatctcttgctgtgccaagaaccgtcatggatgcaatagtggaagcatcgatagggcttggtggtacctgagaaaacgtggactggtatcccacgcatgctacccacttttcaaagaccaaaatgctaccaacaatggatgtgccatggcaagcaggtctgatgggcgaggaaaacggcatgccacgaagccatgtcccaacaacgtagaaaaatctaacaggatctatcaatgttctcctccatacagagtctcttccaacgaaactgagataatgaaagaaatcatgcaaaatggaccagttcaagccataatgcaagtccgtgaagatttcttccattataagacagggatatacagacatgttaccagcacaaataaagaatcagaaaaatatcgaaagcttcagacacatgcagtcaaactcactggatggggcacactgagaggagcacaagggcagaaagaaaaattttggattgctgccaattcctggggaaagtcatggggagagaatggctatttcaggattcttcgaggagtaaatgagtccgacattgaaaagttgattatcgcagcttggggccaactgacgagttctgatgaaccataacatatcattaaatttccataaggtcatgcctttaagtaaccccctaaattgaagtttagcaatatgacattcttggtgacagtggaatctttgtctcttcaccgtgttaacataatctatctattttcttattttcccctctggtctatgcttctgcttccttcatattactgagcattaacaacaccaataaaggacagcagagtccctaaatgtctttaaagttcccaggttgcc

SEQ ID NO: 218269 - DNA, 2690 bp, Homo sapiens
gagaagtatactcattcaagtaaaggatcagtttcagggttcaggctgaagtgtcttaatgactagaattcaggttccaaggagaagcccacaaggctaagggtattggatataacggaaagtggaagctatacctgacttccagagaatgtggaccggatataagatcttaatcttctcttatcttactacagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctggtaataaatttaagtggcacagaactgagttctactgtgtgtgtatgttttcttcaaataaaagaaatatttgtgaaccaaagtatacatttatgtacatataggcagaatcatacatcataagacatcatgtacctgtaactttgtataagcatatttaattttaagggattttgaaaatttaatcatgaatatcttttaatgtttgaggttgatgttcttggacaatgggtcttcatcatacaacaggtcttcattaaatgtacctcttaattataatattctgataccctaaggcaaattgtgttttttgagcacagtaactatataaaaacaggctgctttaaaaggactagcctgcagaaagtttccaaatacaagtacattgaatctactgtccaatttggcttgttttcaaacttcaacagatgtgtgatcatatcatttgttaattgcctggagtagaggattacagcatattgagtggtagctaacgtatgttttacaatttatttttgccaagaatcaaataaccatatggctaacattaatcaagaaattatgttttatgccttaacaatgtacaactctttttactaattgaaatatacttcataaagaccaagccacttttgtaattgtcatatctttgcagcacatgctcaggacagcaatggaaatgttcccagcatgtatgccttgttcgtccagaattaattgaacaggtcaataaaggagactatggatggacagcacagaattacagccaattttggggaatgactttagaagatggttttaaatttcgccttggcactttgccacctagtcccatgctcctgagcatgaatgaaatgacagcttctttacctgcaacaactgatcttccagagttttttgttgcttcttataaatggcctggatggactcatggcccattggatcaaaaaaattgtgctgcatcctgggcattttccactgcaagtgtggctgctgaccgaatagcaattcagtctaagggtcgatacacggccaatctatcccctcagaatttgatctcttgctgtgccaagaaccgtcatggatgcaatagtggaagcatcgatagggcttggtggtacctgagaaaacgtggactggtatcccacgcatgctacccacttttcaaagaccaaaatgctaccaacaatggatgtgccatggcaagcaggtctgatgggcgaggaaaacggcatgccacgaagccatgtcccaacaacgtagaaaaatctaacaggatctatcaatgttctcctccatacagagtctcttccaacgaaactgagataatgaaagaaatcatgcaaaatggaccagttcaagccataatgcaagtccgtgaagatttcttccattataagacagggatatacagacatgttaccagcacaaataaagaatcagaaaaatatcgaaagcttcagacacatgcagtcaaactcactggatggggcacactgagaggagcacaagggcagaaagaaaaattttggacggagtctcactcactctgtcgtccaggctggagtgcagtgtcgtgatcttggctaactgcatcctctacctcccaggttcaagcagttctccctacctcagtctcccgagtagctgggaatacagacacccgccaccacacctggctaatattcgtatttttggtagagacgggtttcgccatgtcgcccaggctggtctcaaactcctgacttcagattgctgccaattcctggggaaagtcatggggagagaatggctatttcaggattcttcgaggagtaaatgagtccgacattgaaaagttgattatcgcagcttggggccaactgacgagttctgatgaaccataacatatcattaaatttccataaggtcatgcctttaagtaaccccctaaattgaagtttagcaatatgacattcttggtgacagtggaatctttgtctcttcaccgtgttaacataatctatctattttcttattttcccctctggtctatgcttctgcttccttcatattactgagcattaacaacaccaataaaggacagcagagtccctaaatgtctttaaagttcccaggttgcc

SEQ ID NO: 218270 - DNA, 981 bp, Homo sapiens
cagtttccttcacaacaccctccccccatagttcattcacaccgagtactgacttttcttgactataagctgccttcaagatactgaaggttcccagtgtttgtgctaagcagggactcaggtggagagaactaaggtcaccctcagggaatttcttgctgaattaggttccactaagccttgaaatcaaaacgcttctggtaggtaaatggagtacagatgggaaatcaaaccagtgtgtgactgggcatgatttagagcaactgttattgatatgacagatcctagcaggcaacctcatgagagcctggatgttcgtttcaatgcaggcagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctgcacatgctcaggacagcaatggaaatgttcccagcatgtatgccttgttcgtccagaattaattgaacaggtcaataaaggagactatggatggacagcacagaattacagccaattttggggaatgactttagaagatggttttaaatttcgccttggcactttgccacctagtcccatgctcctgagcatgaatgaaatgacagaatgattgaatgggctggcaagatggccgatcaagaacagctctggttggcagctcccagcgagaccaa

SEQ ID NO: 218271 - DNA, 915 bp, Homo sapiens
cagtttccttcacaacaccctccccccatagttcattcacaccgagtactgacttttcttgactataagctgccttcaagatactgaaggttcccagtgtttgtgctaagcagggactcaggtggagagaactaaggtcaccctcagggaatttcttgctgaattaggttccactaagccttgaaatcaaaacgcttctggtaggtaaatggagtacagatgggaaatcaaaccagtgtgtgactgggcatgatttagagcaactgttattgatatgacagatcctagcaggcaacctcatgagagcctggatgttcgtttcaatgcaggcagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctgatggacagcacagaattacagccaattttggggaatgactttagaagatggttttaaatttcgccttggcactttgccacctagtcccatgctcctgagcatgaatgaaatgacagtaagtgttccttctgattcacgtatgtgcatgtatttgtaaaagtgtgtttgtgtgtgcattaaaagcaattataaatcactaaaaaaaaaag

SEQ ID NO: 218272 - DNA, 866 bp, Homo sapiens
gagaagtatactcattcaagtaaaggatcagtttcagggttcaggctgaagtgtcttaatgactagaattcaggttccaaggagaagcccacaaggctaagggtattggatataacggaaagtggaagctatacctgacttccagagaatgtggaccggatataagatcttaatcttctcttatcttactacagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctgcacatgctcaggacagcaatggaaatgttcccagcatgtatgccttgttcgtccagaattaattgaacaggtcaataaaggagactatggatggacagcacagaattacagccaattttggggaatgactttagaagatggttttaaatttcgccttggcactttgccacctagtcccatgctcctgagcatgaatgaaatgacagtaagtgttccttctgattcacgtatgtgcatgtatttgtaaaagtgtgtttgtgtgtgcattaaaagcaattataaatcactaaaaaaaaaag

SEQ ID NO: 218273 - DNA, 1387 bp, Homo sapiens
gagaagtatactcattcaagtaaaggatcagtttcagggttcaggctgaagtgtcttaatgactagaattcaggttccaaggagaagcccacaaggctaagggtattggatataacggaaagtggaagctatacctgacttccagagaatgtggaccggatataagatcttaatcttctcttatcttactacagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaagatggacagcacagaattacagccaattttggggaatgactttagaagatggttttaaatttcgccttggcactttgccacctagtcccatgctcctgagcatgaatgaaatgacaactggtatcccacgcatgctacccacttttcaaagaccaaaatgctaccaacaatggatgtgccatggcaagcaggtctgatgggcgaggaaaacggcatgccacgaagccatgtcccaacaacgtagaaaaatctaacaggatctatcaatgttctcctccatacagagtctcttccaacgaaactgagataatgaaagaaatcatgcaaaatggaccagttcaagccataatgcaagtccgtgaagatttcttccattataagacagggatatacagacatgttaccagcacaaataaagaatcagaaaaatatcgaaagcttcagacacatgcagtcaaactcactggatggggcacactgagaggagcacaagggcagaaagaaaaattttggattgctgccaattcctggggaaagtcatggggagagaatggctatttcaggattcttcgaggagtaaatgagtccgacattgaaaagttgattatcgcagcttggggccaactgacgagttctgatgaaccataacatatcattaaatttccataaggtcatgcctttaagtaaccccctaaattgaagtttagcaatatgacattcttggtgacagtggaatctttgtctcttcaccgtgttaacataatctatctattttcttattttcccctctggtctatgcttctgcttccttcatattactgagcattaacaacaccaataaaggacagcagagtccctaaatgtctttaaagttcccaggttgcc

SEQ ID NO: 218274 - DNA, 1335 bp, Homo sapiens
gagaagtatactcattcaagtaaaggatcagtttcagggttcaggctgaagtgtcttaatgactagaattcaggttccaaggagaagcccacaaggctaagggtattggatataacggaaagtggaagctatacctgacttccagagaatgtggaccggatataagatcttaatcttctcttatcttactacagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctggtaataaatttaagtggcacagaactgagttctactgtgtgtgtatgttttcttcaaataaaagaaatatttgtgaaccaaagtatacatttatgtacatataggcagaatcatacatcataagacatcatgtacctgtaactttgtataagcatatttaattttaagggattttgaaaatttaatcatgaatatcttttaatgtttgaggttgatgttcttggacaatgggtcttcatcatacaacaggtcttcattaaatgtacctcttaattataatattctgataccctaaggcaaattgtgttttttgagcacagtaactatataaaaacaggctgctttaaaaggactagcctgcagaaagtttccaaatacaagtacattgaatctactgtccaatttggcttgttttcaaacttcaacagatgtgtgatcatatcatttgttaattgcctggagtagaggattacagcatattgagtggtagctaacgtatgttttacaatttatttttgccaagaatcaaataaccatatggctaacattaatcaagaaattatgttttatgccttaacaatgtacaactctttttactaattgaaatatacttcataaagaccaagccacttttgtaattgtcatatctttgcagcacatgctcaggacagcaatggaaatgttcccagcatgtatgccttgttcgtccagaattaattgaacaggtcaataaaggagactatgggtgagagaaatcttgctttgtat

SEQ ID NO: 218275 - DNA, 2425 bp, Homo sapiens
gagaagtatactcattcaagtaaaggatcagtttcagggttcaggctgaagtgtcttaatgactagaattcaggttccaaggagaagcccacaaggctaagggtattggatataacggaaagtggaagctatacctgacttccagagaatgtggaccggatataagatcttaatcttctcttatcttactacagaaatctggatggagaagcagtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctggtaataaatttaagtggcacagaactgagttctactgtgtgtgtatgttttcttcaaataaaagaaatatttgtgaaccaaagtatacatttatgtacatataggcagaatcatacatcataagacatcatgtacctgtaactttgtataagcatatttaattttaagggattttgaaaatttaatcatgaatatcttttaatgtttgaggttgatgttcttggacaatgggtcttcatcatacaacaggtcttcattaaatgtacctcttaattataatattctgataccctaaggcaaattgtgttttttgagcacagtaactatataaaaacaggctgctttaaaaggactagcctgcagaaagtttccaaatacaagtacattgaatctactgtccaatttggcttgttttcaaacttcaacagatgtgtgatcatatcatttgttaattgcctggagtagaggattacagcatattgagtggtagctaacgtatgttttacaatttatttttgccaagaatcaaataaccatatggctaacattaatcaagaaattatgttttatgccttaacaatgtacaactctttttactaattgaaatatacttcataaagaccaagccacttttgtaattgtcatatctttgcagcacatgctcaggacagcaatggaaatgttcccagcatgtatgccttgttcgtccagaattaattgaacaggtcaataaaggagactatggatggacagcacagaattacagccaattttggggaatgactttagaagatggttttaaatttcgccttggcactttgccacctagtcccatgctcctgagcatgaatgaaatgacagcttctttacctgcaacaactgatcttccagagttttttgttgcttcttataaatggcctggatggactcatggcccattggatcaaaaaaattgtgctgcatcctgggcattttccactgcaagtgtggctgctgaccgaatagcaattcagtctaagggtcgatacacggccaatctatcccctcagaatttgatctcttgctgtgccaagaaccgtcatggatgcaatagtggaagcatcgatagggcttggtggtacctgagaaaacgtggactggtatcccacgcatgctacccacttttcaaagaccaaaatgctaccaacaatggatgtgccatggcaagcaggtctgatgggcgaggaaaacggcatgccacgaagccatgtcccaacaacgtagaaaaatctaacaggatctatcaatgttctcctccatacagagtctcttccaacgaaactgagataatgaaagaaatcatgcaaaatggaccagttcaagccataatgcaagtccgtgaagatttcttccattataagacagggatatacagacatgttaccagcacaaataaagaatcagaaaaatatcgaaagcttcagacacatgcagtcaaactcactggattgctgccaattcctggggaaagtcatggggagagaatggctatttcaggattcttcgaggagtaaatgagtccgacattgaaaagttgattatcgcagcttggggccaactgacgagttctgatgaaccataacatatcattaaatttccataaggtcatgcctttaagtaaccccctaaattgaagtttagcaatatgacattcttggtgacagtggaatctttgtctcttcaccgtgttaacataatctatctattttcttattttcccctctggtctatgcttctgcttccttcatattactgagcattaacaacaccaataaaggacagcagagtccctaaatgtctttaaagttcccaggttgcc

SEQ ID NO: 218276 - DNA, 780 bp, Homo sapiens
cagtttccttcacaacaccctccccccatagttcattcacaccgagtactgacttttcttgactataagctgccttcaagatactgaaggttcccagtgtttgtgctaagcagggactcaggtggagagaactaaggtcaccctcagggaatttcttgctgaattaggttccactaagccttgaaatcaaaacgcttctggtaggtaaatggagtacagatgggaaatcaaaccagtgtgtgactgggcatgatttagagcaactgttattgatatgacagatcctagcaggcaacctcatgagagcctggatgttcgtttcaatgcaggcagaaatctggatggagaagcagtatttatctcaaagagaagtggacctagaggcttatttcactaggaatcacaccgttttgcaaggttgcttcaaagatggtcaacattatgaagagggatcagtaattaaagaaaactgcaactcctgcacatgctcaggacagcaatggaaatgttcccagcatgtatgccttgttcgtccagaattaattgaacaggtcaataaaggagactatggatggacagcacagaattacagccaattttggggaatgactttagaagatggttttaaatttcgccttggcactttgccacctagtcccatgctcctgagcatgaatgaaatgacagtaagtgttccttctgattcacgtatgtgcatgtatttgtaaaagtgtgtttgtgtgtgcattaaaagcaattataaatcactaaaaaaaaaag

SEQ ID NO: 218277 - DNA, 1058 bp, Homo sapiens
actaagagaaattgtctcgttagcaccagagaaatggaacaagaaatagagatggccgggcacggtggctcacgcctgtaatcccagcattttgggagaccgaggtgggtggatcacctgaggtcaggagttctagaccagcctggccaacatggtaaaaccccatctctactaaaaatacaaaaattagccgggcatggtggcaggtgcctgtaatcccagctactcggggggccgaggcaggagaatcacttgaacctgggaggcggaggttgcagtgaggcgagattgcgccatcgcactccagcctgggagacaagagcaagacttcgtctcaaaaaaaaaaaaaaaaaaaaaaagagagataaatcaggggtgttcaatcttttggcttccctgggccacattggaagaagaattgtcttggaccacacataaaatacactaacaatagcttatgagcttacaaaaaaaatcacaaaaaaagtctcttaatgttttaagtaagtttacaaatttgtcttgggccacattgaaagccatcctgggcctcatgcagcccatgggccacaggttggacaagcttgagataagtggtagtagagccagcaggatggcagaatgccacatttcatgacatgactctgtctttactcaccaaattcttagaagttttctctagtaaaattgatttgggagttgatttttatttacttattttttggtagatactggtgagacaattaggtttggggttcaaactgaggtaggacagtagtgaggcaacttctgtggattccaatgtctggaagcagaaatatgaggaaacatgccctggaactcaataggaaaagctctgaactttcacaagactgaaattatggttcaggttaaattaaacaggtctctagttgtgactgggtaatccaggactctgatcaagagaaaacaaaagaaatcagaaaatactattcagaagtctaacaactttcatgccttggcattcccaatcttttatttcagctagctattgctgtcgattttttgttctgttctca

SEQ ID NO: 218278 - DNA, 621 bp, Homo sapiens
ctacactctacctacaggaggctttacgacttatccctgcactgatcactaggtgatgtaacacttgtcttggctctgtctacacgggaattttcacatatctctacactgatcacctaagtgatttaacccttgtctaggttcagcctactggggatttctgacatacctatgcactgatcaccgaggtgatgtaaatcttttccaggctttttgtacaggggacattgtgatatatctctgcactgatcacccaaatgatgcaaatcttctctaggctccacagggagggggcattgtgacatatttctgaactgatcatccaggagatgtaactattctccaggctttgactaaagagcgtcggaatgtgctgggagagcctcagtcggaatttcatggatggacaagggcacagagaggccagcgagttcccttgcatgtcagccacggtgcgcaatgagcgcaggtctagccaggaggctggaaaagagagctagaggtctgcgttccacaaccaggcactccatggtggtagctggcaggctgcagggtcacgggcgtgctggcgacggtggcggggaggcgcagaaggggcgagccgccagaggggtgtcaggc

SEQ ID NO: 218279 - DNA, 439 bp, Homo sapiens
taattcagtggctcagcaatattatcagggacccaggttctttccactttctccctccaccatccttatgtgtgttggttttgctcccaagttgactctgttttcccctgagtcataagctggctcacactattccaggcatcactcagggaaaaaaaatctccagcaaaagaagagtttttttcttcctgtgtgtctctttgtaacagaaaggaagccttttctagaagtctctccacagaattgcacttacatgtcattggacagaattttatcacataagcaaacttctgggtgtaactgataaatatctttattattttgattatagtgatagtttcacagctgtgttcatgtgtcaaattgtatgctttaaatgtgcacaagatattgtatgtgtcaatcatacttcaataaagctgtttcaataatttttgca

SEQ ID NO: 218280 - DNA, 346 bp, Homo sapiens
aatacaagattgaaccttagtgtaaactatggactttgggtaataatgatgtatcgatgtaggcttatcaattgtaacaaatgcaccactcttgtagcaaaggttgataatgaaggaggctaatcatgtataggtgggtaggagatatgtggaaaatctttgtacctttctcttaatttttctgtaaacctaaaacagattttaaaaacagtctttcatggggctgggtgcggtggctcacgcctgtaatcccagcactttgagaggccgaggcaggcggatcacaaggtcaggagatcgagaccatcctggctaacacagtgaaaccccgtctctactgaaagtt

SEQ ID NO: 218281 - DNA, 532 bp, Homo sapiens
attcgttatctatgaatttcatttaagggtaacaaaaaaatgaattacaaaatgcttcttctaaaaagaaatattaggtattccaggactgagagctgctgagttttcctagcctgttcaggctgctagagcaaaataccataaactggtggcttgtcaacaacaaacatttatttctcccagctttggggactgacaagtccaagataaaggcaccaccaaatgtctggtaagggcttggttcctggttcacggatggcaccttctcactctgtcctcacagggtagaacaggctagctagctctccaaaacctcttttataaggccactaatccactcatcagggctctgcccctgtgacctaaccacctcccagaggctccaccacctgataccattgcactgctgattaggtttcaacatactcattttggggagacaaatattcagaccacagcctggtttaattaaatgactgatgatgatgatgatgatgatgatgatgacgatgataaagccaaacaatgggat

SEQ ID NO: 218282 - DNA, 293 bp, Homo sapiens
attttctaggtcataggttatacatatcttccaaagcggttgtaccaatttacactcccatcagtagggtatgggagttttcccagttgctctgtgtcttcacttacacttggtattgttattaatattatctttaatgttttttgttagccattctgttgagtataagtggttttatttacattttcctgatgactaatgaagttgagtgcctttttatgtgcttattcaatatttgggtatctttttttggtggaattcctggttatttgcccaattaaaaaaaaaagctc

SEQ ID NO: 218283 - DNA, 530 bp, Homo sapiens
tagatggcgcaaggtgctggcaaagcgtaaagcagcagaccctgcgaggactatgaattggtacctcctctttggatggcaatgtggaagccatctaacacaatttaaaatgcaggcaccctttgagccaaccactgctcctctacaaattgattctgtgatattcctgctcatttgtaggagtgtttgttgtagcgttgtctttagcagtgagactagaaactgcttaaacgtacctccatagagggctggttaagtaaattaagggcacatacagaggaaaattatgcagccataaagaatgatgtgggctggcatgaaatatctccaagataaacttcaaagtccaaaaaggaacatgcacaacagagcagttagtgtgtgctgttgcatgtgtattagaaaacacatggttgggtgcagtggctcacgcctgtaatcccagcactctagaaggctgagacaggaggatggcttgagcccaggagttcgagaccagcctgggcaacacagagagacctcatatctac

SEQ ID NO: 218284 - DNA, 209 bp, Homo sapiens
agaaagagcctcactccccacactgcaacttgaaagacccaggacatccctcccacccccaggacagacagggttctcaccagctgggaacgcacagagcccgtgacaacaggaggatctgttgggctgggaacttcacatcccacccaccctgcctccaacttctttttttttctggccagattaaaagtcaagcttaaagtgctgtt

SEQ ID NO: 218285 - DNA, 399 bp, Homo sapiens
ggagatggatctatgaattttctcccctgagaaaccagacgggaccacctagagtcggtctccttcccccaaacgccctggacctaccatgggcacaagctggggctcagggaatacctctgtgctccaccactcagcagctgcttttcaagagaaggaaaacactactacacgccatccacagccaccgcacaatactgtatccctttgtcagggataataaaacagacgggaagtcactctggaacttactatggccttgggtcaaaggcaggctgaccggggctggcagaagaaagctaaaacttacttctctgggattctaggaatttcaacaaatgagaccaacagcagatagtttcagattaaagaaaggcaatgtgttcccaaactttgacc

SEQ ID NO: 218286 - DNA, 338 bp, Homo sapiens
aaaggttaattgactcactcaaggtcatgcgacgatctcctgaatcctagagctgggtgcttttcactgcccctaatgttgcctaatggttcgcttagctatccattcacaggaggtcagaaactgaacacggacctcagattccagtatcattttgactaaattatatataaaaattgatgtactgaataggatttgctttcaatctcactgttccagaaatagtcattcattcaacaaatatttattaagcactatgtgccaggaactgcacattttgcagtgatcaagatatggctgcacagaagactgacaataaaattagccttaaagagatc

SEQ ID NO: 218287 - DNA, 1047 bp, Homo sapiens
  misc_feature (267)..(268): n is a, c, g, or t
  misc_feature (277)..(277): n is a, c, g, or t
  misc_feature (287)..(287): n is a, c, g, or t
  misc_feature (345)..(345): n is a, c, g, or t
  misc_feature (387)..(387): n is a, c, g, or t
ttttatctagaatctagatatcaaacttttataatgatagttataacttagtcttggcaaatcaaattcagaattaaccaaaattcctttttgacctgaaatcaaaaacaaattagtttactaatttgtaaaaacatctttgtttttacttctctgaaacaaatgaagatagctggatttttttttcttttaagagatcaaagcaagattaagcatctcatacctatcttaagctgctcagaaccccatatcttttctttcattttnnttcctctgntaacatttgncaagaagattttataagtttaatatgtatacatgactacagtcatttattctcattantatcactagctataagtagtggactggttctgtgggagtttnttatatgatatcagagtttaaatgattcgtaattggtatctgagaatctcattccataggtcttttactcgtgtacagtgttgtcagattggggatatttgcttgatttttacccagattccttactaatatattttaaacaagtagggtaattattattattattttttttggtggggggtggttgagggggcggtaacttttgtcaagtatttgtttccttattgacaactcattgggttgttgtggaaattcaatttttaattatttttttttagcggagtctcactctgtcactcaggctggtgtgcagtggtgcaatctcatctcactgtaacctccacatcccagcttcaaaggattcttgtgcctccttctcccgggttcaagcacttagcctcctgagtagctgggattacaggtataagtcaccaggcccagctaatttttgtagttttagtagagacagtgttttgccacgttggccaggctggtcttcaactcccgggcttaagagatctgtccgaatcagcctcccaaagtgctgggattacagacgtgagctaccccagctggcccgaaattgaaattaagtagcacctagtacagatcttgggtatgtagtagctactataatgatttatgaaacattttatgaag

SEQ ID NO: 218288 - DNA, 3058 bp, Homo sapiens
  misc_feature (267)..(268): n is a, c, g, or t
  misc_feature (277)..(277): n is a, c, g, or t
  misc_feature (287)..(287): n is a, c, g, or t
  misc_feature (345)..(345): n is a, c, g, or t
  misc_feature (387)..(387): n is a, c, g, or t
  misc_feature (2171)..(2171): n is a, c, g, or t
  misc_feature (2316)..(2316): n is a, c, g, or t
ttttatctagaatctagatatcaaacttttataatgatagttataacttagtcttggcaaatcaaattcagaattaaccaaaattcctttttgacctgaaatcaaaaacaaattagtttactaatttgtaaaaacatctttgtttttacttctctgaaacaaatgaagatagctggatttttttttcttttaagagatcaaagcaagattaagcatctcatacctatcttaagctgctcagaaccccatatcttttctttcattttnnttcctctgntaacatttgncaagaagattttataagtttaatatgtatacatgactacagtcatttattctcattantatcactagctataagtagtggactggttctgtgggagtttnttatatgatatcagagtttaaatgattcgtaattggtatctgagaatctcattccataggtcttttactcgtgtacagtgttgtcagattggggatatttgcttgatttttacccagattccttactaatatattttaaacaagtagggtaattattattattattttttttggtggggggtggttgagggggcggtaacttttgtcaagtatttgtttccttattgacaactcattgggttgttgtggaaattcaatttttaattatttttttttagcggagtctcactctgtcactcaggctggtgtgcagtggtgcaatctcatctcactgtaacctccacatcccagcttcaaaggattcttgtgcctccttctcccgggttcaagcacttagcctcctgagtagctgggattacaggtataagtcaccaggcccagctaatttttgtagttttagtagagacagtgttttgccactttgggaggctgaggcaggtggattgcctgaggtcaggagttcgagaccagcctggccaacatggtaaaaccctgtctctcctaaaaatacaaaaattagccgggcatgatggcaggcgcctgtaatccccgctacttgggaggctgagccaggagaatcgcttgagcctgggaggcagaggttgcagtgagccgagattatgccactccagccttggctacagagcgagactccctctcaaaacaacaacaacaacaaaaacccaaatctcatccatttacccatatgtagcaggcaagaactgaatggcaagataccagggaagtggcatgatgacatggctgtttatttcaatacagttttgagacacaggaagtgttgaacctggctttgggtttgccacagaatactgagtctctatagataatatgggtaaaatttctttaggtgtatgtaacatgacctacttgctcagctaagagtgctgattaagtccatgttttcctagttattcaaaataatatatttctaagtcttatcctgtgtgaaaatggtttaaagttcttttttcttcaagttctcttcatagatatttccaaggagtttcctggattgtattcagtttacagggttctttcttagttattactataggagaaaagtgtgtttctgctactgcaggacatgggtgggaaggagtgagtacggacaggtgacacatcagagcccaggggatgtgagggggaaggaatgggtctgtgcagctgtacagcgtgatgataaggggtcggattcatgttgggtgagaagggaatccatggtgcagtgaagttccttagtgtggagtttcagagcccaagtgggatgaggttgacatctacaccagggaggtggtagctgcagagatagaagattggttacatatggaaggagagggattgataaatacagtgagggtgatgagagcaggtttctcatagtaataagagagttccaaatatggaaaggaagaaaactacaataaaccttgtggtattagataggaatattgtggttgtttcaattttaaaatattttaaattatcgaagtaatttataaataattttgaaacaatatagcttaaaatgaaggtatataagtttataaatggagccaaatattatgtatatactcctgaagtgttgccagactttgctgagctttgaaaagaaccatatggtccatggatttcctcggattatatgtaaatttgcatgtgtgtgaattttttttcgggagaaagaatgcatagttttcattaanttctcagaggggtttgtgatgcaaaaaatgttgaacttttttttatatatatgtaactgaggggactctgagtttatttttagaaatcctcctgcagcttacgttaatagagcatgtgtggcctaattaaatgtaggttttaaancagtcttcatatatatgaggaattaacattttattgaataccttttaatgcctagaagaaaaagtactattatacattgattcattttcacagcaatgatttattctcccaacaatgatacaaagtaattattatcctgttgtgctgatgaggaaactgagattgggattaaaaaggttgcccaatgttaaaaaactagcaagaggccaagtaaggtagtaggtgttctttctgctcctccacactcttatctccagtggagtgcctgctgtgttcagggcattgcacagggtgctggtgatgtaatactgaacacaacagactcttaccccaaccttgtaaagaatataggggaattaggtatagggaattttaaactattgagaatgcatttatttcagatattccttatattgctccatttgctcttttaagaatgctagcaatgtttattgtatttccttaagccacccaatacctttaggggaaaacacctattattcaaatgcacaagtgaggcagagtataaatgtgacttggctcattatcaccaagtttacttgcaggatcaaatttagaaccatggtttgtaatactttatattacacagtagtcatcagtctgcatagttaaaaaaaactaaacctgtaatcctagcactttgggaggccgaggcgggcggatcacgaggtcaagagatcaagaccatcctggccaacatggtgaaaccccgtctgtactt

SEQ ID NO: 218289 - DNA, 427 bp, Homo sapiens
cgtgtattagtgtctgtgtttgaaaaaaatcattcacacatggttttatatgtagggactgcctctgaagggatgtacacgaaactgaaaacagtagctgccagagaagtgatcagcaatccggctgggagatagagtaggaaggagacaggctttgtgccttatactattttgtaccctgtgaattttgcatcacgttggagatgcaaaaagcaactaccttgaaaagggcagtcgagatcaagtggagtaagatatttattcagcgcaatgttaattataaaaagtaaagtaagtagaaagaccagggtaggaactaccgaaaaacaaaccaaggaacagaaaagaaaaccaaaaaaacccccagaatttcatgtctggttttaggttgccacaatttaataatgaagaagggacagattataga

SEQ ID NO: 218290 - DNA, 462 bp, Homo sapiens
agagcaatgtggagaagcttttcaaggtgggagttctggtttggtttttaacttgagtaattcacagtgcacacccttatagactacatagacccaggtgtgctccgtggcagcacacacctcatgcagtagattcaacagacatgttgagcacctgcagcttgccacacgttgtctttgacatgttcaaacacattatcttacttaatcctcagaatattttacaacagaaattgcaagctgtgttttacagatgaggaaactgagtcagagagagctaaagcatgttggccaaaggcacaaggcaataaactagattccaagtctattacaggacagttgtcaggtcattgaaaaattgtgcttgatcagtattctgtttctgttcagtactatgataaattagcaatctttagaggtcatttagattgtgtttattccctacagagcaggttggtgaaa

SEQ ID NO: 218291 - DNA, 487 bp, Homo sapiens
tacccaggctcccccacctccctccactcctttttttccccctctttctttctcaccaggtggaggggaaataaatattgaggctggccttcattttagtacttaggactctggggatccctagtagaggttttagtttacctcttttcactgttgatttaatttgaagatactgtgcagttagccacagcgtgatgaggaagttgctttggtggtgcgcgggtgagggtgtttggtctgattagacctgcccaccttatttggagatcacagaattcaactgtggatttgccccttatctgggtcattctttcttctgatagcccacccaactgtcatttgcattctacctatatgtcataaatgtcccaccatgatggtggaaaaaactctctttatagtaaaacaataggcaaaactgacttattctaagctccttaaacacctttttctttataacttcaaaagtaagacttggctcttttta

SEQ ID NO: 218292 - DNA, 430 bp, Homo sapiens
tcttgactctcacctcctcctgagtccatgattcttgccctccattagtactgtttatgcctgcagcatggctgcctgctaccttctctgctttgctgggacttcctctttcaccttttacttagtcatgtgtactgaattgatgagaataagtgtccagttgctttagtttagttagctgtggttgatgttagatgggcagtggggtgctttaaagaaagagtgggtttgtagaaggtaaatctcttgcttgaaactccgtggcccttttgtttgaggccttatgttcacttagtagattattgctgcttcattatagttgttttctgtgtacattttggcctttgatcttacaaagatcaaattacttacaaagagactgagcagatatcttaatagtcagacaacaatacttcactcttggatttta

SEQ ID NO: 218293 - DNA, 465 bp, Homo sapiens
gttgcccaaaagcgtgagctgtgttaaagagtgatggcagaagcagccacaggcagggtgtgtcagaggagacctgttatggactcagccagtgtggcctgtgccagtgaacttcaatggccattctcagttttaacctgcattaagacttgagttgactttttatcacaagccttgaaattttggactatgtatatattataaatgtagacactagccacctaccttcagtgtagaataacattcttgaattgtttttccacccacagttgatccttgaacagcgtgggggttagagcagtcaacactccacacagttgaaaacccgcatataacttctgactccccaaaaacttaactgctaatagcctagtgttgactagaagcctgacccaataacataaacagccaattaacacatattttatatatgtattatatatggtattcttacaataaaatgag

SEQ ID NO: 218294 - DNA, 570 bp, Homo sapiens
gaccgtgtgatgctgattgggacaacctcccggccacagctggccgagatgcggggtctgtgccgggtctacgagcggatcctcttcatgccccggcctgactacgcatcccgctatgtgctctggaagcgtatgatagaggcccggggcatccagccgacccagcacctggacatcagtgccctagccaaggtctccgatggctacacgccgggtcacattctccaagccatccaatcggtgctgagtgagcggcggttcctgcaactgtccaagcggcccctggtggcctctgagttcctgggacaactggtgaagctggatccagtgtacagggaggaggaggagtccctgaaggactggtacttcaagaccccactgggcaagaagagcatgaaacacaggatggaccagttggaggccgaggaggccaagctggacaaggagaagaagaaaaggaagtgatggctaaggcttgcgggcacctgagattagtggcgtgggacagggcagtggcccaagggtaaagggatggggcagaggcataaatgcccagatgacttgggaaca

SEQ ID NO: 218295 - DNA, 573 bp, Homo sapiens
tgggattttgaagaacaaaaagtttttttcttacccatcctagtgagttttgaaagtgggcctgaccagaatgtctctttcccattttgccccgtttgaattaaatataatgtctactctttaaaggctgaaggggtgggtgaggggattgtttctcattttgtctcccaagtcatttttctgctgtgaaatatgaccaggcttgtaggaagactcatcttggagaaaatgtgaagtaatcaaattgcttgagattagtctcctattgtatattagagccaaaacacataataactttggcaacagggagttgtctagactcaattttcagaggtcccattgtagtgagttaatattgctaatcatgtcaatcacttgacatggaagtcagtggcaaatctttaaagtatgcatttgatactggcaaatatatactactgatgtttcacaaaagaatcttagaatctgtagaaaacattaattacttccatgaattatttctaaagtataactttaaagttttgatttttctatttaaataaaaagctattgatgtgttttagcatgtcctca

SEQ ID NO: 218296 - DNA, 496 bp, Homo sapiens
gaagcagatgccggggctacacttcctgtacagcctgcagaacggcaagccaattaaacttcttttctttataaattagccagcctcagttatttctttatagcaatgcaagaatggactgatgcagatcccaaaccaccttgtgtgtgtcaacattggcaagatgggttgagtggaagaaatatgtcagggattcatgagctcagaggtaaatgggggctgaagggaggtgcacaaagattgaaggtggaggcaagatcagcagctagggaagggaatacagagaacagaggcctgaccaggcagaagtttgtggtcctccatgtggccaggaggccaaatctcaactcaatgggccaggtattagtcacagaaaccagccaggtagccactacctacgttttccaggaaggtactttgaagctttctgttgggatagggacaatcccaagaacccaggctgtggcaagcttatgttttgcacatgggaagtagt

SEQ ID NO: 218297 - DNA, 403 bp, Homo sapiens
gcatccctctccctcttaggagtagtatcagagaagggctagtggggagcttaaactttcatcctcgcccaaaagtagaggagctcctcccccttcagccagtgtggtgtcagtgatcaacagatatcaacaaatgttggtgttatcatgcaaagattttaagacagttatcataaaaacactttaacacacaattacaatcacacttgaaactaatgacaaagtagaatgtaagtcttagcaaagaaactgaaaatacaaagaactgaatggaagttttaggactgaaaaatataataactgagatggacaactcactagataggcccagtagcagaatggagacaacagagtgaagttgaatacagaactgtagaaatcacccattctgaacaacacagta

SEQ ID NO: 218298 - DNA, 473 bp, Homo sapiens
cctgcttctagccaggactgtcccaagtatcctaacactctagttcttaaagtgctgtaaggaaggagtttctgcccccttagcttgctactccttcatgcatctcgtagaaagtcattatccactggcttcctgagtccattacctcttgttggatgagatggaggagatggagcggcaggccagccattgagtggaccttcatgttgtgcagtgcctgaagatggctgacaaagctgccatcagcttcctctgcagctaagaggaagggaagtcctcctggccttttaaaacctgtcctgtggtccctattgctgttttctaattgggctttccattctcattccctctgctccccaccccacttctgatttttctccatgattttccagctctagaagacaaaggaatgaatcactgcaatttactgggtttccaccttccttgcccagaatgtaggacagccacttttc

SEQ ID NO: 218299 - DNA, 520 bp, Homo sapiens
acagagacagggtttctctatattgccgaggttgatctcaaactcctggcttcaactgattctcttgtctttccaaaatgctgagattacaggatgaaccagcatgccagccaaaatgcctttaaacaattgtccctgactgggcacggtggctcacacctgtaatcccaacaccttgggaggccaaggcaggaggatccctcgagcccaggagttaaagaccagccggggcaacaaaagccatgatcatgccactgaacttcagcctgggcaacagagtgagaccctgtctgaaaaaacaaaaaacctgataaagggcacgttggctcatgcctataatgcgagaactttgggagaccaagaaaggaagattgcttgagcacagcctgggcaacatggtgagaccacatcttcacactcacacaaaaattagccagacatggtggcatgcacctgtagtcccagctactcttgaagctgagtggggagaatcacttgagccagggaggtcgaggctgca

SEQ ID NO: 218300 - DNA, 1100 bp, Homo sapiens
caggcaacgccagcgatgtggttctgcgggtgcaggctgcgggcaccgatgaggtccgggtattccacgcccaccgcctgctgctgggactgcacagtgagctgttcctggagctgctaagtaaccagagcgaggcggtgctgcaggagccacaggactgcgccgctgtcttcgacaagttcatcaggtacctgtactgcggggagctgaccgtgctgctgacccaggccatccccctgcacagactggccaccaagtacggcgtgtcctccctgcagcgcggcgtggccgactacatgcgcgcgcacctggcgggaggcgcgggcccggcggtgggctggtaccactacgcggtgggcaccggggacgaggccctgcgcgagagctgcctgcagttcctggcctggaacctgtcggccgtggcggccagcaccgagtggggcgccgtgagccccgagctgctctggcagctcctgcaacgctcggacctggtgctgcaggatgaactggagctgttccacgcgctggaggcctggctgggtcgcgcgcggccgccccctgccgtggccgagcgggcgctgcgcgccatacgctaccccatgatcccaccggcacagctgttccagctgcaggcgcgctcggcagccctggcgcgccacggccccgcggtggccgacctcctgctgcaggcctaccagttccacgccgcgtcgccgctgcactacgccaagttcttcgacgtcaacggcagcgccttcctgccccgcaactacctcgcgcccgcctggggcgccccgtgggtcatcaacaacccggcccgcgacgaccgcagcaccagcttccagacgcagctgggcccgagtggccacgacgcgggccgccgggtcacctggaacgtgctcttctcgccgcgctggctgcccgtcagcctgcggcccgtttacgcggacgccgcgggcactgctctgcccgccgcgcgcccggaggacggccgaccgcggctggtggtgacgccggccagcagcggcggcgacgcggcgggcgtgagcttccagaagacggtgctggtgggggcgcgccagcagggccgcctgctggtc

SEQ ID NO: 218301 - DNA, 484 bp, Homo sapiens
tgaaaggaaaacactgggaagcctcagggtggggcttccactgtgtttgcacccggacaatgaagctccaactcgatggccggtcccctgtggactctaatgtggactctaaaaaatctatcctgggaggtgggtaccgccctgaccccgccccacctctcggtctctcccgcaggtacctgtactgcggggagctgaccgtgctgctgacccaggccatccccctgcacagactggccaccaagtacggcgtgtcctccctgcagcgcggcgtggccgactacatgcgcgcgcacctggcgggaggcgcgggcccggcggtgggctggtaccactacgcggtgggcaccggggacgaggccctgcgcgagagctgcctgcagttcctggcctggaacctgtcggccgtggcggccagcaccgagtggggcgccgtgagccccgagctgctctggcagctcctgcaacgctcggacctggtgct

SEQ ID NO: 218302 - DNA, 954 bp, Homo sapiens
gcataaagatgcctaggagaggctactccaagcctgggtcctggggcagcttctgggccatgctgaccttggtgggcctggtcacccatgcagcacagactggccaccaagtacggcgtgtcctccctgcagcgcggcgtggccgactacatgcgcgcgcacctggcgggaggcgcgggcccggcggtgggctggtaccactacgcggtgggcaccggggacgaggccctgcgcgagagctgcctgcagttcctggcctggaacctgtcggccgtggcggccagcaccgagtggggcgccgtgagccccgagctgctctggcagctcctgcaacgctcggacctggtgctgcaggatgaactggagctgttccacgcgctggaggcctggctgggtcgcgcgcggccgccccctgccgtggccgagcgggcgctgcgcgccatacgctaccccatgatcccaccggcacagctgttccagctgcaggcgcgctcggcagccctggcgcgccacggccccgcggtggccgacctcctgctgcaggcctaccagttccacgccgcgtcgccgctgcactacgccaagttcttcgacgtcaacggcagcgccttcctgccccgcaactacctcgcgcccgcctggggcgccccgtgggtcatcaacaacccggcccgcgacgaccgcagcaccagcttccagacgcagctgggcccgagtggccacgacgcgggccgccgggtcacctggaacgtgctcttctcgccgcgctggctgcccgtcagcctgcggcccgtttacgcggacgccgcgggcactgctctgcccgccgcgcgcccggaggacggccgaccgcggctggtggtgacgccggccagcagcggcggcgacgcggcgggcgtgagcttccagaagacggtgctggtgggggcgcgccagcagggccgcctgctggtc

SEQ ID NO: 218303 - DNA, 472 bp, Homo sapiens
aaggacttttatttgagtgcataactctggtcaatgttcctttccttttctggttttgggtaaggttagggattaacttaatagcataccttatagaaaagtacagagttttgccaaaaacaactgcaagtgtaacagttacagcctataaatcagtccattcattggaaatccattttttattttgttttgctttataaaaagaaagattggacaaggatccagccctgtgcaatatagctgtgaacaacatagttattttatcaatcgtttgctcttgtggactcagtggtatgtccttgtagaattggaagtgtgtctgtgggttcctggtttcctaggcttccgttgcccccctggcctttggagagtttccagatgacatattcttgactcgtgttaatggcctaaatttgtctactgtgcaatttactagctggattaaaagtaataaaggtttttttttgtcgtt

SEQ ID NO: 218304 - DNA, 384 bp, Homo sapiens
gatgaattggcaaaagtacaaaaaaatctctgcagaggaccatttattccagcactattgtaacagtaagactggaagtaacccaaatatcatcaattaaaggcttgttgaataaactatggtttatctgcatatagaatactatgcagctgttaaagaaatgggaaatacatttacatatcattaatggtctccaaaacgtattgttaagtgaaaaacaaaactatcatggagaaaagggtgtatgtgtctttatttaaaaaaagtgaacatatcaataaaaattatatttcatgaagatatgcagggatatacttttggaaatgaagaataatccaaaatataaaaaataaaataataaaaattacattagctggaggaaga

SEQ ID NO: 218305 - DNA, 382 bp, Homo sapiens
ggctttgcaggccacacaatctgtcacaacaactcaactcagctttgtagtgtgaagcagccataggcaatatgtaaatgaaagtggctgtggccaagagtggtggctcatgtctataatcccagtactttgggaggccaaggcagaaggatcacttgaggccaggagttaaagaccagcacgggaaacatagcaagaccttgtctctacaaaaaatgaaaaacttagccgggcgtggtggtatgcacgcccagctagttctttttcttcaaaaagacgctgaagcaggaggatcattttaacccaggagtttggggctgcagtgagctgttgactgtgccactgtgttctagcctggacaatagagtgagaccctgtccta

SEQ ID NO: 218306 - DNA, 167 bp, Homo sapiens
actgccgatccaacaggttctctgtcctcatcacttttctctggacctgtttcccagattgtaaaatggggaagggaaggagttgaactctcgtccagacctagaatgtctttctccagtgctcaagttaggagcgtcttgctcttaaataaaatactttagggaaa

SEQ ID NO: 218307 - DNA, 424 bp, Homo sapiens
gcctccagagtagctaggattacaggcgcccaccatcacgcctggctaatttttgtatttttagtagagacgaggtttcaccatgttggacgggttggacaggtctatatttctttccgtgcttattttacaactggtatggtctgaatgttctccaaaattcatgtgttgaaatgtaatcgtcaatgtgatagtattaagaggtgaggcctttaggaggcgattaggtcctgagggcagagccgttaaggatgggattaggactcataaaatggtttgagggagtgggttcattttcttccactcttctgccatgtgaggacacagatttcattccttccctagcatacaacaataagccaccatttcttggaagcagagtagccctcactagatgtacaatctgctggtgccttgatctttg

SEQ ID NO: 218308 - DNA, 481 bp, Homo sapiens
agcaccgaatttacacatgaaatgatttaaggaacgaagagcactaggctttttaagccagaaggataatagccattattttaaccttatcaattggataagatcccgggggcggaagaggggagaaatccaaggaattgcagtcataacaaagcgtaatccgtaacatagataactggaattggaaaattagctactcgttcctggttcttctagtagattgtgatattactgaaataatttttatgaccagctgcatttattggagctatatttttttaattactgaataattgcacctcgatatggggcaagggaagaattttaggaaattgatttactttcattgtaataaaaattgtaagctaatgatgtgttgtgaaaaataattaaatcagtaagtatttattggatatttaccatattcaaaggactgtcctagtccctggggacagaaatgcaaaaatgaataaagtatttt

SEQ ID NO: 218309 - DNA, 535 bp, Homo sapiens
ttcaatctgttgcctaggctggtctcaaactcctgagctcaagtgatctttctgcctcagtctctcaatgtgctgggattacagatgggagctacctcaaccagccctggatgacttttaaatgccttaagagaaagacagtctgttccactgcaatttccccctggcctttcagatctctgggaatactctcaataagaacaaactttccctgaggactggacctggtgctggaggacaaagggaatgcccagggacttagtagttttcttctcatttaagacaacttccatctggtacatctgcaagggtgcttcagagtggaaggactgatggcaggttcctgtctaccactgaggcttttcccatgttcttagagggatagaggagggtgatggaacacactgaaatgggaaccccctgtccccacagaaaccatgatattctcctacactaacactagaaagtcccagaacaacataggtggtccccacagatgttctttaactaacttccttttttttttttttttttt

SEQ ID NO: 218310 - DNA, 467 bp, Homo sapiens
aagaaagctgagttctggaattagtaccatcacagtaattgctgcatatgagcaggaggtagaaaccagagtttgagaggctacctgaggtcaggctagtggaaagaaggtctggtgcagacggtgggagaagccgggcagaggaaactcggaaattcacagcaggaagctccacaaagaagagcgtccatgtgagtgatccattgccctgcccctcttgaaggagcagccccaacaccagggctgagcctgcccaaggtgatgggtggtgttaaatcatgcactctgtgcgtggagcccttcctcctggaatcctgactctgaagccctgtgtagcctctttccattcttcaccagctctaggatgtacctcctgcaactctcttctctccccttacgtatgaattccccccttcttctgaatcattccccttagcactccaacactatcatttctcctacctgca

SEQ ID NO: 218311 - DNA, 347 bp, Homo sapiens
tatttttctttctttcctctattagtttattccttaactcaggtgttaggaaaaacacaatctgattgaattgcatgaaaatgtaaatatctcctagcctttaaccttagagagatttgtattttaagaagaaaatcttggttaactcagattttttgggaatgatgtgaaaaactccagaacatagaggagaagattcaacactcaagctacacacaattttgagagttaaacgtgaatgaggcactagtgataaaagaatgaatagagacacttgtcaatgtgagtttttggtgtcccttaggagaaattctgtgcaataaagaggctatttatggcagtttgtt

SEQ ID NO: 218312 - DNA, 503 bp, Homo sapiens
aaagaagttaaagttaattattttaggagtggtgtggaatgatggcaaagtcagtcaggttttgttatgtcctttttgtagaagaaataagatttgctgttcttgtggtgcagaggttggcaaagtctgacctttgggctaaatctggcctgctctctatttttatatttataagcaaagtgttactgaaacagacacacctgttggtttgtaggatgtatattgctgcttttgccttatgatggcagaattgagtagttgcaacagagagtatatgagctgcatagatgaaactatttactctctggcccattacaaaagtttaaccctgatctagtgaagaaaaattacctaaatttttccaagttgaagacgatcaatgtatgaatttttatagaagtgttacattttttacaaagggtacgtcatatggttaaagctactaatttgaatctgtttcatttttcatttgatttctgataaaaggttatctttggagttta

SEQ ID NO: 218313 - DNA, 378 bp, Homo sapiens
tcatcccttccacaacacctgccagggcaggacaggttcctaaaccgcgtgtaagatgtgttcgtccaaactgcctgaccacaggaccctgctctgcctcttttctctgtcgtactcggggcctgctggcctgccacagagtgtgattatctaccacatctgtcatttacccgtctcacccaccaaatggcaagctctgcgaggcagttttagtcactgttgtaccccaagcacgtaggccagtggctacaattgactgatggagattttgcatgaggaaatggacacggtagcaggctgccctgctggggtactctgccgtgaagccgggtccatctggatgaatgaactcactgtgctctgtgttgctctgcagtt

SEQ ID NO: 218314 - DNA, 346 bp, Homo sapiens
tgtattccataaaaaatatgagagagtgcctgtttacctgcatccttgacaacagtgggtattatcattactaaagtaaaactaaaatggaaatcaggcttgaaaaattcctaagcaaacaaaatcaaaggccttaagaatagccttaatcttgctaaaattacaaacttaagtgaatcttactttaggtgataactacaaatataagcaaaacttaacttgggtcatttgcaataaatgcttatgttaggcagaattaaaacttaaccccagccaattataagcagccaactgttaacagactatgacatctgcaaaggaaaaagagaaagctttcttttctatc

SEQ ID NO: 218315 - DNA, 384 bp, Homo sapiens
tacccctctaggttctctggctggggctctgaaagagactgacaaaggcagattaacgagagaaaaacagacacgagtttattaccacgtgcatcacgcacacccatgggaacgtccgcagcctgactccatttgtcccactttccaatattccatgtggatagcctagaaccatctaagagataaggcacccagatcgcaaaccacaggactcggaattctctgcttgtctcctaattagaagccattgaagagtcagtggactgaatacaaattaaccattagatcaactgaaaatgtcaagtttagatgaatctgagttctcatttagatattttctggctgttggcccagccccacaaataaatacacatttgaaagtta

SEQ ID NO: 218316 - DNA, 432 bp, Homo sapiens
ctactctcagcatgtcagccagtcttctctggaagcaagttggctgccgtagtagctcccagcatcacatctttaagcatcaccatgtccaaagactgagaaagaactcgttacttcctgagtcccagaatccctctagcagattatccctgaggattaattgtccagaactgtatcatatgcttagtcctaagcatggcaagacaatagaacaccataattggcttagagcagcagttctcaaagtgtggtccttgtaccaagatcagcattacctggaaacttattagaaatgcacattctcaagccccaccagaatcagaaactcggagggtagagtagagctcaccaagttgtgtttttaacaagccctccaaatggctctgatgtagctcaaatttgagaaccactggtttagactaaccgaaagtt

SEQ ID NO: 218317 - DNA, 419 bp, Homo sapiens
cacaccctgtgtgtctctctgtcctgccagcactgagggctcatccctctgcagagcgcggggtcaccgggaggagacgccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagccaggaggcccaggagtaccgactgcataaagagggaagcccagagcccttggacagaaataacccactggaacccaagaacaaggccagattctccatcccatccatgacagagcaccatgcagggagataccgctgccactattacagctctgcaggctggtcagagcccagcgaccccct

SEQ ID NO: 218318 - DNA, 506 bp, Homo sapiens
aagttccccctcggctgtcccacctggcagtccctctaggatttcggccagtccctaattggctccagcaatgtccagccggagcttctttgggcctccgagtgggagaaaagtgagagcaggtgcttccccagcggcgcgctccgctagggcccggcaggatcccgcccccaagtcggggaaagttggtcggcgccttttctccccgacgaagccgctccagggctgctctcagaggacgcgcggcaggcaaagagaatgaacctgagcgtccacgaaacgtcctgcacggctcccgggagctgggagaaacaggtgcctttctccgacgtccgcgggcgacgcctgccgcaccttgcccgctgccgcgcccctcccgggcacccctcgccctcggcgcccctgcccccacccccagtgccagggcggaggcagtcccggctcgcaggtaattattgccagcggagcccgccggggagcgggggtgggcgcgccggcggtgggcg

SEQ ID NO: 218319 - DNA, 595 bp, Homo sapiens
tgccatgttgcccaggctggtcttgaatgctgcccactttggcctcccaaagtgctaggattataggtgtgggccaccgtgcctggcctatcagagtattttcaggcagagaaaagcataaggtcttacttctagcataaaaggaacattctggctgctatatagagaagggactgtagaggacaagaatgaaagcaggttgactgattagaaagcattgcagcattataggcaagagcttatgatggcctgaactagagtggtaactgtggaagagataaatggatgaattcagaatatttttggagaatttccttcctttttaagactgaataatatgccattatatatgtatactacattttgtttacccattcatccactgatggacacttgggttgcttccatcttttgcctgttgtgactaatgctgctgtgaacatgtatgtacaagtatctatttgagtacttgcttttaattctttgggtatatacccagaagtggaattgctggatcatgtggtaattctatgtttaatttttttaaggaattgccatactgttttccccggtagctgtaccattttacattccc

SEQ ID NO: 218320 - DNA, 420 bp, Homo sapiens
gcactgaaccaagatcccgccactgcagcctggcaaagagtgagaccctgtctaagaaaaaaaagaaaggccactgatcattgggagcttttggaggcaccgtgacaggcagggtgccaccaagcatgtgtggcctcccaggagctaagaccccagagttcttcaggctctgctgagtgcctcccatttgcacagcctctttatgctgttaggaatgaagaaaagtctaaactgaagctgccccaggcaggaggccaggttttctgcttcttgggtttactgaggctctgctttacctacagagtgtttggaaataaagagaagactggaaatctttgctcttgttagaaacactttgtgtttgtcccgctgacacctctgtgttggccttcccatccccaggtcccattaaggcacagt

SEQ ID NO: 218321 - DNA, 407 bp, Homo sapiens
tccagatgtgtctgtgagacaacacgttatggggcaaattgatttcacccttgggaaaccagggagattttcaaagttatgtctgcaaagccagctaatgcaattccccattagtgcattaaagtgcgcccttattaattcaaacataaaggcaacaaaataagcttttaaatttaaaatataatacatatataatgagcatgtgtgaaagccttattcaaatgaaaatacaggagtgtttgaactactgaggtatcttttgtattgaattatgagcatatgtaatagatttaattattaatttccccattgttctatgcacacagacagggttcaaggcacagtcattctctggctttcatagatctaatttgtataattattgcctgaataaaaaattgctccaa

SEQ ID NO: 218322 - DNA, 435 bp, Homo sapiens
gattacaggtgcctgtcaccatgcctggctaatttttgtatttttagtagagtcgaggttttgccatgttggccaagctggtctcaaactcctgacatcgtgatctgcccacctcggccacccaaagtgctgggattacaggtgtgagccaccgcgcccatccagtaactaattttctatccaacaaagatttaatataaccaataggcactattctgggtgctaggtaaaggtgatcaacttgtgtcttcaacttgcttacagttcagggagggagacagggtagtgtattattattataatttactgtggtaagtgctatgatggaagaaggcttgaagggccatgaagcatcaacaagagacgtactaaaagaagtacgccttacataattgctgtgatagctggttttttgtttttgtttttgttttgagt

SEQ ID NO: 218323 - DNA, 501 bp, Homo sapiens
atctatcttctctctctctctcaatcgtctgtttattggttgtttcaagcactgcggctacacaatttaaatacataatcttcacaacaaccctatgagccttgttatctccactccacaaattaagaaatgaggctaaagataataaagtaatttgcctaaggtcaaagagctaaatgcaggataaggttggaagtgtctatgtggttccaaagaacccaacacactgaaccactttgctaggctggcttgtcatgggttatccttccacatgacaaacaaatagagaattcattccagccaacacacgctgattgcacaaacataaaaacagatcttatagaaatatatatttgatgggcttccaggtaaagacttttgtacagcctatcatgatttactctggcctcaaaaacttgctttaaaagcccagaaaaaaaaagtgtgatgttaaaagtctttgggtcagttgggtaagaggacatcaccagagtggcaaat

SEQ ID NO: 218324 - DNA, 193 bp, Homo sapiens
aaacagcatggcaggcttcatcatacctaccttcagtgattgccatatatatgtgtatatccgcacacacacatatatgcccccacctccttggcaggacgagcactgagggtgaagaggaaacaacttcacatccccgcttcctcccagctgcccgcaggagctcagttttggtttgtgcagtgccctggcc

SEQ ID NO: 218325 - DNA, 443 bp, Homo sapiens
tgaacaatcaattgagataactatcttcagatcatccaagttccaatttcttctcagagcatctagtcaattaatcaccttgtaataggctgtaggactcttcttctacctggctattttggggggtcagtggtgctggtcagccctttcccgttgatagcactatctttctcttgttcagaattctgtgatttacatatggatgctcattattattattctctacttaaagaaaatgcatatcctttataaaatgaatagttttagatatcattaatgttcaatatattaataacgtgtcaaatgtttatttaaatcagacacatattcatcctttttatattgcagcttttcttatgtaaccttttacattgtaatgtacactttatattttttatcattaacttaaaatttataaataagaattattgcaattggtcata

SEQ ID NO: 218326 - DNA, 561 bp, Homo sapiens
cagtataatgatttgatatgtatatacattgtaaaataaaatatagtcaagttagtgaacacatctattacctcaggtagataaccagtttttttgtagtaagaacacttaaggtctactgttgtagcaaattgtaagcatacattacagtattactaactataaataatgctattttgctgatctaatgctgaatgtactttagatttttcagagttactcaagttacaactaaaaatttgtactctttgaacaacatttccgtattttccaccctcaggcactaacaatcaccatcaatcaatgttaaagtttttttgttttgttttgttttgttttgtttttgagatggagtctcgctgtcacccaggctggagtgcagtggcgcgatatctactcactgcaaggtctgcttcccgggttcacgccattctcctgcctcagctactagggaggctgaggcaggagaatcacttgaacccaggaggtggaaattacagtgagctgagattgcaccactactccagcctggagacagagtgaggatcttgtcttaaaaaa

SEQ ID NO: 218327 - DNA, 397 bp, Homo sapiens
gctagggaaagaaggcgcttaccaggccacctccacaggtgctgaaagaagccagcgagccagggtgccgcagcacagctccggtgtagaagcagcctgcgtctggtggcgcgggaggttgcggggcggatgctgcccccgtggggccggggccgggatttggccgctgttccactgcgaagcgcggcgccaggaagcggccgtctctccggagcagcaggtacaggtcccgagagaaggccgggatccgcagcaacacttcgtcgccatccggctcggcatgctgggccgggggcggggacgggggcggctgcgggggaggcggcggctgccacgaggccggggcgcccggggacaaggcggcagccccgctggatccccgcggcagctcctgcga

SEQ ID NO: 218328 - DNA, 471 bp, Homo sapiens
gggactccttaagacccacaagtgacttctgtctacactacagatgaactgaattgatcatctaaaatacgtttatagcgttcattgtgccagttgctcatggttctgctaattggcccaggactagttgtgatctgcagactgaagccagagtaagtaagagaattcaaggcactaagacaaccaggaacagttttaccaaggcaagtggaagctgctaggctcagtggttgcatgcctatagatggggtaaatcatcctggtgcaaatatggtattcacaccataaatgtgtagtgcaagtttcctctgtggccaatcacagggctgcaagctgaagccccagtttagcttattctccatacataacttcaaggggactttctggtgaacttttccaagaagctccaagcacagatggttcaaatttgcagtttggctagactttgtgactggatgtacattaaattaa

SEQ ID NO: 218329 - DNA, 748 bp, Homo sapiens
attttctgttgttatagacagaatttttttttgcatttaacacctaaacattatttttacttttctagtgaaaatgcaatctcatgttcgtgaatcgaactgcattgccagggatataatttttgcagagatttccagggcaccgtgcttagaacacaacctggaacctatgatttttatgcctttcaggaagacttctaactaaatattaatcttgcttcagcaaatacacttaacaaataagtatggcagtgaaggtacaaggtataatagagaaaggtaaatcgactgaagcaatgcaaaacacaacactgggagattctagtatagagaatgtactaggctttctggagaaccttaccatcacatgcttagatcttagctcctgatgaggtggtagaaggagacaatggggaaatgatttaatattaggaaaggcaagtgcctcgagacatttatttaagctaatctgtccttgatttttgactttcagattcattacacccagccacattagcctgcaccattaaaaacattgattcaacctctcttattggcatagacaatacatctgccttgttcactactctatcctcagcttggtatttctctagcacagaagaatggtccagtagatatgctgaagaaatacctgaatgcataaataaataagaaaatgagagactgaatgaatcaattaatacctcaagtgttaccctagataagattctagagaggggagattcta

SEQ ID NO: 218330 - DNA, 580 bp, Homo sapiens
attttctgttgttatagacagaatttttttttgcatttaacacctaaacattatttttacttttctagtgaaaatgcaatctcatgttcgtgaatcgaactgcattgccagggatataatttttgcagagatttccagggcaccgtgcttagaacacaacctggaacctatgatttttatgcctttcaggaagacttctaactaaatattaatcttgcttcagcaaatacacttaacaaataagtatggcagtgaaggtacaaggtataatagagaaaggtaaatcgactgaagcaatgcaaaacacaacactgggagattctagtatagagaatgtactaggctttctggagaaccttaccatcacatgcttagatcttagctcctgatgaggtggtagaaggagacaatggggaaatgatttaatattaggaaaggcaagtgcctcgagacatttatttaagctaatctgtccttgatttttgactttcagattcattacacccagccacattagcctgcaccattaaaaacattgattcaacctctcttcccgcgtacctgcccgggcggccgctcg

SEQ ID NO: 218331 - DNA, 199 bp, Homo sapiens
gctcttctcctatgccactctaggctttgccctatctgaggccatggggctcttctgttgaatgaccaccttcctcatcctctttgtcatgtgaggctctgtgggggtcacctgcctgtgcatgctgctgtgactccatgccattcctggttctgcggtgtgctaagctttaccattgaacacgtttctctaaaaaacg

SEQ ID NO: 218332 - DNA, 330 bp, Homo sapiens
aataaaagttacatgtatggcctgtaagtggtaagctccgtgatggtgtgcatccgtagtcttcatcattgccttacagtgtgtcatatgcattgtaggtactttatttattatttgcagagtaaatgaagtatcccaggtcagtaatttaatttttttgctctactacctgagtgatatttgtgagtgtgaatcatggtgttgggttagcatatttgcttaaaggacgtgtaagattaggagaatcgcttgaacctggcaggcagaggttgcggtgagccaagattgcgtcactgcactccggcgtggacaagagagtgagactccgtc

SEQ ID NO: 218333 - DNA, 494 bp, Homo sapiens
tcctctggaaaaccttgactggagtgttctttctacttgcttcagactatctgcttgctcacctctccactatgtaaacgtaacttactgtgagcgcccaggccgtctggctactacagataagcaccccagcccgggagcacagacgctgaacgcagccgcctgaccagaatgcagacaccagggcagataccattctgaagctgtggactcttccctttctggggaaatcagtgagttgatattttctatgttgccacagggagctctttctggcaaaggaaacggaaagaaaacgcaggatctcctcaccaaagcacagaatggggaaaaacaccaaagcctgggcagttgggcagttaggtacaaatctaccaagtgagcagacttaactaaaagggattgtgatgatctactccaacaatttcatttttaaaattaggaaacgaggccgggcatgatgacttacatctgtactcccgacactttgggag

SEQ ID NO: 218334 - DNA, 745 bp, Homo sapiens
tatgtatgtatgaatgatttctttgtttttttttattccagtcaaatgtttatgaaacctccagattgcctcgttaaatccttaaccttggtgaaatggtttgggaaaatgcaggtctgggctataagtttagctttttctttagtcactactttagatttcacagaataactggaagtgtacatggtaattttatagatctttttctttatggaatcctgtatttcttggcattagacgtcaacttcagattttgagaaggaatgtatttgctaagagtaatacagaaatgcttgttatgatatttctgtattaataacaagccatgctcaaaatgtggtttcatccagtttgaccattaagccctcagcactcagggacatgactaaaggcactcacatggaagaacggcagttcataacactgggaataaacaagtggaacagcgggaatcaggcagtgtgtttattgaggtacatcttcaggcagtactgggattagcaattaggtattcatatgaattcagtttgtgagaggattccatcaatggctcttcaaatttaagcagcaaaggccaccactaactcctaaaatatagtgatctttaataccagtttatttgaatggggaaaatttgccacacattttctcgttttcttcttcttgtaattttagagcagcaggagcattttaaaagttatactcaccaagcctgggcaaggtggtgagaccctgtctacatgaa

SEQ ID NO: 218335 - DNA, 365 bp, Homo sapiens
gaaggaggcattcagatttctccttccatccttaattatcccatgatgtctacctgctagcctctcatgacaaggaattgctgatttttcagaataagcaaaaatcatccttgtttaaacttatttatttattttttgagatggagtcttgcactgtcgcacaggctggagtgcagtggtgtgatctcagctcactgcagccgccgcctgccgggttcaagggattctcctgcctcagcctcccagctacttgagaggctgaggtgggaggattgcttgagcctgagaggtcaaggctgcagtgagccataatcacatgagcctggaagacagtgagaccctgtctcagaaaaaaaacgaagaag

SEQ ID NO: 218336 - DNA, 520 bp, Homo sapiens
ttcaaacactggaaaattgcttgacattttattgggaggcattgtcaattattagctaagattgttttgtcttctgaagaattggccctctataaaaaaatagttgtggaaggtgggcttttaacagaaaatgtaaagtctgttcagttcatactaattagtacatggaattatttaacatataggcaataatggctaaaaactgacatgaccatcagctttattttaggatgttttacaaacctatcacaaagcaacaactaattttttgttcatgtatattaattcatttggcctttacctggactaatatcatctgaaaccttcttttctttgaaacattttatgaaatgtatacacttatttttactttattatgtaagcaaagcaattttttattttccgtcccacaaattatgtgttcctttaaagatttgacattttgatgcagcaaatgttaagaaaaggtgtgagataaatgtctacaaaataaatgttttatacagaaccacggggcaat

SEQ ID NO: 218337 - DNA, 601 bp, Homo sapiens
tgcataattctttagtcttttttcccctaacttctgcctttttccattagtctaagtccatgttaccttcctctatagaaattctgtccagcaatagtgtttgcttcaaatgattgcttcttgctacggtgcgagaactcagtcatattcagaaaaccagatcttgctcataaaccataatcgtggaaatggagaagtgggtaacttgtcacataacacccctcccgcatacttactgacactcattaattgccaaagtagaggttttgttaacaactttgccagacactggttttattacttagaatgtctaatgagcaaagtttaaaatgccagtcattgtcaaaagagctattcaccattttctaccttaccttgtcagtaaactggctttattaagtggctcctataaatgctcctcacttgcatacttcaacttaatcaagaaaaatgctccattaataaataggcaagctacttctagagctcactgaagacagattaggagacttgaaattacagtagtatgttgttacccactggtttactgagtgcgtttctgtgtcataaaataaacaaaatgaccaggactttgaagcct

SEQ ID NO: 218338 - DNA, 560 bp, Homo sapiens
caagaggagcttgtcctatgctaataaagattctataacattggccaaagggtccgtttatacattctttgagcctggtggagcacgtttgctgaggtgatgtggtctcctcagtgtcactgtgaagagctcagtcaggaaaagccagcagcatctaccctgccaccctccaaaccttctgactttggggagactccagtcccccaggtctttacccagcctgcagatctcattctagcttaacaagggcatgcgtgtgcatgaagttgaactaagagtggaggaaggccagaggtagggttgggtgtgatactaggtagcagatattacagacttctgaatgcattcagatttccaaagggtttcctgagacctctcaaccaatctttctaggacaatagctagtgtaggggtctcctgactcaataggggacccaggccttcagataccagccactcactggctgctctgtgacgtgctatcttaagaccgtgaatggaagacaagccctatgtaaacacaaatcttaaagccactgttggctactcgagggcctcct

SEQ ID NO: 218339 - DNA, 957 bp, Homo sapiens
caagtgcttgccagccagtattttaagcattttacatgtgtgaattttttaacccttacaacaactcatcccaattttctgatgagaaaactggggtaaagagggatgaaattattatccaaggtaacaaaagtaataaatgacagagtcaagattggaattggaactcagtctgactaatggatttcctttctgaacacacacacaaacacattgctaggatcacagtttgtatctttgcatttccctttgacctttatactgagcatttcccatgttacttatttttcttctagatcataatttctaatgcttgcctaatggtctataccatgattaaacattctacattgtaggacatataggttattttctatctaatattttatgactgtaagttttgctgctatgaacattcttctcccaaaatacttgactgtgtccctgattatttgttggatcaacttttaggtgagttacagaagtaaagatatgaaaacaggctcttgaattagaaggtttgcaggagcacagtggacataaaagcagagattctggagtaagatgccccaattaggaaatgctgctctgctactatctgtataattcagttatgttatttaacctctctctgcctctattcctcatccctaaaataggagcaataatagtacctacctcatagagctgttaagtggataaaatcacttaatatacataaagattttagaatagtttcagaaagaagttccaagatggccgaataggaacagctccagtctacagctcccagcctgagcgacgcagaagacgagggatttctgcatttccaactgaggtaccacgttcatctcactggggcttatcagacagtgggggcaggacagtgggtgcagcccaccgagcgtgagccggaccagggtgaggcattgcctcacccgggaagcgcaaggggtc

SEQ ID NO: 218340 - DNA, 307 bp, Homo sapiens
agcccattgcatgagggcaccttttgctcccatgctctgatgggcacacggcggctttcgagggctgcaggccagagcaggcacctgacaaggctggtaacatacgcagccaaggctggattttcttcatagacttcaaccaacagcacatctcagcagatgaagtgctggagccgatatgggaatccagcttccactaagccggacaatacaaagattcgcaccaacgtagaaccacgccacttttctcaggcgggtttttcatttttaaaagtatgattgcttttcataaaacattatgctattt

SEQ ID NO: 218341 - DNA, 621 bp, Homo sapiens
gatcacttgagcccaggagtttgaggctgcagtgagccatgatcacactactcccctccagcctgggcaacacagtgagaccccatctcttaaaaaaagaaaagaaaaaagaaagaaatataattatgagttgcaaaacagtgctgggaggatgaggggctgcagaataaggcagagaaaaagaaggggctgatacttatcaaactgtatcaaaagggtttggtgcttaatgtttgcttatttgaaacagctgtgccattctctttcctttacaacctaacttctggaaagagtagtctgtacttatttttcccctttttttctacccaagtttttgccaccattccactgggcctcttcctgctgagctgatagagcctccttgtgtccacacacaccggacccatcagacctctgacagagcagttctcacctcctgggggttgcccctgtttatctgaggcccctggcgcaggcagagcacatggccccttccacagctttggggattcaagtgcagtttcatgtgaagggttccaccttcccaggccacaagtttttttatatctcatatccccagcttgaatagggagggaattctggacatggaaatcaccttca

SEQ ID NO: 218342 - DNA, 631 bp, Homo sapiens
tacttgcgcagaggcaaataagtaagaaaaacatatactgtgctatggttataagtgctactaagaaaaataaaacggggaggaaggctagggaagctggggaaaggggccgtcagtgtggccagggagggtgacatgtgagcaaagacttggagtagaggagggaccaagccacacggatacatgaataagcatccaagcaggcaccatggccttgggatgtgcctgtgttttcaagaaacagcaagggggacggggctgctggagagggagcatgtaggagatgaggcagtgggctgatcaggaggggactctgaggccactgagaagacttgacttttgctctgagtggatgggaggcactgaaagtttgcagagaagtgctctgttccaactgtgatctttttttattttaaataattgagatggggtcttgctatgttgcccaggctggtctcggactcctgggcttgagcaatcctcctgccttagcctcccaagtagcacttgccaccatgcctggctgtgatctttaaaagagttgcttggactgctatgccaagagactgggagatgcaggtgggaggggctggtcagggagctactgtggtgaccaatgtgaggtgacagt

SEQ ID NO: 218343 - DNA, 406 bp, Homo sapiens
gtcaagagaattcaactttttccagggctacagcttttctctttatgctccttttctatattttcatccattttctcatgtggaactggagtgtaccttatcttaagataccaagtgtctgacagccacatgttctgaggatgtctggtctcccaaaggtcagaatccaaaatcaaagaactaatcattatattcctacggggatctttaaccattttctaactacagaacatgttccaagaactgactggaaaacattttctgaactgtttcttgaggttcccaaatgatcagtgtattttaatgtaaaatcaatatatatttggggaggtaaaaaaacaatgtttaaaacatgtccgtttgagaaatggacagtagaataggaatccacttaagagggagaccg

SEQ ID NO: 218344 - DNA, 408 bp, Homo sapiens
ctatggatatggccatatatagataactaaatatactgatatactgagatttccacttagtaaacagtaattttgggcatgttatataatattggaggtttagtttcttcatgtgtaaaataaagataatgattgtgcataatttatgtgattgttggaagcattatatgaaatattgcatgtaaaagcttatttatttaatatttattcactgcctgttctgtgaacctagcatgtaaaagcttttagccaaattcctggcacatatttatgtcttcaagcattatttatcatcatcaacattattgctattgttatttctgctagtagcacagtactatgttgtagcacaatgttaggcatattgtacctgtgtgataatatttattgaatttaaaccgttggcca

SEQ ID NO: 218345 - DNA, 444 bp, Homo sapiens
caattgattcatgatcacctttttaatttgttgaagttgtggattactatttatattgtacttaacctttgcagttaaatgctggattactatacaaataccaactcagggccaggcgcagtggctcatgcctgtaatcccagcactttgggaggccaaggcgggcagatcatgaagtcaacagatcaagaccatcctggccaacatggtgaaaccccgtctttactaaaaatgcaaaaattagctgggtgtggtggtgtgtgcctgtagttccagctacccaggaggctgaggcagaagaattgcttgaacctgggaggcggaggttgcagtgagctgagatggcaccactgcactccagcctggctaccaagcgagactccatctcaaaaacaaacagacaaaaaaagcctcagtaataaatttaaacaaggattcccttgg

SEQ ID NO: 218346 - DNA, 462 bp, Homo sapiens
cactggcacagggaagaacgcagtccagaagtccttaaaaaagtacccattgttgaaccaggccctctgaagttagggccccacaagaacaaaattccacaatcccagcagtgctacctaatgtcgcctggctccccgaggtaaggcctcctgtgtagaaaagagctctcacagcacgcctgagacttctcttcctagaaaagcctgctgcaggggaaggagcagacaggagaaaataatagaatataccatttatgctgggaaatgcattgagtcaacttaattgctctacagaaaccctgggcttaaatactaacaccatgaaggacaagagtctgtgtctcccctcccaagaagacaaaacatggctaactcaaaaaccactggaaaagtgagtaatttcttatcaaagccaagccattcagtattatttctgtggctgccagtgttgtttcaaataag

SEQ ID NO: 218347 - DNA, 4873 bp, Homo sapiens
  misc_feature (3049)..(3049): n is a, c, g, or t
  misc_feature (3133)..(3133): n is a, c, g, or t
  misc_feature (3597)..(3597): n is a, c, g, or t
atggcccccgcccggggccgcctgccccctgcgctctgggtcgtcacggccgcggcggcggcggccacctgcgtgtccgcggcgcgcggcgaagtgaatttgctggacacgtcgaccatccacggggactggggctggctcacgtatccggctcatgggtgggactccatcaacgaggtggacgagtccttccagcccatccacacgtaccaggtttgcaacgtcatgagccccaaccagaacaactggctgcgcacgagctgggtcccccgagacggcgcccggcgcgtctatgctgagatcaagtttaccctgcgcgactgcaacagcatgcctggtgtgctgggcacctgcaaggagaccttcaacctctactacctggagtcggaccgcgacctgggggccagcacacaagaaagccagttcctcaaaatcgacaccattgcggccgacgagagcttcacaggtgccgaccttggtgtgcggcgtctcaagctcaacacggaggtgcgcagtgtgggtcccctcagcaagcgcggcttctacctggccttccaggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtggcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccggccaccctcggcaccagtgaacctgatctccagtgtgaatgggacatcagtgactctggagtgggcccctcccctggacccaggtggccgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcagccccgtcccaggtggtggtgatccgtcaagagcgggcggggcagaccagcgtctcgctgctgtggcaggagcccgagcagccgaacggcatcatcctggagtatgagatcaagtactacgagaaggacaaggagatgcagagctactccaccctcaaggccgtcaccaccagagccaccgtctccggcctcaagccgggcacccgctacgtgttccaggtccgagcccgcacctcagcaggctgtggccgcttcagccaggccatggaggtggagaccgggaaaccccggccccgctatgacaccaggaccattgtctggatctgcctgacgctcatcacgggcctggtggtgcttctgctcctgctcatctgcaagaagaggcactgtggctacagcaaggccttccaggactcggacgaggagaagatgcactatcagaatggacaggcacccccacctgtcttcctgcctctgcatcaccccccgggaaagctcccagagccccagttctatgcggaaccccacacctacgaggagccaggccgggcgggccgcagtttcactcgggagatcgaggcctctaggatccacatcgagaaaatcatcggctctggagactccggggaagtctgctacgggaggctgcgggtgccagggcagcgggatgtgcccgtggccatcaaggccctcaaagccggctacacggagagacagaggcgggacttcctgagcgaggcgtccatcatggggcaattcgaccatcccaacatcatccgcctcgagggtgtcgtcacccgtggccgcctggcaatgattgtgactgagtacatggagaacggctctctggacaccttcctgaggacccacgacgggcagttcaccatcatgcagctggtgggcatgctgagaggagtgggtgccggcatgcgctacctctcagacctgggctatgtccaccgagacctggccgcccgcaacgtcctggttgacagcaacctggtctgcaaggtgtctgacttcgggctctcacgggtgctggaggacgacccggatgctgcctacaccaccacgggcgggaagatccccatccgctggacggccccagaggccatcgccttccgcaccttctcctcggccagcgacgtgtggagcttcggcgtggtcatgtgggaggtgctggcctatggggagcggccctactggaacatgaccaaccgggatgtcatcagctctgtggaggaggggtaccgcctgcccgcacccatgggctgcccccacgccctgcaccagctcatgctcgactgttggcacaaggaccgggcgcagcggcctcgcttctcccagattgtcagtgtcctcgatgcgctcatccgcagccctgagagtctcagggccaccgccacagtcagcaggtgcccaccccctgccttcgtccggagctgctttgacctccgagggggcagcggtggcggtgggggcctcaccgtgggggactggctggactccatccgcatgggccggtaccgagaccacttcgctgcgggcggatactcctctctgggcatggtgctacgcatgaacgcccaggacgtgcgcgccctgggcatcaccctcatgggccaccagaagaagatcctgggcagcattcagaccatgcgggcccagctgaccagcacccaggggccccgccggcacctctgatgtacagccagcagggcccaggcagccaccnagcccaccccaggtcatgccagcggcagaggacgtgaggggctggcagcaggcagggcggccccaggcctctgccctcctctcnggtgctggaggagctgaaggcttcgccacaggacctggagttatcaggggtcaggcgcctgggaaggggcctttggtggccaccctggtgaggacacctgtcccccagggcaggcaccttctcttttccagagcctggggcctccacgtcacagagtccaacagggacatcactcgcctgcctctgtgtgcgtgcatgtgtgtgtgtggtggggggtgttctcacaaggtcatgggatctcatgtgaacagtgtgtgatcaagtgtgtccaccccttcgggtctcagcatggacgtgtgcatgttatgagcgtgtgcttatccgttaaggctggaggcacatgtgggtgatggtggatgatgtgtcatgaatgaggaggtgtgtgagcagggaactcagtgtgacaccgccaggtccagcacccatgggggcgggggagaggctcacccctacgtccccccacncctggaggctggagccaggggccacttctgaactgcaccagcaccaggcccaccctcgtctctgcctgggtgagcccaccccggctgtatctcaggtctgggtcctccctctagccgaggaggccacctgcagcctccacccggctctcaccgctgcttcaacaggaaaacagggttcccggtcagtccggctggccgccttcatggaggcatcatggcagagcacatgagatgtcctcagctgggcttggctgcctggccagggccgggggctcagcagcctcctctagcctctgatgccttccctccacggcccaggtctcctcactcaaagtcccttcgccaacctttcaatgcccagccctgacacctgccctttgtcccccaggcctaggatcagggaccagaggatcctatcttctcagcacccagcccaccccttcctgtagcatatggggagactaaggcctggagagaggggtgatgccccgtcccaggttgcactgcaaccaagtgtcagagtcggggctccggcctcctgccaaggctcttgtccccatacaccatcccacaagggcgctgggggtggaagtgccctggaagcccctcccctctcacactgacctccccccttacggcccaccagggtatgtaaatatctcttttctaccatgtcagaatattttttcctcactcctgacaatgcaaaaatggtcttcaaagcacataaaaagcacccagggtgagaaagccccatcccgggggccgttggcaggcagggaagcaggaaccccaccgtgtgccccctgccagccccagagggagtggcgagcccagctgcccagccctgccccccctccccatagccagcacagctatcccgcggggacaccagcactgagccccctctccctcctgcaataattcggggagtctcagccccatccaggtgccgcggccagctctctacacctctatatattatattactatatagccgagctgttcttccttcctatggaagtcggaaacatggtcagaacacgatctgggggggggatcctgtcttcctccccaccccaccccactcttacccaatttctgggctctggatcctcacagtcatggaggcaccgtgggcctggcacttgcaaaagtgtggcccctcactctagtgtgtggtccctctcagggtcctggggatctgcctctctgtggtctccatcctgactcttgaacttacccacaataagaataaattctgcctcatctttaa

SEQ ID NO: 218348 - DNA, 419 bp, Homo sapiens
ggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtgggtgagcgcgccatggcctgggcatgggtcagccggcagcggtgcttggtcttggcagggctgccagggtgtaaggggggacgtcagagcccacaggcacctgagtgacccacacagcccctgggaagatggataaacctccagtgttcctaca

SEQ ID NO: 218349 - DNA, 411 bp, Homo sapiens
aactctgtgtcactaaagtcaatactcttgaccaaggtgccctgttaccttgggcagattacttaatctttgagcatcgttgtcctcatctgtaaattgagcgaaataatacctaccccacagtgctcttgtgacatgtgattgagtgtgcatgcagagcatgtagcatagtgcctggcacagatgagcacccagaactgggagctgctctccatcagtatggtggtcctcccttgccctcacgactcatctatccatgactcttttgcccctctcatcattccttcagtctgacttcctcccttcatggagacaccagtcggtcagcactctgggcactgttgtgtgcacagccctcctcgggaaccaaggaaggagcggtaggaagaggagggacttactaccattctt

SEQ ID NO: 218350 - DNA, 182 bp, Homo sapiens
ccctcccaggcagtctggtcagtcagagggtgagaaggaggaaccaacaaaagctccatccaaaagaaaggaaaagaatggagtgggaagtgttttagactagcagaaacacctttcttgctatcagagttcaacacaaacaccttaaggggccaggcaagtaatgaaaatgagctggcaac

SEQ ID NO: 218351 - DNA, 583 bp, Homo sapiens
tgaattagaaagctatatacagatatgagctatttcagtcttcatttttctgacatggagctgtagtacaacttgaagaactttgaaatagtcttggagaaaagttcaagattgaaaattagatttttggtactatatagaaatactctgaaatagtttagatagttcctatattaaaatgacacttaaaatacttgtgtatttatgagaagtgagtcaagaaatgttactttttttctgataattagcatctgttctaatacttatgtaaggaaatgaggctaatttcctcatttatattaatctaatttcctagatttatattaaatctctcattatgcttctgcatatgtatttagagaagcataagaatatactatatattagagtttaaaatttagatctgtggtatatataaaccaaactatggtaaactcctttttcttttctttttatcataggcagtggtcagtagcctgtggtgagctgtttcagagtttttcgttttctgtatttttgacagatgatctatcaggaatgaagatatactgctagtacaaaattaattatatcatacatgcta

SEQ ID NO: 218352 - DNA, 204 bp, Homo sapiens
tacctgtgctctctcttgtaaaaaccagttttagcaagaaccctactgagtcagtttagcaagagtatccccacccttgatatctgatcaggttccttatccttcaccattccccaaattaattactctgattactctggccatcttcagcaagaatcattaggttgttttacccagaaaccccttactttgatgttactctta

SEQ ID NO: 218353 - DNA, 483 bp, Homo sapiens
agaatcgctgaacccgggaagcggatgtgcagtgagccgagatagcaccactgcactccagcctgggtgacagagggagcctctgtctcaaaaaaaaacaaaaacaaaaacaaaaacaaaacagaaaacaaaaaaacagaacctatttccccaggtcacggagtggttcttgacttgaacacagcaatcagaacacctcgggggtaaacactgcaccaaccctagcctgagagcacaagaggcagtgcctcctttttcctgcagccgggctgagtggccctgtgcgggggtcacatggggccatctgaagatgagcctgggctgaggagcagcacccaggggggcaagggaaaggaggaccctgctttatcctgccatgcgccttcttcccgggccacagggcactctcatgtgctgtgcctcagcccagcagactcttccacccagcttgctgcctcctcctctttcatatctcatcctgag

SEQ ID NO: 218354 - DNA, 428 bp, Homo sapiens
ggtgttctagaggatcccgtcaggagtttgagaccagcctgaccaacatggtgaaaccctgtctctactaaaacaaaaaaacagaacctatttccccaggtcacggagtggttcttgacttgaacacagcaatcagaacacctcgggggtaaacactgcaccaaccctagcctgagagcacaagaggcagtgcctcctttttcctgcagccgggctgagtggccctgtgcgggggtcacatggggccatctgaagatgagcctgggctgaggagcagcacccaggggggcaagggaaaggaggaccctgctttatcctgccatgcgccttcttcccgggccacagggcactctcatgtgctgtgcctcagcccagcagactcttccacccagcttgctgcctcctcctctttcatatctcatcctgag

SEQ ID NO: 218355 - DNA, 562 bp, Homo sapiens
gtctcctttggtttctgttcttgcgtctttccctacaaactgaaactagaattctgtagcagtgtcggagcggaaatgcttttctaaaacaagctcaggaagtcatttaattagcccaggaagggaataggggaaaatctattctctccaaataatcttggaaaattggagttttcctaacacattaagagtaaatgtcctgcctcactgcagagtgatctgtacatcttcagttgacaagcatgaacatcccccacctcttagtcccatgattccttctctcttccttcctgctattgactactgtgcagactcagctggattttagataatctttataatatcacaatggtttccatggagatggatcatgatgtcacaaaagtagatatatattctttggatactgaaaaatcaaagggcaatagagggaggaagagaagaattttcaaactggtatatagaggagggggaaatctagagaacaggaaagaaaactaagaaagggtgtgagtgaaacagagaaatggctattcaaaggctattcaaaatgacagcaacc

SEQ ID NO: 218356 - DNA, 380 bp, Homo sapiens
cggggaggcagaggttgcagtgagacaaaatctcaccactgcactccggtttgggcaacagagcaagacttcttctcaaaaaagaaaaaaagacaataaaacataggaaacataaatatgtgtcttgaaaaatcatttaaagttatcaactttgctgttattttttacaatgcagcattggcatggaatgcattttctagtatgtctgtaaccatgacttcaagaaactgtggtctgaagttgactctgctgcaggaaactctgaactatgagacaaaataaaggacataatttgttaacggacctcaaaccaaatggattatttattgcctgtttccacctctggaatataagagctccaaaagacagaattttatgtg

SEQ ID NO: 218357 - DNA, 535 bp, Homo sapiens
tccttcaaagaagcgcttttggttacaagtgggtccataacacacaaaataaaattctgtttacggctgggcgcggtggcttacgcctgtaatcccagcattttgagaggccaaggcggggggatcacctgaggtcaggagttctagaccagcctggccaatgtggtgaaaccctgtctctactaaaaacacaaaaattaggtgggtatggtggtgtgcgcctgtaatgtcagctactcgggaggctgaggcaggagaatagcctgaacctgggaggcggaggttgtagtgagccgagattgcgccattgcactcgagcctgggcaacagagcaagattctgtttcaaaaaaaaaaaaaacaaaaaaacccacaaaattacatactttttgataatattgaaaaataagtatggaaaatgattcttcttaggaaaatttatgcccattattcacttcgctgttttgttaatgatcacgaatatattaaactgaaaatacaagctaagcagctgctttgaaactacatcaaaacag

SEQ ID NO: 218358 - DNA, 1019 bp, Homo sapiens
ccccgcttctgccgatggctgcggcggtgtaggagcaagtcgtaggcgcccgcgaagctctggccgcagaggccgcagcccagggtccgtcgcaccaggtgcacgtacttgtgagtcacgaggcccaggaagtgcttgaaactctgcccgcacgtggcacagctgaagcgctcggggccggaactggcacccccgccagcacctgccaccgccgccccgcctgcgtcctcacccccagacacccctgccagtgccgccacggccgcccccacctcccccgccagcccgttgtccagcacgctggccgcatccgtgccgctggagccgtccgggggctgcaggccgccgggtgcgggcgggagcaggcgctcgggggcggcctggtggaccagcttgtgccacatgaggttctcgatgaagccgaaggtcttgccgcaggcgtcgcagccgtatggcttctctgccatgtggacctccttgtgactcatgacgtgaaagagatccgggaagtgctcgccgcagtccgagcaggcgtagctcagcccatcggtgggccctgcagacgtgcccgaggccccgggcccacaggcccccggtgtgccttgggtggaggggaggccggctgccccggccagggcgcagggcagctggagccggtgcacctggcggtggcgggtgaggctctgcgggtagccgaagaccttgccgcagagctcgcacttgtagggccgctcgcgcgtgtgcaccacgtgatgcttgctcaagtggaaggattcgcggaagcgcttcccacacacggggcactggtggggcttctcgcccgtgtggatgcgctcatggcgcttcagggtctcgcggcgcccgaagccgcgcccgcagatgccgcagcagaacgtctttcctgggacgctggcgcccgagcctcccgccccgctggtccccgcgccgccgagcagcagcgggtgggcgcccaggagcgggacgggcacagcgccgtacaccaccgccgccgcggccgc

SEQ ID NO: 218359 - DNA, 653 bp, Homo sapiens
gcctactactactaaattcgcggccgcgtcgacaaaaaattagccatgcgtggtggtgggtgcctgtaatcccagctactcgggaggctgaggcaggagaatagcttgagccagggaggcagaggctgcagtgagccaagattgcgccactgcactccagcctgggcgacagagccagactccgtctcaaaaaaaaaattattatatatttttatgtgtatataaatatgcacgtagatgtatacatgtatagaaaaagcctggaaaaatgcacctgaaacttttacagtgatcttctgggttgggagtgacaaaagggccttaccctttttgtaatggtttccttttgtataacagaatgtaccatgtattacttatgtaaaaaattttaccctcacactgtatttactcttacaattggcgtacagtattttattgtatagatggtcattatttattcagtctgttaataatggtcatttaagtttttctccagttgacaactctaaataacattgagataaatgtagatatatcattgtacatttgccttggtttttcccatgggataaattctagaaaatgccagctgaactatagtgacagcagaccagtggttgcttgaatgtcaaggattgagagagagtttggtt

SEQ ID NO: 218360 - DNA, 314 bp, Homo sapiens
ggaaccctcacggacgaacccactccatgtattacttatgtaaaaaattttaccctcacactgtatttactcttacaattggcgtacagtattttattgtatagatggtcattatttattcagtctgttaataatggtcatttaagtttttctccagttgacaactctaaataacattgagataaatgtagatatatcattgtacatttgccttggtttttcccatgggataaattctagaaaatgccagctgaactatagtgacagcagaccagtggttgcttgaatgtcaaggattgagagagagtttggtt

SEQ ID NO: 218361 - DNA, 582 bp, Homo sapiens
gagatgagccggtacccctcacggattacctcaacaaaatattagcaaattgaatccaacaatgtgtaaaaagaattacataccacaaccaagtaaaatttctgccaaatacgcaaagctggttcaatattcaaaaattcaatcaatgtaatctaccacatcaacaggctaaagaagaaaaattacatggtcctatcaattgatgtagaaaaagcatttgacaaaatccagcatctattcatgactataaaccatcaacaaactaggaagagagaggatcttcctcaacttaataaggaataccttgaaaaacctgcagctaacatttagggtgagaaactacataattttctcctaaaactagaacaagctatgtcccctgtcttgtgccagttttcaaagggaatgcttccagtttttgcccattcagtatgatattggctgtgggtttgtcatagatagctattattttgaaatacgtcccatcaatacctaatttattgagagtttttagcatgaagggttgttgaattttgtcaaaggctttttgcatctattgagataatcatgtggtttttgtct

SEQ ID NO: 218362 - DNA, 566 bp, Homo sapiens
gagatgagccggtacccctcacggattacctcaacaaaatattagcaaattgaatccaacaatgtgtaaaaagaattacataccacaaccaagtaaaatttctgccaaatacgcaaagctggttcaatattcaaaaattcaatcaatgtaatctaccacatcaacaggctaaagaagaaaaattacatggtcctatcaattgatgtagaaaaagcatttgacaaaatccagcatctattcatgactataaaccatcaacaaactaggaagagagaggatcttcctcaacttaataaggaataccttgaaaaacctgcagctaacatttagggtgagaaactacataattttctcctaaaactagaacaagctatgtcccctctcacaactcctattcaacatcatactttttttttttattatactttaagttttagggtacatgatatagcccacatgatatagcccacgatgatatagaccgggtgatatagtccacatgatatagtccacatgatatggaccacatgatatagcccacaaaatatagcccacatgatatagac

SEQ ID NO: 218363 - DNA, 479 bp, Homo sapiens
ttcctagatggagtctcgctctgtcgcccaggctggaatgcagtggcacgatcttggctcactgcaacctccgcctcccagattcaagtgattctcctgcctcagcctcccgagtagctgggattacaggtgcatgccaccaagcccgggtaacttcattcttttgcatgttgaaatccagttgtctcagcaaaatttgttaaagagacttctttttccccattgaatggacttggcatctctgtccaaaatcaattggccataggtgtatttctgtactttcaattctgttccattgtacctatatgtctgtacttatgccagtaacacaatgttttgattactatagctttgtggtaagttttgaaatagggaatcatgagtcctccaactttgtccttctttttcgagatgtttttactacttggggtctctggaaactccatatgaatttcaggatggatttttctatgtctgca

SEQ ID NO: 218364 - DNA, 526 bp, Homo sapiens
  misc_feature (18)..(19): n is a, c, g, or t
  misc_feature (70)..(70): n is a, c, g, or t
gcccccccccctcaaagnnaggctgggggaatttaatagggcatgaagcccacccggcggcccgggctgngaaaatttttcccaaaaccatatataaaagtaaacttaatagtacagtataatggaccccatgaacaaaagtaatttttctaacctcaaaagcaggggcagtttatttaatcaggtaaaaactgagccttaaaagtcagactttgctaaaagaaaacagtatttttttcactgtcctgaatataacattaaggaaataggatttggttaggtctagataacatttaataatttcaactgtgttaaagacaaaagtaatttttgatgtgaccatggacttgtcatgaaaaatataaaggtgaaagggattccatcccccttcctctaaacagaatggaacataagcacaggtttaggctaattcataacctggatttttaaagcttttacatagttgggtttcatgttgttcagatgtcttactaaaccaggtatctaaatgagtgtttttctgtta

SEQ ID NO: 218365 - DNA, 335 bp, Homo sapiens
gcttgtctacattcttagtttgtaactgtaggatttttaatttttgtggctgtcatgagagactttcaccagcctcattattttgcaggtatgagatgtggtccttcagggtcagttgatagtgtgacatgagtggcctggtaatgaggccagcactctggttgatcctagtacagaccagaagagcaggagaagagccaacacgtatccacatttctgattggtgccaaatgagcagtgccaatgaggcactgtgcagctgtgctcaccaggggcctttacaactaaaggggagacataaataactagtcaggtgacagactttatctcaggtt

SEQ ID NO: 218366 - DNA, 321 bp, Homo sapiens
aacaaacattgagctgctctaattaaagttgagaaaagtggtgatgagggcaaggagattataaatggcttggtgtcactcctcacttcccccatgaagcaaaatttgaaaatcactgaattgttctgctttctatgactccttctatgtttatagataaagattggatttccttttctgccttgccttctgggaggctcaggccttctttgttttactcagtcatgctaattctcttcaaattggggttcgtgagccaccgtgcccagccaaatcttaaagctccaaaataatctccttggactccatgtctcacatcca

SEQ ID NO: 218367 - DNA, 397 bp, Homo sapiens
gcttcacactggtcttcaccttttatgatgttcttaaggcataaatcatagtttcaaagccagggttcccattatattatttaagatgttatgtggaagtttttatgcatttcacaaattcataaattagtggggcttgaatgatagaaactaggtagaccacttccttcattgtcagacaaggttatagaaagttgaagcatcttgcctctgttccatggctagcttgtggcaaagccagatggtatttatccttgaggttcccttcaagtgctcgttttgggaacctaaactgcctctctttggttaatttgatgaattatgtaatttatcagagtggttttaaaattcagtataagtaaaattatatggacactaaaatttttagagtgagtaa

SEQ ID NO: 218368 - DNA, 432 bp, Homo sapiens
tggttttgcctacatacatggaattctaattcttcatacatgaaatatttatgatgtaacaattagcattaatcctttaattcaggaaaacagtaggaggagctcctttcttttaaatgaataagcgtttacataaatctgtataataattaattttagagcaccaaaactacaaataatatattacaaagatatagaagattctacatatataaagaattgctttttaaaaaactttagtcagaattatcattaaagtcagggatgataaatgagataaaaaattatgtgaaattgaattaagggtatttggggatacttattacttccatactagaaaatttgaaaaaataagttaaatagatacatgcttagaaaaattaaaatactaaatgagatgtaagaacagagaatatgaataaagcaaacaaa

SEQ ID NO: 218369 - DNA, 106 bp, Homo sapiens
gggagtgggcacgggctggacagtggacttcaagccaggggcacagcagccaagacctccactccacccaaggctgggcctctagaatacctattctcagggtgtc

SEQ ID NO: 218370 - DNA, 1059 bp, Homo sapiens
atcattttttgttcctcattcaacatatacattttaatctagtttttgactaattaggaaggtattccagcagttagcatgctgagaatttgctgaaatttaaaaaaatgtatccgtttccgaatgttgtttactaaaatcatagtagtgctgaccataattattagttttagtgaacccaggctggctccaggtgatctttctttcctaagtggtcatgaaattctggattcacagggattctatttttgggcattgagttattgtttctgctgttgacccttatgcaaatgagcacatttacctaactttaatctctcagttctgttcctctcctactgatttccagactaagaatgccttcaaataaccaagtatataattgtctgattctggaaacaaaatctttctgtagtaatccattactctaatattattttcctacttagactttgactccatcatatctttctttcctttgcagtcaattctttttgataaaggtccttgataccaccttatacctatttctgctcttctttttgatttttaattcactttatgtgttctggttcttttacctgattccaaaatgttagctttttgccagatttttattctttcacatagtttctgtccatggtgtttttttcttcttgtaataatcacttaattttcataaattatcatttattccctgatgacatatatttgtatgatcagtctagatagctgttctgagctcttagtctataaatttttctgcttcatagacatggatatctatgaaatatcaacttggaggtcccagaaagatctcatatctaacatgcctatagcagactcattatctccccaaatttgttcctcttcttgtgtttctttggtgagtgaaagatgatggtatcacatccttcccagccaaatgattcccaaattaaaaactctgctaaggcatgtttaatcctccatttctttgaggctcaaaattcatcataaattcctcttggatcaggctcttattattttactacagttagtacaatagacaatcaagta

SEQ ID NO: 218371 - DNA, 141 bp, Homo sapiens
ccactagccagcacagggctcatgcgggggtagggggaagataaattaggtaagggagttaggaacaaagcaggcatcccactagctagcacagggctagtgcaggtgggggaaaggtaaattagctgagagagttaggct

SEQ ID NO: 218372 - DNA, 557 bp, Homo sapiens
ttttttattggatagttgtgaggattaaagtaagagcatgtcaacgtgtagaaagattatatacgttctacagttcagaaacattggcgtgtagattataaatatttgctatgttaaaatatttttatttgggggcaggactttgagctgctccaccccacccccacctcctgctgcccacgcaagaatcagaaccactgctgggcagagtggctcatgcctggaatcccagcacttgggaggctgaggcagggagattgcgtgagcccaggagttccagaccagcctgggcaacatgcagaaaccccatctctacaaaaaatacaaaaagtatccaggaatggtggctgtaatcccagctacttgggaggctgaggtggaaggattgcttgagcctgggaggtggaggctgcagtgagccaagactgtgccactgcacttcagcctgggcaacaaggtgagaccctgtctctgaatgaatgaatgaatgaatgaatgaatgaatcagaactgtaagaaaacctgctaacctctccacattgtcccgagtccattaa

SEQ ID NO: 218373 - DNA, 230 bp, Homo sapiens
tgggcagtgaaactattctacatgatactaacaagggtcgattcacacttatcaaaatatatatatttatacatttatgcagtattactatccattatatacttatcaaaatccatagaatgcacacttccccaagagtgaactctaatgtaaatgatggactttgggtgataatgatgtgtcaatgtaggttcatcagtggaaacaagtttaggactgtagtgcaggat

SEQ ID NO: 218374 - DNA, 466 bp, Homo sapiens
tactaatttaatcatcatttattactcatttgatatcccattttatagatgaagaaaccaaaacaaagacagataagtaatttgaccaaagtgtatcagtgtccaagaacaatctcattctctggccccagagccagtgttcattactcgttatatcatttgtatgtgttttctaatacgaggaagtatgtatatgtgtgtatgcacatatatacatgtgtttacataatatataatttaaatgataaccaaaatcaagagaataaatcagtgtttaacaaacaatatgatcatcaagtacttagtatggaaagactattaaagaagaaaacaaaagattttagatttactctcagctgtgtgaccctaatcacttatctttactaagtcctcatctgtgataaataagcatcacctgggggcagatatgtggttaaaaacagaaattcctgcaccccaagttgga

SEQ ID NO: 218375 - DNA, 571 bp, Homo sapiens
gtgaattctgtaatcctgccatatttaatatcttacccctctagtatctccaatgtatcatttgaaacaatttttaaaattatgccactaatatgattgtcttttaaaattcaccattacatcatatactttagatcatctctatgttaatggttcttaatggttcagaattgtttctccaagattgccttcaatttttcattgccatttttaaagatatttcacaacattggtggtatgggctctaaaaaatattatggcacattagagattttaagtgagcttggtatattttcacctggaggcaattatgtagactgtattgagttcctttatatcataaagttttgcatatataaattaacaggattatcaatcggcttcttagaaacgattatgtaagttctagtaatattaaaaagatatttaaacattacatccatacatatgggttaaaatacacatacaaaaacaggagagcctaataatttcagaagccagtatcataaaacaaaggggaaggagaagttaagtaacagcagtatggctaataaataaataatgcatttta

SEQ ID NO: 218376 - DNA, 242 bp, Homo sapiens
aatataaagatgttgcaccaagtgtcctcctcaagggcagtacatttttttttctagaaaaaaattctgaaaagagctctcctattcatgttcatcagtggttcttcagtggaggctatttgcctctttagagatatttatcatcattcagagacatttttgattgtcacactggtaggaggagggtgtgctactggtacctaatggctagaggtaaaagatgctgctaacatagcctacag

SEQ ID NO: 218377 - DNA, 599 bp, Homo sapiens
ggaaaaattagatcattttgtatcaggcagtctagatttgggtgccagctatttgtcagaaaaccagctaccccatagttggagatattgagaacttaggagagttatagccctttctaaagtgggaagggagactcagtttcttaatgctagtgtaacaaattatgcaaatttagtggcttaaaaacaccacctgtttattatcttacagttttggagtcagaaatatgaagtaggtctctgggctaaaatgaggtgttgccagtgctgtttttctagagccttcgagggagaatccgttccttgtctagctttcagaagctacctgcattccttggctcaaagctcctttcctccatcttcaaagccagtcacagctaaccggcagatcttcacattgaatcactctggctctctcttccaatttcctcttctacttttaaggaccttctacttttatttatttgtttcaagagatagggtctcgctgttgcccaggagggagtgcagtggcacgatcatcattgactgcagcctcgactcctggtctcaagcgatcttctcacttcagcctcccaagtagctaggacaacagttgc

SEQ ID NO: 218378 - DNA, 472 bp, Homo sapiens
atctagagagttgcattttgtagacactcacaaactgatagattacctcggcatccactatagtgcaggtccaaaatagtactgccaagaaactttttccgcattattcttgtctacagctacaatcgaatttctcttctcacttaagtgatttttagattgggaatgtcaccagagaaaaatgtagctgtgccagccaatgggcactctggacagttcagcatcaaattaatactctttaaatacaccctcttcatttgactgttcagctatgcatctcaacactgctttacttacactggaggcaggcaaaatattaaatatgcacttgactgaaaacctaacagactattttatacatagctttggaatgtgaaagttcatgtatatggcaagtcatttgacataactgatttgtaactaaaatttttaaaataatttaaaaagaaataaaattggttatttgccggca

SEQ ID NO: 218379 - DNA, 416 bp, Homo sapiens
ctgacagtgggaaggggaaggtggctgcttgcttctctgccacccttgtcttgcacttgggctcgccctggcccctcctaggttgaagctttggcatgaaatggtgcccatgtagcctctaccagcagacgtcctcacacttttggcagaagccccctgagcagtacctcatttagactttcctacctctgattccacacctggtctcgggtaccacagacctctgacctctggctggggacacgccctgagccttgccaactggtcttctggtcctcacttgtggcttaagggggaagcggggacgcctgtaatcccagctctcagggaggctaagaggcgggaggatagcttgagcccaggagttcgagacctgcctgggcaatatagcgagcccccgttctccaaaccaacca

SEQ ID NO: 218380 - DNA, 107 bp, Homo sapiens
cagttgaggatcccccagtctgtccgaacggcaccacctgttcccatgccctctgcctgtggtatcgtagtcctgcagtgtgggcaggcattgacctttggagaccg

SEQ ID NO: 218381 - DNA, 305 bp, Homo sapiens
tcatttcctataaatggtgcaaacagtacctaccccatacagttatgagaaataaatgatataaagtgctttataccctgagtctcaaagtatggtcaacctgggtccagcaagggtccatagactctttggtaataatctacaatgagataagtacagaagttgggaataattgtatttcttttgaatctaataattaaaaattagggcctatattttctatgtctcttttatgtcatgtttctagtatttaatttttattgtttacaaaagcatcagtacacaatggattggaaactaaaact

SEQ ID NO: 218382 - DNA, 467 bp, Homo sapiens
tcgtaaatcaggaacagttacctaaaacagttagcactgttacagagtcaagagaccagaggttctccgtcctcctaggtagaaatatgcagaactttacatacggggtccctcggctagaggcctgtccatggtgtctgcaggctggctatgctcagattaagcaagactctttgtgggataagaaaagccactttgttggtattcctatcaaaaatttaaataacctgaatctaatcatgaggaaacatcagataaacccaaatggagaaacattctaaaaaagaactgaccttactcttcaagaatatcaatggcaagaaaaattcaggaagtgttccagactaaaggagacaaaagtgacagttgaaggcaatgcgtgactagaaatttccttttgctataaagaatattaaagaggtaattggtggaatctgaataaagtacatagattgttaattatattg

SEQ ID NO: 218383 - DNA, 462 bp, Homo sapiens
ccctcacaattcacctgcagtgctaagcagggcattctttgccccagccatcactagcagaacagaggaacacagggatcaggttgaagctgagaggaaggactcccacagaagactctgtgccataggagtaaccaagttaaggttcagacacaacagactacttgtaaacaccacattctctacattagaggtaacacagttgtgacttgtccaagacccaagacctacaaaaaaaaagagaaaaacaaactaataaactgcttttgatattgttactgacaagaaacacaaaataccactaagcaggtgatagtgaaggacactgtgcagatacgtgttcccatacagatacgattcagctaaactaactcaagtgcaacaaaaaatcttcaagattataaaaacatagctaatatgattgatctctctgaaaaataaattcaacggaactcaaaatct

SEQ ID NO: 218384 - DNA, 419 bp, Homo sapiens
actgtctactggttgagaaataacaaaatgtacatacaagtgagcagtgatggctgctattttataaacttgaggatttcacagcttgtttttgtcttgtatttctgggtaagcctggattacatttaccacttggctttacacatgctctgtttttaattaaggagcctgagttgtattgacagcatgtttatgtaattaatacaattatatatagtttagttaaacattcattgagcacctattgtttgcccattccctgcaactataatctttattcttctgagtcattgtaccatgtacaacctataattaaccagttaagcatatggtagtggttcccagacagttgaattatctttccttcactatagataaaaataaaaaattaatatattttcatatagcagatgattcat

SEQ ID NO: 218385 - DNA, 426 bp, Homo sapiens
acgtgttagctgtagaaattcatcgcaaagagttgctgcttggctgatctgagcctgttagtaaactttctgcacattcacatttaggaaacaaataggattaataagactggcagtgtgcagtaactccaaggctggttgtcacttacagtaaggcagccacatcaatgccctggtgcactccagtggtttccagaatggaagtaatggaatttctgtagttaagtgcctgtcagtcctgtggctggggcactcctgtgtaaatctgtaatagagaaggagccattatgggcacctggcatgagggctagggaaggcagggttggcccaggccctaaggctggtcgtggcctagggaccaaacctgcacaagcacagaaaatgacaattctgtagtcttttccctcactttgtttttcttgggtc

SEQ ID NO: 218386 - DNA, 337 bp, Homo sapiens
tggacactatttaaagtgacatggcatatgtttaaaagaacaaactagaaattctagaattgaacatttaaaactaaaaaactcaatggctatgttaggcaacaaagtattagtaaactagaagaaataatggaagaaagtatcaagaatgtagagctgagagacaaaaagggagaatataaaaggtcaggaggaaggaggatggggtcagaaggtgtaatgcacgtttaacactgagtcacaggaagaaaagtcggggcagcaccatgtttgaagtgacggtggctggtaaatcatatcaaacagtcaagaaacccagtgaatcccaagcaagatt

SEQ ID NO: 218387 - DNA, 464 bp, Homo sapiens
acagaaccctgaggctcagtcttcagcataatttgagactcactttttgccaaagaactgtgattgacaacctgagcactttcagttcaccttattgttcattatttcctccagatgaactgtaaattgaacagctctatccaagattatagataagacatagcccaccactgccaattcctttgaagctgttctactagaaaaagttcatcaaaagtgctgactcttcagggagaagttccccccccccaaaaaaaaatgctgaatcaaagactactgtgcacttcaaaaaactcgcccttttctctagatgtgactgtggttagtactgtgtaggtaatcagcaggaatacatcagcagtcagaaaactgtggcagttactccggactcagccaaatcactttacgtgtttctctagctccaggttcccatctatacaatgaatagcattttcatccactgt

SEQ ID NO: 218388 - DNA, 305 bp, Homo sapiens
tgcacgagggaagaaggtgccttacttccctttcgccttccaccatgattgtaagctttctaaagcctccccagccatgctgaactgagtccttttgctcctgctgagtagttcctgcctgcatctttaatcctatggaggtgacagcctttgttccattcagcgtaagatgaagggcctctagtattgtgctcctgacctcgtaatgagaattaccagcaggactggatggattcctaaagaatgtgagcctgctctcttgtaaatgtttttaataataaatgataagaaaggcaaaggcacaa

SEQ ID NO: 218389 - DNA, 534 bp, Homo sapiens
cccctcaggagatggtggcacaagagagacagcaccctcctaagatcacctccggccccactaggtcacctttgcaatttcattagctccaggctgtcttgttccattcagatttacagaaattttagatctgggatttggatcaaatggcagaagcaagaaaaattcattttgagtgttttttgaaaccaactctgtaacaattgaatatatttgatgtagaagttgtcaccatctagactgatgtcctcatcatcaaagggcaagagcaaatgtctctaggttcctgtgttgtccatttgtttcccgctccctttttaaaacggccttatggaaggacaccttcttcttcctgtaggaatgggccacaagcttcaggtaagagccttccctgacttccctcagccaccaagtggaagcagtgtcttactctcagaacccacatggcattttatccatggcatttatccagcagggtgtccctttgggagcctgtcactttttattctgcatgataggtgactgtgtccatgc

SEQ ID NO: 218390 - DNA, 403 bp, Homo sapiens
tagccacgtgaggatgggaagtctcatttgccaaatgactgggctgggtgcagtggctcaagcctataatcccagcactttgggaggctgaggcagatggatcacctgaggtcaggagttgaagaccagcttggctaacaagagttccccaaggacagaagtcagggaataagagctgagtgagacctcccaaagcagatcacaaagagaaggggacactgcaccatggaggtgacacaggccagtggccacggtgctggacctggggctgagaggacccacatgtatatcctggccgatttaggtatcttagactttctgtgcctcactttccttatctgtgaaatcagcattctgatcatgactaaataaaaattgctgccattgatcaagggcactgact

SEQ ID NO: 218391 - DNA, 511 bp, Homo sapiens
ggataatgctggcctcaaataatgaggtaaggagtattccctctccaatgttttggaaacgtttgagaagaattagtgttggttcttctttaagtgtttgatagagttcactggtgaagccattaggttcagagcttttcttttttgggagatttttgattactgattcattcttcttacgaattagagctctatgcatattttctatttccacatggtttcattttggtaggtcttctgtttctaggaatttgtctatttcacctaggttacccaatttgttggtgtagaattacttagtactttcttataatcctttttgtttctgtggaataggtagtaatgtccccactttatttaatttctaattttactaaagtgagccttttctcttttttttttttttttgttcttagtctatctagctgaagtttgtcaattttgttgatctcttcaaagaatcaacatctgggttcattaattttctcaattgtttttctagtctccattt

SEQ ID NO: 218392 - DNA, 177 bp, Homo sapiens
ggagaaaatctagcttctggtggtttgcaggcaatctttgacatttctttgcttgcagaaacatgaccacaatatctgtcttactcttcacatggcattctctgtaaagccacactatttgcttagattgtttgaagaaggcactttcagatgtgttccagaggctgggcaccttga

SEQ ID NO: 218393 - DNA, 223 bp, Homo sapiens
agtgcactcaaatgctggcactgaagttgcatcttgttgatttacaagtacaaatctaggagacaagatcatgaagacacaaagcatcgaaaacctaatgtaggggtgggcaaacgacttcttacgggttaaatctgtccaccaccttgtaaatatagcttcgttagaacacagctgtgctcatttgtttatgtattatgtgtccagttttatctctaataac

SEQ ID NO: 218394 - DNA, 658 bp, Homo sapiens
agggactgttgatattcagggatgtggccatagaattctctccggaggagtggagctatctggaccctgctcagcagaatctgtatagggacgtgatgttagaaaactacagaaacctggtctccctgggtattgctgtctctaagccagacctgatcacctgtctagagcaaaggaatgagccctggaatgtgaagaaacatgagacagtagccagacacccagctgtttcttctcatttcacccaagacctcttgccagagcatggtataaaagattcatttcaaaaagtgatactgagaagatatggaagctatggcattgagaatttacaattaaagaaagattgggaaagtgtgggtgaatctaaggtgcagaaagaatgttgtaatggacttaaccaatctttatcaactacacataccaaaatctttcaatttaataaatgtgtgaaagtctttagtaaatcgtcaaatctaaatagacataagataagacatactggagagatatcttccaactgtaaagaatgtgacaattccttttacatatcctcagttctaactccacttcagagaatccacactgcagagaaatcctacaagtgtaaacaatgtgggaaagcctttaggcactgctcatgctttcttgaacatga

SEQ ID NO: 218395 - DNA, 424 bp, Homo sapiens
catcatgagtaaagtatttcacataagtattctttttttgagatggagtttcactctgtcacccaggctggagtgcagtggcgcaatatcagctccctgcaacctccgcctcccaggttcaagcaatgcttctgcctcagcctcccgagtagctgggattacaggcacgtgccaccacgcccggctagtttttttgtatttttagtagagatggtgtttcaccattgttggccaggatggtctcaatctcttgacctcgtgatctgcccacctcggcctcccaaagtgctgagattacaggcgtgagccaccactcccagccaaccccgtccctaatttaaaacacacacacacacacacacacacacacacacacacacacacacacacacgtgcgcgcgtgcgcgtgagccaccgctcccag

SEQ ID NO: 218396 - DNA, 420 bp, Homo sapiens
ttggagttttgctcttgtcacccaggctggagtgcaatggtgtgatcttggctcctgcaacctttgcctcctgggttcaagcaattctcctgcctcagcctccctagtagctgagattacaggtgctggccaccatgctaattttttgtatttttagtagagacggggtttcaccatgttggccaggctggtctcgaactgctggccttaggtgatccgcccacctcagcctctcaaagtgctgggattacaggcatgagccacccggtttgtttgttcttaaggaaaaataacagtacttgataacagattgacaaaagagattttgaactttaggtattgagaaaagattagtaagactcactttgatagttgtgaaaattactagaacatgatacagattttgcttctggccatgat

SEQ ID NO: 218397 - DNA, 505 bp, Homo sapiens
ctctcagagggtgaattgttttcctctttccaagttctcttcaggaggggaatccccccgctgtccatccctgtatcctgcgagttaggtacccagctgggatctgatttcacagcctggggtcagatgtgttgtaaagcaatcttacatggttggtaaaaagcaatgtaagacactctgctagaagttggcagggcagagagctggggggcaggcggcaaacatgattagagagggagcttacccggctctcaagggactcatgctaactgtggagaccaggctcatccttttatgaaaagataatgagctcttgtgtgggtctgtgattaaggcctacatatggcacagacaccaagggcgatagcaggggagtattgaagaaaagggcttagaaatatcagggtatgagcaaagactcagagatgaacgctcagggcatgtgtgggttttgtctagggtttctacatctagaaagtagttgttaggttctgggggcacacag

SEQ ID NO: 218398 - DNA, 373 bp, Homo sapiens
ggaagaaggtaggagaggcatgggaactggggaagaacagcttttcatccccctcacccaccacaatggtcagctagcaggatccaccaaccaagggtgacactacaccatatgcaacaatgaacttgaaatggagcagatacctcaatgcaagaacaaaggctataaaatgcacagaagaccaaggaaaaaagccctgtaacactggatttagcaaccatttcttggatatgacgccaaaagcacaagcaacaaaagaaaagagcgaaaaggcaacctagggaagggaagggaatacttgcaaatcatatatctgacaaagtattagtatctagaataaacagctcctaaaactcaacaacaaaaaacaatt

SEQ ID NO: 218399 - DNA, 413 bp, Homo sapiens
cccctacagtgtgaactagagcacctgtctgtgtgttccagatgtgtacacatttgtcaaaagaattgctggccagataccggccatcaggactgaaagctacactgtacacaggcttctcattcagcatttaccttcggtatagaaagccgtatcagtcagtccaatataaatggtgccctcgtcccacctgctgcattgatttctatcatccagaaaggtctacagtatgtagaagcagaagttagtattaatgaggatggtactttctttgatggtcgaccaatgagtctgtccctgatagacgccttaatgcctgatgtagtacaaacaagacaacaagcttatagcgataagcttaaacagcaacaggcagcagctgccacagccaaccaacaaggatctgcaaaaaa

SEQ ID NO: 218400 - DNA, 633 bp, Homo sapiens
tttttccaactaatactctcccaccttttattatttatttccattcgtagtgacactaggacccccagatgccttcatagcattgcttatggctttgtagtcccgcatgagtagccactgccatgcttctgccatgctctcccccatgtcacctctgcagccacagcgctgttcagttgtgtgctgtcagtgcttccaacagggggtgtttcagctcttccctctgctccattgctttctcatgacaaagttcatcctgcttccgtctcagcaaagcctgatctgtgactctgtgatgtgtgcttttggatgtgagtgtgtctgtgtgtgtatccaccttagggagaaaacggatttcataatttcattgaacaaattggcccattacatttgctaccctttatcaaacaaaaaccgaaactgtgtcatttggacaaagtggtagaatttattatctcaaaagtgataatgggaatgctataactagacatcgataaaacttctaatcttggttgaaaaatatgatttcactttgtattgctcttactttccctcatatatttattaaagctgtaaaaagatgacagtgataaattcaaataaaaatttgagtatagcagggaaaggatactg

SEQ ID NO: 218401 - DNA, 332 bp, Homo sapiens
gtccgcaccggctcatgcggcgttccagcagcggtcactcccgccgccggcccccgccgcccgccccgcctgcccctacccctccgcgcgggccgggcacctggccgccgctcggtcctcggggccccgcgctgctgtctctgtctcggcttctctcggcccctgggtctcttcgtctctgccgttctcaggctcagctccgtctcgctcggtccctcgcttccccgccgggctctagccggccgtctggtggcccgaggtggcggcgggctgggcgcggggcgcgatgagcggcgcctgcacgagctacgtgagcgcagagcaggaggtgg

SEQ ID NO: 218402 - DNA, 434 bp, Homo sapiens
ggtctagtggtccttcctcccatcctccatcaatccatccatttgttaggcccctactctatgccaggtcttgtgctgggtgctgcacattctttctttctttctttctttcctttctttcctttctttctttctttcctttctttctttctttctttctttctttctttctttctttctttctttctttctttctttttctttccttctttccttctttcttctttttttttgagacggagttttgctcttgttgcccaggccggagtgcagtggtgtgattgtggctcactgcaacctccacattctggttcaagcgattctcctgcctcagcctcccaagtagctgggattacaggcatgtgccaccatgcccagctaattttgtatttttagtagagacagggtttcgctgtggtcagaatggtctcgag

SEQ ID NO: 218403 - DNA, 529 bp, Homo sapiens
gagcataccttttctgttatgacaactctgtaaatggaagaaagaagtccttttcaactcaaagcagcaatttcagtggctgtttcaaacattgcctttcaattggagataaaatcaaagaaacaaaacctcaggctttttactgaggaccaacttgaattcattattcaatgattttctgtatcctttcaacatgtgtttgttaagcgaggtgcggtggctcacgcctgcaatcccaacactttgggaggctgaggtggaaggatcgcatgagcccaggagttcaagaccaccttgggcaacatagggaggtctcgtctctataaaaaattagccaggtatggtggcgtgtgcctgtggtcccagctacttgggaagctgaggcggaaggatcacttgggcctgggagctcaagactgcagtgagctgtgattgtgccactgcactcaagccagggcaacagagtgagaccctgtctctgaaaaacaaaacaataaaaatgcatttattgaattcacacttcaaaaaa

SEQ ID NO: 218404 - DNA, 589 bp, Homo sapiens
ggtactcactatccctatttcacagctctggaaaggtccctggagaggatgtggaaagatccccagtaggtagcagagccaggattcgactgaagaccgtgattcaagtgaggctcttaaccctgggccagctgtctgccatttggactgcaaaacccagaggccagatacccctaagaggccagctgttgcacctctgcaaggcggggttccacctcctctcgggtcccggcacctaggccagactcatcgaatgaatgaaagactctgttgtatcccctgtacccaccatggctatcacaagccacagtcccatgaagacagagaacccaaggccactttctcagaggaggacggtgatctgtctctgggcctctagggtgggattcatccttctcagtcagatttcaggagcgatggtggttgcgtttttgggtgtcagtgctattgctataacttaatgatgcaaggtagggaagtcccacagacactgaacatgcagtgatgctgctgagtgtgttgattagcaccaaagcaactgtggaactcagagataataacatttttaattgtattagggtttggggaa

SEQ ID NO: 218405 - DNA, 903 bp, Homo sapiens
aggaggaggaggcagaggcggtctgggccgggccgggcctgacccctgcgtcccgggggcacaggcgttcttaaggctgcagagccctgggtcccccacccggccccggttcactttgagcggtcccaaggcctgagggcctactgtccagtccccaggttatcgtcctgagcaaagacagaccccgagccctgcggtcttggggctcaaacagtccctggatggccaaacaagcaaatattcgccatggcagtgggtgctggaagggtggctcacggagctgacgccctccgcagagaaccgtggtctagtcctgcggtcacgaggcctatctgggacagtggtgtttgagctgagactttaacgaatagagacaggtgaggttcctgcagcccagggcttcagcgtgaacaaccccagaaggaaaaagagtgctgttgttaaaggtatctggcatcatggacccaaccatcaccaggagtttctcacttcatctctgtgtgataaattttgacatatgtatacatccatgaagccggcaccacaatcaagataatgaacatctcgcttaccccagaagtttcctgtgccctgtcactcctccgtattcctccatcctcaggatttcatcaaatggtctgctgcactgtgctggaattttgaactccccagagtagtaaacaacatcttctcaagggtatacaagtcatcagatagagaaaacacccattatagagctgtggagcccttacgatatagtgctatgctgcaacaaattagacagaagagtatttgttgaataataaaaggtatcaatgaacgaacaaataaattaatgagctgatgtattgattaaatgaatttacttctttcagatttacttttccaaactaaaaaaaaatt

SEQ ID NO: 218406 - DNA, 748 bp, Homo sapiens
aggaggaggaggcagaggcggtctgggccgggccgggcctgacccctgcgtcccgggggcacaggcgttcttaaggctgcagagccctgggtcccccacccggccccggttcactttgagcggtcccaaggcctgagggcctactgtccagtccccaggttatcgtcctgagcaaagacagaccccgagccctgcggtcttggggctcaaacagtccctggatggccaaacaagcaaatattcgccatggcagtgggtgctggaagggtggctcacggagctgacgccctccgcagagaaccgtggtctagtcctgcggtcacgaggcctatctgggacagtggtgtttgagctgagactttaacgaatagagacaggtgaggttcctgcagcccagggcttcaggcactgtgctaagcagttttcctggaagtgtctacctcatttcgttctctgaatagctctaagaggccaaccatcaccaggagtttctcacttcatctctgtgtgataaattttgacatatgtatacatccatgaagccggcaccacaatcaagataatgaacatctcgcttaccccagaagtttcctgtgccctgtcactcctccgtattcctccatcctcagcatgaacgaaaaaaaatcatccatattgttgagctgctgaatacccaggaaaggctggaacccatttctttgttcatgtgtttgtccaaatcctgtgtttctctccattgactcttgtt

SEQ ID NO: 218407 - DNA, 658 bp, Homo sapiens
aggaggaggaggcagaggcggtctgggccgggccgggcctgacccctgcgtcccgggggcacaggcgttcttaaggctgcagagccctgggtcccccacccggccccggttcactttgagcggtcccaaggcctgagggcctactgtccagtccccaggttatcgtcctgagcaaagacagaccccgagccctgcggtcttggggctcaaacagtccctggatggccaaacaagcaaatattcgccatggcagtgggtgctggaagggtggctcacggagctgacgccctccgcagagaaccgtggtctagtcctgcggtcacgaggcctatctgggacagtggtgtttgagctgagactttaacgaatagagacaggatttcatcaaatggtctgctgcactgtgctggaattttgaactccccagagtagtaaacaacatcttctcaagggtatacaagtcatcagatagagaaaacacccattatagagctgtggagcccttacgatatagtgctatgctgcaacaaattagacagaagagtatttgttgaataataaaaggtatcaatgaacgaacaaataaattaatgagctgatgtattgattaaatgaatttacttctttcagatttacttttccaaactaaaaaaaaatt

SEQ ID NO: 218408 - DNA, 1302 bp, Homo sapiens
aggaggaggaggcagaggcggtctgggccgggccgggcctgacccctgcgtcccgggggcacaggcgttcttaaggctgcagagccctgggtcccccacccggccccggttcactttgagcggtcccaaggcctgagggcctactgtccagtccccaggttatcgtcctgagcaaagacagaccccgagccctgcggtcttggggctcaaacagtccctggatggccaaacaagcaaatattcgccatggcagtgggtgctggaagggtggctcacggagctgacgccctccgcagagaaccgtggtctagtcctgcggtcacgaggcctatctgggacagtggtgtttgagctgagactttaacgaatagagacaggtgaggttcctgcagcccagggcttcaggcactgtgctaagcagttttcctggaagtgtctacctcatttcgttctctgaatagctctaagaggcgtgaacaaccccagaaggaaaaagagtgctgttgttaaaggtatctggcatcatggacccaaccatcaccaggagtttctcacttcatctctgctttattgtagtataatttgcatacaataatggcacacatttaatgtgcacagtgtgataaattttgacatatgtatacatccatgaagccggcaccacaatcaagataatgaacatctcgcttaccccagaagtttcctgtgccctgtcactcctccgtattcctccatcctcaggatttcatcaaatggtctgctgcactgtgctggaattttgaactccccagagtagtaaacaacatcttctcaagggtatacaagtcatcagatagagaaaacacccattatagagctgtggagcccttacgatatagtgctatgctgcaacaaattagacagaagagtatttgttgaataataaaagagtctcactctattgcccaggctggagtgcagtggcatgatctcggtacactgcaagctctgtctcctgagttcaagcgattctcatgcctcagcctcccgagtagctgggattacagttttccaataataacatagaaaaaaggaagaatttgagagtttctcagattaggcaattccttgaagaatctgagaacacagaagctcccctccctactttccatgattgaaatcagtgattcattggtttctttgtgtgggcttttgaaagatcattagaaaccaacctgaagatcatgagattcttgtggacacaggagcaatgagtggcaatacagtgctttctaatgcaacctactttaaaaggtaaacaga

SEQ ID NO: 218409 - DNA, 415 bp, Homo sapiens
aaagacagtgaattacttaaggtgtcgccatgataaactagggtaaatcatgaatattttcagagatgttactgcctcacagttgtatgatatgttctgtgagtcttattggttggttgtaaaagcaagctgacagccttcagaagaccttctttgttcagcacagaacctggaggtacttgattaattcagtagtgtgtggagagaaacagtggggcaaggagttctttggtttgactctccaagccagatgctaaaatcagtccggaggactgtgacagagttccaatcacagtgcaacaagatttatatttacctagaatctaattggactgagatttcctgcagttatattaaaatcctctgtccttttttcttagtgagcaagcatttgaactcctaagctctggagatt

SEQ ID NO: 218410 - DNA, 331 bp, Homo sapiens
ctgtcgagaaaggatctatcttcttagataatagataaataattatcaatagaatgttaatagaaatgtggacagtacagccaattctgtgaaggtctcagatagaaatgaggaaaatgttattggacaataaaagaaagtgatccttgttataaagtgccaaagaacttgctgaattgtgctctcgtgttttgtgaaaagtagaactggtaagtggtaaaatttgattatttaactaaggagattcctaagaaagtgttgaaggattggcttacttctatctgatggcttatagtaaaatgcaagggatgaattgaacaaggaattgtta

SEQ ID NO: 218411 - DNA, 225 bp, Homo sapiens
gcctgtcccctctcagaactgtgcctgtgtccgaccaaccctccaaatgagacccagcttgcccctggctgcgggagccccagtgatgggggaggacggtgaagatactagtgtcccagatgattaagccttagaagatactctgcaagacttaggccatgaacggagcccttctctgctcttcttaactcaaagttaaaaataaagtcaaaaattcggtgttcc

SEQ ID NO: 218412 - DNA, 622 bp, Homo sapiens
cctacagtcacaggtgctggcctgtccctgctgtcctcctgaccacctggtgctcccggccaccctgcccgcccccctgtctcctcgggacagcctggctgcctccacttgctggcccctgccggcccaccctctttccaagcctgccctgcccctcagctcctggggtggggaggggagacctcgccttctgcctgcagcgactcccacctgtcacggagcccccctgcagcaccaccaggccctgccctttcccaagcagagggatgggacagccgtgcagatctcgggtcccgcccctagggaagggcctcgctgcagaagccaggctgctcaccttggagtgcggggaaccagcgcccctttcagcacccggtggtgtctctctgtgggaagggagcggttttatccaagcaggacactgttttctgtagttttaccttctttcaagaaatgtcgtatatgagacctccgttgagtgtggcagctgttcattgatattccattggatgcactagtgtgtcctagtccccacgatcaatgtgtaaatcgtaacatccaatcatagcgagtttcacacacataggaataaataaatggagagtgctgtaccgggaaaaaa

SEQ ID NO: 218413 - DNA, 225 bp, Homo sapiens
acaggcacaggtgatctttaaacagggagacctaggtccggctctgggccaccgtgtatgatcctgggcaagtcacttctttcaacgcaatttaggattagtgacagccatagaaaggaacatcctttggactaaaggctggttaacctaggtctacgcacttgacctctgtgcctcggtttcctcatcaataaacgtaggagacctacctcacttgattgagga

SEQ ID NO: 218414 - DNA, 500 bp, Homo sapiens
gtgctgggattataggtgtgcgccagcacaacaggccagaagactcaatattattaagatagcagttctcaatattatcaagatagcagcagatcaagatagccaacttgatctacagattctacataatgacacaatcttaatcaaaatcccaggaagttatttgtagatatggataaactggctctaaagtttatgtggagaggcaaaagatccaaaatagccaaatcaatattgatggagaatggtcagaggactgataccacctgacttcaaggcttactctaaagctatagtcatgaaagcagcatgatactggcaaaagaatagacaaatagatcaatggaacagaatagagagcccagaatattaaaagtaatatttctaatagacctgtataaatgtgtcaactgatctttgacaaagcagcagaggccacacaatggagcagagatagtgttttcaataaatgacgctgggacaaccggacatccacaagc

SEQ ID NO: 218415 - DNA, 364 bp, Homo sapiens
ggaaggggcagggaataggagaggtctgggcctctggatcagcagtcaactcctcaccccagactcctcccactcatgtccttcctatttctcctgccaaatcaactgtcctaaaataactcattgctcataaacatgcaagtggcttcccccacacaacatgctcagaaaccaacaccttggcctggaattcagagaccattacagtttgacccctactaatctctctctccacccactttttcccttttcctttttttcatcatgaggaaatcatgccaaatttgagtttatatatcaaagccaatttgcttgtctttgattcacttttatgtagcagaaaaataaacatatactacttgta

SEQ ID NO: 218416 - DNA, 414 bp, Homo sapiens
agatgataaatactgagtactggggccaggttctgaatccaggagttggactgcaccagaggctaagcacttgccctcattgttgtgatgctgggctacgttatggaagacaaagatgtctcggggtatttgttgttttataagaatttcaggctgggcgcggtggctcaagcctgtaatcccagcactttgggaggccgaggcaggcggatcacctgaggtcaggagttcgagaccagcctggccaacatggtgaaaccctgtctctactaatacattaaccgggcgcggtggcatgtgcctgtaatcccagctacttgggaggctaaggcaggagaatctcttgaacccaggaggcagaggttgcagtaagccaggaccgcgccactgcactccagcctgggcaatagaacg

SEQ ID NO: 218417 - DNA, 526 bp, Homo sapiens
accctgacttaggacctcctgccgtttctctgggtgactgctctgtagtcgtgagtcgtctctttaatgctgagcatcagtacctgcacagccctgaatggagcagctgcccagaatctgtcttgtcatcgatagatggacagttgccgagtgtcctgcgtgccgactgactaaggagtttttgtctctgtcaccctgtcccctgtggttttatgaagacgttagttatgaatccgtgtttaggatgagaagatgtaaacagtgaggaggataagtgagaagctagcaagagtctggatggtgatggcgggggagcgctggtggaggagtcgggggcgtcccgctggactggggcacagctctgcagcagcagccggtgcggttttgccttgtaagtgacaccgttgcctgcaggcatctctgacagctgctcctgctccagattccagaaatttctatggaacatttcctgaaccatcctcctggtttcttcccttcccctcactgaataaaatccgtaatagca

SEQ ID NO: 218418 - DNA, 253 bp, Homo sapiens
ggattggtcaaagaagacatatccacaatttaatgtcacaaatttttccagaaaatggtcaccacaaacatcaggtcttttagaggccaggcgtgatggctcacttctgtaatcctagcactttgggattacaggcgtgagccactgtgcccggcctaattaatttatcttttttttttttttttttttggagtctcagcgtttccgattcgttgtcccccaaaagtggaagtgtatgtgccacaaccccaaa

SEQ ID NO: 218419 - DNA, 477 bp, Homo sapiens
ctgcctacacgatcattcttagcagcaaatttattccatcgacttttacgtccacttaacatccagattgcatttactttgcgcagataaccttgccgcctacctcacaagtcaaggccacctgctgctctctttctactttaaaacatccttcctccatctttaccccccaactcagcaaaattgatgtctctctcggatgacccaaagtttggagggataattaatttgatagatgtcagaatcaaagttcaaaacagtctcaacaggctacaacattaggccaaaagcaatgaaataaaatataactttcaaatctaaatatgatgtactagctggaaaagcccaagttttagattttagaccttggtttgtatctagttacccaaatttgagtcatatccagtaactcaaattactatcttttgctctagtaaggtcaactgttaatttgagataaaaatacctacttcataa

SEQ ID NO: 218420 - DNA, 567 bp, Homo sapiens
attcatggctacccagcagaagctgccagagtcttctttcctgcatgaactagagtgtcctgataaccgcgagaccacttaggctgaagtcaagatattctttcagtatgtgggggtccccaaagccacaccccctctcacttgggaataggagaccatgccgccccctctccacctccactgccaggggacaactagcctcttaggctgttccctccctgagtcttcccttcccaagctggctacaggtggacatccactcttccccttccaactcccttcagaggcccatgggccacagactgcagatctagccctcccttcactaaccctcttgtcctcactaacctgggtctgtctaagccttcttccctgtagtggatgggttgctctgccaaggcctggcatgcagtttggaggtgctcaggaaacctcagctcagagctatgatggatgaagcaggacaaaaggccagaggtgaaccaagaagctgggagaacaaaacaggacagggtctctgttgtcttggccaaccaaggtctaggagtctccagactggtcaactcc

SEQ ID NO: 218421 - DNA, 294 bp, Homo sapiens
aaaggctgtgaattggaagcacaggctgcaggcagctggggcagctttgagcaggagctccgggaaatcttctctaacctggggtccctgctgtgagcagcggcaccagccaggtaacctgttctcagtgggagacaccggctacccaccagggaagccagaaaagaggccatttcgctcagacctcaggccttcccacaggcgtgtcctccatactccgagggatggctgaggtcccgtttcgtttttaaacgtggaattatgattgctattaataaaaatatctggcccagt

SEQ ID NO: 218422 - DNA, 403 bp, Homo sapiens
tatataaccaagtaggtaaaacccattgtattcatgttttcaagataaaattgctaaatttatcctatctttacagggaggcaggatttgcaacttggagtcaggtgacagctgaagttaggctcgtctcctctgggaaatgtcctcttttgtttcaggtagttgtgagactgataggaggctaatttagcattcgactttaaaggagtcataattctcaaaccccggtgaattcttacttgtttacaagaccaatgaagacttctaaaaacctcgtagtccccatggccagtgtgtgcaaaccaggctgtcctgcccctgggatgaaatgaaaaagtgaaaagtaaatgaagtcatccatatccagcccttaatatttttctctggcaaacagacacactaa

SEQ ID NO: 218423 - DNA, 242 bp, Homo sapiens
tctgctggggcagtagcaggctgtgagatgtaggaaaagggctgctttccagttctggctctattgctacttcctaggagaccaagaaaagttccttttcttgttgggacctcaattttcctatttctgaaaaagcctaatattctggaagtttcttcccatcctagaaactatttttttcttttttcttttttctttttttttttttttgagacagggtctgactctgttgcccaggctgg

SEQ ID NO: 218424 - DNA, 543 bp, Homo sapiens
actgcctctagcagcaggataatgcaatcacagggctcatttgtttcccttttctcatggatctgagtttcacaagagtgaaactccggctcaaaaaaaagggggttttattcgaacaacatacaaacacacaacagaatgcttcataagtcactttaaacaataaaatagacaataataacatacatatttttataagcatactcaggtatactaatgacagttgcacaggtacaacagttatgagcagatgaactgtattcataaggtcattggctgggtgcggtggattatgcctgtaatcccagcactttgggaagctgaggtgggtggatcacctgaggtcaggagttcgagaccagcctggccaacgtggtgaaaccctgtctctactaaaaatacaaacaattagctgggcgtggtggcaggcgcctgtaatcccaactacttggtaggctgaggcggagaatcacttgaactcgggaggcagcggttgcagtgagccaaaatcacagcatgagcaacaagagcaacactccatct

SEQ ID NO: 218425 - DNA, 332 bp, Homo sapiens
tgtgtcctccagatggcaaaatggtcaaaagaggtgcaaagagccaggcagtgggcaagaatgggaacattggaggtgtctacattgccttgtccagctctggctcttttctcaggtcctgtgtggaccatgcataatcacttttatggtaggaagaacctctaaaacataaaaaaatagatggaggaaacctgttagaggtttcctcttatattatttcatgtggcctcaggacttcagggttgatgatgggcagcttgttcttagagaatacatttttaaaaatctcagtgggcatatgcactacgctctctggccattcccttccttag

SEQ ID NO: 218426 - DNA, 370 bp, Homo sapiens
atatgcaaaaggcctaaagtacatggtgcattgtagaaacagtgagctgcctgctatgtttatctttcattattagcctttcaccccactttcctccctccaataccatagttgccaaacaggaaatggatacagatccactaaagagccttaaaaagccatgccaagcaatttagactacccccacgtggctgaaagccagtgaaacactctcaacggttactggcagatcaatttctatttcaaatatcactatgacaaaagatatattaagagagtttaggaagattaagcaggagctcattacaataatttaggagaaaaataagaacatagaatttagaggaaggaacagccatgagagatattg

SEQ ID NO: 218427 - DNA, 491 bp, Homo sapiens
tttttttttttaataatttaattcccaacacacttctgacacataatagttgtttgcaaatgcctgttacatgaacacagcagataataaaatagtataaacacaaatagctttgaaagctattctagtctttctctagtatgttgaagatctacatactgacatgtttaaaaattataaacacatatcaggagattgtgatttattgctcaaactctctcacccttagagaaaatctgaagttcctatcatggcctacaaggtcccttgagatctatcccaggggtcagtcaactatacccccacagggccaaatccaacctgctgcctgtttagcaaataaagttttatgagaacacagccaggtccattcatttgcatattgtccatggctaatttcccttataatggcagaactgagtagctgccaagagaccttacagcctgcaaagactaaaatatttactatctggccttttattttaaaaagg

SEQ ID NO: 218428 - DNA, 158 bp, Homo sapiens
actatttgtatcttgtttcagtgtttttcaaactttgtttctcctctaggtcacttgaaatgagcaaaattccatcattagcaatctttttatgtgatgctagagagattattctcccgctctcccaaatatttcattgtgtctttttcccaaatctc

SEQ ID NO: 218429 - DNA, 339 bp, Homo sapiens
ctggactggcgctgggctggacagcaacagctaaggggaaaaggaaagtaccagatagcgtcgtaggtgcgcaataaatatctgttgactgatcgaatagatgtcacctgtggacgtgttgcccgagtgagtgcatgtcccatcacagccgccagacctcccagcgacagttgcgaacacgcgatgcttgtgcattcctgcgtgtgtatttctccccacacgggagcccgactttgggaagttgaccggcatgtgccactcagggctgtggaatcccgactccgctaaaactgcagaccaagaggcccgtttcagttttcttccctttcctgttttcga

SEQ ID NO: 218430 - DNA, 226 bp, Homo sapiens
tagagaaataacggcaacatacaaggtaatgaacacatgtggcttggtcaactgcaaatctttagttttatggagtaaaaagtataaagagtctctgctacatatttccaccaaagtctggtcaatcttaaggaagcactagggaaggaagtttaggagccttgcattcactactcttttttttttgagagagagaggtagtttcactttgttgcccaggctggag

SEQ ID NO: 218431 - DNA, 195 bp, Homo sapiens
aatagggagaggtgcagtgcagcctttagtctgtggtcaaaggtccagagtcctaaagctaaaggacttggagtcccatgtttaagggaaggaaccatccagcatgggagaaagttgtaggccagaagataaagctgtctagtctttccgcattattctgcctgcttttattctgggtgcactgcagctgattag

SEQ ID NO: 218432 - DNA, 167 bp, Homo sapiens
tttttcacagaaatgctttgttgcccaggctggtcttgagctcctggcctcaagcagtcctcctctctcagcctcccaaagtgttgggattataggcatgagccaccatgcctggcctggcacttggattctatctcatgtgtagagggaagccattagtggaattt

SEQ ID NO: 218433 - DNA, 564 bp, Homo sapiens
aaggaagtgacatgacttagttttaaaagagcactatattgtgtggagaatgtgttgggaggtggaaagaatacaagtaggaaaattattttaggagtctaggcaagacatgataggggcttggattatggtggtgacaaactaaaatcctgttttgtttgcaattaatagacaatgaaaaagtatttttgaatactgatttgaaaatcttacttattttgcctccaaagcatacattttttttttctgtctttgctaaatcatttaaatccaagggttccaaactttttttttttctgcacacagtatgctagtggtggttgcttttaatattccagagctctgtagtcaagatcttgagtgtaggagttggttggggtggaaggactgtaataagttgagactagtggaaagaagaagctggtgccaagttgctgtgcagaacagggcataggtgcatactatagttccttgggaattctatgaagcttgggacagtgttgaagattctgtatggacaaggcccaccttagtcaaataggggaaaagaaagatatataaact

SEQ ID NO: 218434 - DNA, 401 bp, Homo sapiens
gaagggattaccaggaagaataaatagaatcaatgtattatactactacatggattcttttcatttattatgtaatttaggataatacctacctatttcagtttttcatttgggagcaggtatttggctagctctgatgctgtctctctctctctctctgttacccccacccccatataaaatatgtaatataacatgtatttgattttactctgagaagtactgaataattaaattgtaatagtattaggcaatatgaattaatttatgtgttgtattcagagaggttttaagataaaatctgtaagacctattttaaaagattatttcttgaaaaaggaaaaatcttattttaaaaaataaagcaattgattagtgttcttggaccaaataagatttat

SEQ ID NO: 218435 - DNA, 569 bp, Homo sapiens
tcaactatgcttaccgactctatagtgatctcacagctgttaaaataattataatgggggagagatgaaaaaggttggttaatgggtccaaatatacagttcaattgaagaaataagctctaatgtttcatattagaataagggatgattatagttaaccacaatgtattgtatatttcagaatagctagaaaagagggcatgaaatgttcccaacaaatagaaatgataagtacctgaggtggtggatattccagataccctgacttgatcattacatattctgtgcatgtaacaaaatatcacatgtaccccataaatgtgtccaaatattacatatcaatacaaaaagttataacaacttattcttaaaacatttggacacattatatttgatagtagcggtggtgaaatgtgtatttttactcatctagatgttccctaagtaaatacattctttttatctgtattcccaaggataagcacagtaaatacatacacagagagtacgtatttcaaaatgactattaaatacatgaaaattttattttgaacaactgattctttact

SEQ ID NO: 218436 - DNA, 459 bp, Homo sapiens
aggaaaatagaaatcaatgaatccaaaagttggctttctgaaatcggtaataatattgacaaaactctgaccaaacaattaagaaggaaggaaggaaagaaaaaacataaattaccctgtgaagaataagagagatgatttctttacagatgttacagatattgaaagtgtaataactgaatattatgaaaaacttgtcaatacattcaacagaaaccaaaaaataataaattcaattattattgagtcatgtaataaaattattaacaatgagaaatattgagttgtttctgcatgtcttttacatatgccgggtgcagtacttcatacctgtattattacctttaacatatgcatttcatgtatgtaacatatgtaataccagcactttgggaggccaaggcgggtagatcgcctaaagtcaggagttcaagaccagcctgaccaaaatggtggaac

SEQ ID NO: 218437 - DNA, 440 bp, Homo sapiens
tcactgagagaccgtgttgcaatgtcagaagcaacagcagcaacaaatggagatgtaatcagtgggactccagttcagaaacttatgctggtatcagctccatctattctttcttctggcaatggaactgcaattaatatgacacctgcgctgacatctacaggtgtttctgcccagaaattagtttttattaatgccccagttcctagtggtacatcaaccccaactcttgttgcagaatcattaaaacaaactcttcctcctccattgcaacacggtctctagggcaacaaagtcaggccctccaaggaaggggaagtgaagatggcctctctcgcactcccaccactgggaggacaatcttacaggcgcaggtgcttagccaggtagggtttggctcagggaggccatagaggggtccattgcaacacggtctctca

SEQ ID NO: 218438 - DNA, 1092 bp, Homo sapiens
tagaattaggcacaggtgctttgataagacacaaggatatttatccagactgggttagatgggatttttccagaatgggaaagtgaaacctgagttgaagttttaaagggtaagtaggagttagtcaaagaaagcagcatattctgaaggcctagaagtaagtacagcattgtgcttttggggaactgccaaaagtaagagttccagtgtatggcacatgtagtaggagggatgagtagtaagaagagataaaaatgaaaggtataagccaagcatggtagtctgttacgtgggaggatggcttgaacccaggagctcaaagtcaacctgggcaatatagcaagaccccatccctaaaaataagaattaaacaaggctcagttccttttatgtttcaagcaggggaataacatgatcaggcttagtttttatttagtttctgtggggccattctgttgttagtgtagactattagaggatggctaggattaggagagcctggaggcagagagaccagttaataggctgtgagtgaggcataactgagataataacatcgagaataggaagaagtacaaagattgcagaaagattaaggaaataatctagagaagattggatgctggaagaaagggaattgaaaggcttaaaaatgacacccaagttgttagttcttgccacagggtgagtggtacaataaaatagggttgttgggggagatgttaatttgggaaatggaaagaagatatataaaattttggacaagtgtagaagtctactaataagattaaggtagattatattttaaattaatactgtggcaattaaattttacagcaagtagcaaaaaagtactgctttccccagatgacatctggatgctttgctattccctccttgatgtccatagtctgtttctgtctcctagtcaaaacagtgttttgatgcgctcagccctagatcattcttactttttaaagatcttcagctattctctttgtatcatgcatcatcactaaaaaatgccatccgtctcgtgccactgcactccagcctgggcaatagagtgagactctgtctcaaaaaaaaaaa

SEQ ID NO: 218439 - DNA, 580 bp, Homo sapiens
ggtttcaccgtgttgcccaggctggacatgaactcctgagctcagggaatctgcccactttggcctcccaaagtgctgggattacaggtgtgcgtcaccacgcccggcctatcatatgatttttaatgtgacatagtaattatttaaatgttggtcatccttttctaaaggttatatctttgtatgcaagttcatttactgtcaccattcaccttactcaatttactgaaattgaggcctaagaaagtgatggcttatctaaagtcatatgttagttctggaagaacctactaggatgtggtaggaagaacatgggctttggggagatccaagttaaaatctgtaggcctctgacttgctttgtaaacttgggcaaaagttcctttacctgttgtacctccattctgtagaggtggaatagtatctgagtcatatcgtgaatttgtcatttttttaatttcattactccattcccagatgttgaatagaagtgcgataaatcagtcacaatttcccattgtgacagactcttcgttacaaaactagtttgtgtgaaatacatatgcagttgaccctcaaa

SEQ ID NO: 218440 - DNA, 405 bp, Homo sapiens
tagttttgctaggcttatttgtaacttctgtatccataaataaataatcgctgtggctttagcattaaataatatctatctatttaatattttgagtcatcatttttattgtggctaatgataatgactgggaattaacagaaaggtgacagatttctaaagatgcctttgaaaaatggctatttgcctctgtcctctcacctttgaaaataaactgtattttttaatctttattatcaatgaatattataagatctgaacactgttatgctaatatatatgtgtgcatctatcataagaaatatagaaaatatttattacaactattggcaagaatgtggagtaactggaactctcttacactgctggttggaaaataaaatgttttaaatactttgatgaata

SEQ ID NO: 218441 - DNA, 144 bp, Homo sapiens
ggacgggaaggtctatggtaccaggccttgcaaatctgaaagtatatgctgttgccttgaaagacaacagacttagttgggcatgaggttgttcccaacatttccccctgaaaactctactacgtgtggtttcattgtcttctg

SEQ ID NO: 218442 - DNA, 464 bp, Homo sapiens
gtggtggcacccacctggtgtcccagctactcaggaggttgaggcaggagaatcacttgaatctaggaggcggaggttgcagtgagctgagatggtgccactgcagtccagcctgggtgacagagcaagactgtctcaaaacaaaaacaaacaaacaaaattctaacattcaggctatacctcaggccaattaaataagaatcgctagcagtcaggcacagacatcagtactttggaaacgtccttgggaattccaatgtatagctaagcttggtattgctaccctaatacctggaggaggtaaaaacctgccttctcccttgtgttaccaaatccagttgagaaggaatcgaaagtgctgaccaatggaccccagcaagaatcaccactttcccctcccatttgagaaaagaccaaacacttgcctctctgcttgaaaaaaatatggaaatttatatatacta

SEQ ID NO: 218443 - DNA, 266 bp, Homo sapiens
actgaaatgccaaggaaaaacttaagagatgctgtagtagttaaagctgtactgtccaatatgtagtgtttggcagcatgtggctatttaatcttggaatatggccagtccaaattcagaggtactgtaaatttaaaatgtatgtgaaatttcaaagagttagtatgaaaaaaattaatgtaaccacttcaataattttatagtaattatatgtgaaataatgcttttgatatattgggttaaataaaatacattattaaaattat

SEQ ID NO: 218444 - DNA, 238 bp, Homo sapiens
tgctgggactacaggcatgagccaccacacctggcctagggtattttttttggtgtgttgctagcgtagcccaaggcagctctgtgcagggtaaagcaatggggctccgagtctggaggggtgtgtgtgtgtgtgtgtgtgtgtgtgtgtgtgtgcgcgcacgcgcgcgcgtgttatatgtgatttgtttgtgtgtgttgtgagagttgtgtgtgaggtatgtgtaagaggtatgttt

SEQ ID NO: 218445 - DNA, 673 bp, Homo sapiens
tattcattccctccattataaatttatcaagtgggttaagacatctggttattatgaggcatttattacattaagccttaaaatgtcttaggagaagatcaaatgtgaaaagggatattaacttttgtgtcactgccaaggatataaatggtattcctctgataaatttacctctggtggagttcttcctgtagcaaaaacatttcagaaaataaattttttacatttgtcagaaaatgatactcaagattagtatgaattctattttcctctttggatctgttttgaattaaagcagccatggcaatatcagggacactggaattgtaatgccactaaaatgaggatttttcagggacaagatggctatggaacaggtcctatccagtggccacgctctaaggaagtagggtcatatggtagaggatataacctctggaaggatttgattcctagcatcagagctagatagaggatataacccaactctttctccaagcatccctctctcattttgctaccccaatcagcattatggatataaactgaatttttaggcatgctaagaaagcagaaatttaggctgaggcaggtggattgcttgaagtcaggagttcaagaccagcctggccaacatggtgaaacctcatctctactaaaatacaaaaattaa

SEQ ID NO: 218446 - DNA, 410 bp, Homo sapiens
tattaaggattcatctgatgggaagttcaggaaggaatgcttcacaagcagggatgtgaagtcagcacttagcaagcagtgagcgttgggcttttaggagggaggaaacagctcgtatggaagaggagagttattggcttagcaaagacaaatagctttgtggggctagagggtttataggaacagtgtcagatgaagctgaaaagtagattggggtcatgcttttgtttttctttttgttttttgagacggagtcttgctgtgtcccccaggctggagtgcagtggtgtgatcttggctccttgcaactgctgcctccggggttcaagcgattctccggtttctgcctcctgagtagctgggattataggcatgcgccaccacgcctggctaatttttagatttttagt

SEQ ID NO: 218447 - DNA, 405 bp, Homo sapiens
tgtaatatgctatttgcaacatgtatcagacagatttactagcctttagaaatccagtattcatttatggcccccagcagattatatgtgatgttataataacataccttctaggaatctgagtctatattacaaaaaaaagaaaagatttttctagatacctgtcttaatcattaaatgtcctttcctaacaagataaaatattacctcattatttagaaatttttatttttatgaacaatttactttgaaaagcattactccgtccattttatagctcatataaatctattttaactaataattcattcactcacaaaaggctgtaaagctcagtatttaaggatctgatttttggagccaaattcctttgaatcctggctctatttcttctgagccatgcaa

SEQ ID NO: 218448 - DNA, 205 bp, Homo sapiens
gatggaaatataaatgtttgtaacaaatatacagtaatctgtgtttggataaatatcttttagtgtattggtgtggctaaatgtcagaatgaagttaagatagttgtattactagttctgtgtgtatacagatttgtttatgtagtatatatacatatgtaagtgaaggtatatgtgtgcaggtattaatcaatggatatggcag

SEQ ID NO: 218449 - DNA, 480 bp, Homo sapiens
aaacagtatgttctctgaccataatggaattaaattagaaatcaataacaataagatatctaaagaccacaacgttttgaaaattgaacaaaatacttaaaaatccatgggtcaaaatttaaaaatcacaagagaaatcagaaaatatgtaaaactgaatgatgatagaaatacatcatgtcaaactttgaggtatataaagtgtactaagagaaacgtttatagctttaaatgcatccatttgaaaaaaaggtaaaaaaatcagtgatctaatgttccaacctaaaacactagaaaaagaacaaaacctaaagtacaaggaaggaaataataaagaacataaatctgtgtaatagaaaacaagagaaaattaaggaagccaaattcattttttgaaaaaataagtcatcactaatattttaccattcattctatctctgattttgtctgtctagctagaagttgatccattttattgat

SEQ ID NO: 218450 - DNA, 516 bp, Homo sapiens
gagaggtcgtcaggcaggtgtgcagacaacgtgagtggtgagcctcacgcccgaggaatccgctcttcctgctggacgcgtggatggtggtgacggcctcgccgcagcagcagcacctggagctggcccctgccgggtgggtggtctccatggggctcatggcatctcgggggtcttggggggatgtcactctggtgctccgtttgcaggtacaaacctgccattctaggagctgactgatgatcccggtcctcgcccctgtcctcacacccctgagtggtcaggcaggggcttcactcggctggttctggcctccgtgctaaaatgaatgaataggacaggacagtgaggaaaacgcacacctggggaagtgacctgggaactcaccacccccacccacctccgggactccgacctcccagggcctcagccaggccctgccctcttcagcacattggaaacacctgcatctacccagtgtgcgctaggatggcagctctccagcctccatcctgc

SEQ ID NO: 218451 - DNA, 816 bp, Homo sapiens
catgaatacttgacatatttctctcatcactaagacaacatgccagttagtcaattaaaaaacaaaaataaatgtatcaaaccacgtggtattatgtggagaagacttgatcccaaatgttcccttttctcgaagttatttgctgttgtccatactatccacgctatccaagtttacctggataaatagaatgcaatcagaattatgttgaagctaatttattgataaaatatataccaaaatgtattacaaacataaaacttcatgaggtcagtattattaatttcaaattttgggtttttttctaacattaaattattcaaaacttttatttaaaaatgccacattcaggtaaaaggtagtagatgggaaaatttcagcagtagatatttcagaatacaatggttgtagaaaaagggattatgagtttatttatgtgcagatatacagttatgtttttaaaatctagattataaaactgatataaaattcgagtttaacaacatatcttattaagataagaatcttaatgcactatgaaaagaaaaacaaaacaaagcccagataacaggtttcttttggtagtgatctacaaggtattagggatatgatttccctcttgttctgctgtctctctgtccctcagtgattacaggtagagcatcacttcaataactcttccagtcagtattggtggtgacagccagtctgacctgaaaagaaaccaataccccttcccaacctggaaatgctggtaatttatttcaccatccccagcttccctatatttttccccatcctaccagcaaactttgt

SEQ ID NO: 218452 - DNA, 458 bp, Homo sapiens
gctcaaggagtcaaaagtatttattggtcacctgtgcactgtttacagagctctattctaggggctgagtggaggagaaggaaaaaaaagaagtcactagttcctgccttttaagatagctggagacacatgcagagaaaaatagctgaaggtcacaaagagcaaagcaagaaatcaactgcaaataaaatcaatataattcaccgatgtgtaataaatcgggagcaccaaggggaagtcaactgcaataagggatcttggaggaggtaacttttcaaggaatatgaggatatgaattagcactcaggagaacggaatgtgcatgtcaacagaattaaatgccactgtgtctcatattacccaggtacagcgggagaccaaaaggtgaccatgctgtggacccggttttccagaagcatcttatctagatgtggcattcgggacacaacaaaacacag

SEQ ID NO: 218453 - DNA, 221 bp, Homo sapiens
caggctggtctcaaacttctgacctcaggtggtccgcctaccttggcctcccaaagtgccaggattacaggtgtgagccaccacacccggccacttctgaagttctaagaattcataagacttgtaatcaaaatcatgaatcatggttatgaatttacagttttaaatacttagaataaaaccagaaattattttttctcacttcaagtcaatttaccaat

SEQ ID NO: 218454 - DNA, 155 bp, Homo sapiens
aagtgctttgctgtcatggagcttaaagtatagtgagttaatgagaaactgatgccatgtgtggaaacatctctttgcatttaatttaggtcttagttaagatagaatcttgtctcattcgtagccaaagtaattgtgtggtaactgaggaaata

SEQ ID NO: 218455 - DNA, 266 bp, Homo sapiens
gcacaatgaagtgtggattttgttattgaattggatggcgaagcattgtgtttattatgtgatgacactgtatacccaaagaatgcaattaaaacattaccatactaagcattcatcacaatattcccaactcacaggaaagcacgagtaataaaaaattacaaaacttaaaatgtaatacctcattacgacagaattttattacaaagataaaaatgagactgctagtatgaccttgataccaagactaaacaaagacagtgtac

SEQ ID NO: 218456 - DNA, 541 bp, Homo sapiens
agccacgcccccacacctgggattccagggcctgctcttctctgctggactcccagactgcaacccagactgcactgttagaaaccagagaactgcatgatcatgaggatgagtgggtgcctgtgggtcttcaagacatggcatccacctgccgtggaccagtccagtctgcaggcgtggactctgacagctggctccacccagtattcaggtctcaacctgcaccctcactgcccagaacccagccctttttttctgggacctgccacactgccagatcttgtcattccccttccccagagatgactacactgtcttcccagtccactggctggggacctgtgctatgtggctgcctctcctgcatcacaaccatctgcctccatctagagcatctgaccaggatgtacagcccacacaccgttaagcctcacactaagctcactcaaattacgatgtgcatggtaaaacctacccaaggtacttctgattgtcaagaaataagaaataaaataagacgggccacagaaaagtggttata

SEQ ID NO: 218457 - DNA, 261 bp, Homo sapiens
ggaaattcatagcaaccaatcaaaacgggcctggtttacttgatttgccatgctaaagaagttccctctattttaaccctataagaaaagtaactttgaaacaaccaatctgctttttgttctctgtttctgctttcttcagcctgtttctgtctataaagccaattcctctgctcagctcatcggaacactcattcttgttttatagaatgcagtgttgctcaattataaaattgcaaataaaaggcaattaaagtattt

SEQ ID NO: 218458 - DNA, 192 bp, Homo sapiens
atggcagagcagacttgggtggggcggggttaatactcacagctcatggagctcagccaggtcagtcaggaactgtcctgtgatttttttttcccctttcatgagctatgtgcaggaataccttttttttttttttttttttttttttttgggaaaaggggtacccataaagtggccccaacaccagaggga

SEQ ID NO: 218459 - DNA, 130 bp, Homo sapiens
cctaggacctcaaggttgtgtctaagacataatttacagttctcgtgtaggtcttccaaatacttagctacacagctttggggcgttttctcagccaaatacttttctttagcccttctgtcgtcttctc

SEQ ID NO: 218460 - DNA, 675 bp, Homo sapiens
gctcccggcggggaaacgtttccaatgcctggagcttttgtttgatagcgagggaggtgggtacggcgcttggtgggggtgaggggagcagaaagagagagagtttggtccccaagtattgagctgtgagagagcaggggcaactccagggccagcattcagagcggagaattagagctgcgcacgccccaggtcggatgcgacaacgaggtccccgggcctcagcagctaggtgacactgggcaagtctcagcagctctgggggcctcaacgtctcaactgtaaactctgggcacgcggctagcgccaggtcctctccagccctaacattctgtgattctaaacttgtctgatttgtctcatatgttgcaaggctcgtagcaaaaagaaaaaaatactccataactatttaacaggaattagctaaagcacagctctagagagagagacacacacacacgtttcaaataacccgaacactagaacctagtgaattttatacctttactaaactttagcgattatttgtttctttcgtaacaaaggttattgattagatttagtgctgaaaaaaaccaacaacgtgcgcttcggtcatttgtcttatggaggaaacataaatctataaatcttcctcctgtctctaagaaataaaactctcttcatttccaaagt

SEQ ID NO: 218461 - DNA, 764 bp, Homo sapiens
ctggttgctatccctgggggtgctttgcactggcctgtaccctttgaagttagatgtgaccatgtgactttcttgagccaatgaaacatgaataaatctgatgtgtattattacagatagaagctttaagagccagtgacctgcccaccacattctttcccccggccctggcaattgtgcaagcttgtttataggaaaaggtagcctctgccagccggggcccctgtgtgaccatgatgagtagggccctccctagcaattgtagttggacttgtagcatgaatgagaaatccagtcctgagattgaattggttgttactgcagtataatctaacctctcctgtctgataagaaatcagatgtttctgtatatatcaacttccagtaaaagaaaaaatcataagattctgctcaaactaagtgacaatttaaaaataagagcaagatgcatattcagtatatctttaaggcttgaagaaatagaaaatattttaaaaagccacaggtaaagctgacaaggcaattcaatggggaaagaatcgtcttcaacaaatggggctaggacaatgggctatccacatgaaaaagaatgaagttgaacccctgcctcacaccatatataaaatgtaactcaaagtggatcaaagacctacgtataagaggtaaagctacaaaactcttggaaaaaaaatacggcagtaaaccttcatgaccttggatttggcgatagtttcttaaatatatcaaaagcacaagcaaccaaa

SEQ ID NO: 218462 - DNA, 440 bp, Homo sapiens
gctaagtctgttttcagagccccagatataccccattcataggtaaggacaaaatacatcccaaagcagagacaccaatggccttggggacatccactgctgtagtgagctgctccactgtcagcttccctaagctaagatattcaagagtgggtcagccaggcacagtgactcacgcctgtaatctcagcactttgggggtccaaggcaggtggatcacctgaggtcaggagttccagaccagcctgaccaacacggagaaaccccgtctctactaaaaatacaaaattagctgggcatggtggtgcatgcctgtaatcccagctaactcgggaggctgaagcagcagaattgcttgaatccgggaggaggaggttgcagtgagctgtgatcacgccattgcactccagcctgggcaacaggagtgaaactccatctca

SEQ ID NO: 218463 - DNA, 831 bp, Homo sapiens
ggtgttccctttgtctatgattgccctggggcagaggatctaccatttatatgtacacggcctttgcctagggcggtgcctggtatttggggagaaaaataacaaatacttgttgaatgctaagtcataatgatttggtgtttccctttgtcttacctgtaattctaatgatgtcctattttcttttcttttccatagccatccatctaaacgtgtcatggttagtgaatagtgagcacatattcaaacaatgttcaaaatgggaaaaacacaaaatctattaactgtctctgtcttcatttaggaataattctcgttttgaggagcaaagtgctttcctaatcttcctatgatgcaccttctctggcactgccccgtaatgcaggggcatggcggcatgctttcttgcttgcacactcactctcctttttctttctctctttctccccatatgtgcagtgccaaactacagttggaacactatttccagttttgttcagtatttggcttccctacggcattagtatacatacactttgagacacaaggtgtgatctcaaaccaaatttgtgtcctctttaaaaaggtagcacagatactagctgatgctacattccttttccttagacaaacgttttacttctcagatctttaaagaattgttggattgcagaagtctagacttagcgttcattgtatattttagtctcctggaagtgggaatttattttgaatggaatagaaaattaggtaatcactactaatctttgctggcttacctgtaaaatctgtggtctccataaatactgggaaaataaataggtattttta

SEQ ID NO: 218464 - DNA, 486 bp, Homo sapiens
aaggatttaggtagccaacttaatttattatatctggtcggtcttctgcttgaaacagattcacactcaacacccaactaaggaggagccaaagtagtggagtattcctgacccaaaaaggcttttgaattttgaaacatttctaatgtgttaggttttctcaatgagaccattaaaaaacgttgtgttccatttgagaaaccagagtcaacagcagtaaatcagtgtgccccacaagccacgtcttattcagcaataaaatagtgctcacatggtgcctggcagacagtggctctggacagcaaagcactgagtcacccaaccccactcctttgggatggggttgggagtcatgcattggctccctttttcatcctggggaaattacaacacaacgcagagtgtccagaaatctaaagagctggtttaaggtgaaaaaaatgccatgaatgaatgaaccagatgtttaataaatcaaaacaacta

SEQ ID NO: 218465 - DNA, 282 bp, Homo sapiens
tgttcttaacgaccatactctcttgtaacaggcatatgcctggtgctttcctgacatcagttcatttaatggacattaaacaagaaatagattgcttgatatatgatgcagctgaaaaaagccagacatgactaagacagagatttgagacactagctccagcaatagctgtgttaacttggcacattatttaaattctctgagctcaggttcttaatctgtaaaatgagcttatctgtatctactcttctgtttgacgcagtgattaaaccagcttgctcc

SEQ ID NO: 218466 - DNA, 293 bp, Homo sapiens
agtgaatgtggcctgagaaataagattctccaaaatttttaaaaattgttgcatgaataaataatcctagctgcttatctgtagtttggagaactctagaagtgctataaatttgggctatacgtctaataataccaaatatcaagagtttctcccacccatatatttttattgtattttcaaggatgtcactgcttcgattatcctctccttccaggatcattaatctctcccaatctactggtttactcctgtgagtatccaacatggttaaaaagctcccactattgaaa

SEQ ID NO: 218467 - DNA, 304 bp, Homo sapiens
agtgaatacctttatataagattcttgacatgacaaaattatgaaatggttgcccggagtcaggacttggagttggggatgggtgcggaaggagtttggttgtgtctatgaaaggacaacagaaggcatccttgtggtgatggaattgttttatattttgactgtgttaatgttaatatcatggttgtgattttgcatcatatttttgcaagatgtcactactatgacaatgtggctagagagtacatgggatctctatgtattatttcttacaactgcatgtgaatctacaattatctcaaaa

SEQ ID NO: 218468 - DNA, 453 bp, Homo sapiens
ttaagacttcatgggtaggtagctatttcctcactaaatcactccctttaagccatctctttagagaacaatgtgcacgcctgagggtttacaatttgaattaacaacgaaagaaacttaacgattgggttactgtgctaagggaagctggtgacatgtgatcccatgctgtgcaagattccactgggcaagcatccaacacaggcccattgttcccagtgaagcactctttcaaactaaaacaaaacaaagcaaagcaaggcaaaaacaaaacaaaaacaagaagcacccagatagcccctgaagccatttaaaatacttggaagtaagactaaaaaggaagccccaagacattagaacagccaggttgaccaaaagaaacacctgcccttacctgttgaggcacacttccacgctggattatattctagtccatccaagcagtgtctacaa

SEQ ID NO: 218469 - DNA, 559 bp, Homo sapiens
cagggggatcgcttgagcccaggagtttgagaccagctctggcaacattgtaatacccagtctctacaaaaaataatttaaaaaaaaattagccagggatcccttgagcctgggaagttgaggctgctgtgagctgtgattgcaccactgccctccagcctgggagacagagcaagaacctgtctcaaaaaatatatatatgtgtgtgtgtatatatgtaaatatacacacatgtatgtatatatatgtgtgtgtatatatatatatattatgaaaggaaatgagtattgtaattttaggagttcagagcctggggagaaaggaaggactctggaaggcgttctgctttttcatggcctgggtagtggtggagaatttttttgatactgtatatttatattttagactcttttttggatgtgttatattctgcaatttttataaaagctaaaacacatgtatttgtaaaaaatttgcacttatgaaatcatttacccatgtttttgcttaagaaagtactagaacactaccactattccaataattacacctttatctt

SEQ ID NO: 218470 - DNA, 610 bp, Homo sapiens
aaatcagtttaggagaattgacagcttaacaagagtgatttttccagtccacaaacatagtaactctctgtgtgccatcttaatacctattaactaggtacgcattcctgaacatctacactccttagattgtagataaaaagctaccagctcctttcttcctggatcccaaaagccttcttcacagcttctgtttcctgattttctctcacatccctgaataactggcgcttcaaatgacttgtaggcctcaacaggataaaaatgtaagaatacaacacggcagccccaacatccacacaataagtgatgcacctatagagtaacagcagaggagcggggtggttttctcaaaccctcattaattaggaataatattaaaaaccaaaagcagaaacaatatgttttccttttaggaaactgaggtgttctgcccttggattattagatgcagttctggctaccacaccataaaaggaaataacacagttgaagaaagcccaaggaagggtatctatgacggccaaaagaatgaagagacttttttatggtgacagacccaaactaaaccaaaaacttttcagatgaaaagggacatggcagcagcctt

SEQ ID NO: 218471 - DNA, 411 bp, Homo sapiens
ccatgtttttacacgtgtgtgttcagttcccttattacttctcccagccctagacagtgggggcaggtctgtggatagaacagatgcaagatatgtgttgagctcatttctctcagtataactatgggactgggctcacacctgttatctcagcattttgggagaggctgaggcaggcagatcacttgagtgcaggagttcaagaccagcctgggtaacatggtgaaaccccatctctataaaaaataaaaaaattagccagccatggtggcatgtgcctatagtcccagctactcaagaagctgaggcaagagaatcgattgagtccgggaggtcaaggctacagggacccatgattacaccactgcactccagcctgggtgacagagtgacaccctgtctttaaaaaaa

SEQ ID NO: 218472 - DNA, 393 bp, Homo sapiens
atgaaagaaaataatgtgggtcagtaatttagcgtggtatcaaagaggtaacattgaaaggcttcctaaaggttgagtaggaactgtccagctaaagaagagagggaagaacattctaggtagagggaacagcaaaccctgaggtgaaaaagaggtttcaagttagaaaagctaaattaaaagcaaggagagtcgtttgagatgaggcaggagagaagtttacacaggacctcatggtccaaagtgattttagatattaatgttacatgctgcagggaagaagggaagtgacaaaattatatttgctttctaataggacactctgggtgcttggtgtagaatgaattaaagcacagcaagcaacaaggggggcacttagccattcaatagtcc

SEQ ID NO: 218473 - DNA, 225 bp, Homo sapiens
ttgtacattttattaagtgaaatagctattttaaaatttaagaataaccactaaatgtttaggaatgtattaatagtatgtaatttttcaagctaataaaaagagaaaaagcagtgagaaaaaatttttaatcctacgcttagtcaatccaaaagaaggaaacagaagaggaaaaaagaaaaggaaaggaagaaacattaaaaatagaatgagtaaaatgtctac

SEQ ID NO: 218474 - DNA, 446 bp, Homo sapiens
aatagctagcctcctgaggcttggttaacagatggactgtcagctgagtacaagcaaaggaattaagataatgaacacaatctttaatcagaatgaagacaatggaattgaaagcccattcttaggcttgatggttccaaaccttaggaagtgaattattgagaataattgtatcatcctttaaaatgtgaaacgttaaaagaagcagatctggtaagttgaacgttcaagttcaatttgaacattctgtataaaatgagaaccagcaaacgagtctcctataaccatcagctgtaggatgacttaagtcaggctctctagcacatttgtgaaacaatctttctgtaaatggtaagagactgggacatcagtgccattgcccagaggcagcagtcttgtctgttactctgggaatattaaagctaccaggaaaactgaaggctgtg

SEQ ID NO: 218475 - DNA, 643 bp, Homo sapiens
attgcttaaggccaggagttcgagaccagcctaggcaacatagtaagaccagtctttacaaaaaaaagttagtcgaatgtggtggtgagcatccgtagacccagctattcaggaggctgaggcaggaggatcgcttgagcccatgagttcaagaccgcaggaagctgattcttaccaccgcactctagcctgagtgatagagcaagactctgtctctaaaaacaaaaccaacaaaaaacagtgaagtaaattattttataaaacattgctacagatatctgctgaataaaatcaaattttcaaaatagggttttgttttggttttggtagagcacatctatagtagatattaataccagaataaattataagatatatatgccattttctgataactcaaaattaaatatctaaattttaatcatcagagaaatgctaatagtgttgagacgaaatattttttcattgctagaatgtattcttccagatccattgccttaaataagttactgtggcattacattagcttttgaaaggtggggattataacgtcgtagtagtccatgggtgccatgactctagttaagagcaccctttctgtagaacttactctttgtattgaacttgaggtttaaaaaaaaaa

SEQ ID NO: 218476 - DNA, 1320 bp, Homo sapiens
gcgggcggatcacgacgtcaggagatcgagaccattctgtctaacacggtgagaccccgtctctaccagaatacagaataatacaaaaaattagccgggcgtgttggtgggcgcctgtagtcccagctactcgggaggctgaggcaggagaatggggtgaacctgggaggtggagcctgcagtgagccgagatcacgccactgcactccagcctgggcgacagagcaagactccgtctcaaaaaaaaagaataatttctttaggtctcacacagtgaaaagaactcgcaagactaaagacccattgataaactaacttatctgtttctcagtaactacctagaaagatttcacttggacatgcaaaggaaacatgtaatctttaagaaaaaacagaaagatcctctttcagcatggggagctgaaaaaagaaaaaaccgaaagactacaaaggttttactttttattgttgttttttagagacagggtcttgttctgtcgcctaggctgtagtgcagtggcacagtgataggtcgtgggagcctcaaactcctggcctcaagcgatcctcccaccccagcctcccagagtgctgggatgacaggcatgagtcaccacgcccagcctataaaggctttaatcttagattctatgtattttaaatggtaggatacaatcccaaccagaagctaactcttggaaatttcacagctgataaatagacatctctgcttcagaatctttcttaactgaatgttttcaccaaatctttctgagctactgatcttcacttgatcttaaaataacaaactgatctgaaccttaatgaactgctgcatgacctggtgtttctatactgctaatgactgatgcaagtagacacatgagtgatgagctgtgacaatctatatcaatcattacacaatctagttcacttactgcacataatcatggtagaaaataaatgaaaacaaaattttaaggtataaaaaattagtgtacctcattattatttctgggtaaattttttgtcttttaaaaaatagtgcctaaaacattgtcttatctatgtgacattcagtgactactaattgatggttattgtgttgaattactcctattaaatgtgggttccacatacttggtttcaatttatacattccatggaagaatagacatgttttattatcatcatctcttggcattttttttcaggataacagacaatggaagtaggataagtgtaaactttttgaagtatgttattaatgttatttgattttaaataatgaataaaagaatgagaatgagaactatgatt

SEQ ID NO: 218477 - DNA, 362 bp, Homo sapiens
aggttaaatttttctctaggttttattggccatttgaatgcccttctttgtgaaccttctctttttttttgtcaataaaagttgtattgagatgtgattcacatactgtacaatttatccctttaaaatatgcaattcggtagtttttagtgcattcacagagttgtgcagccattatcgtaatcagttttggaacagtggtcatcattccccttctccttcttagctccaagcaaccactaatctactttccgtctctatggatttgtgtattctggatgtttcatgtagatggaatcatgcgatgtgtgatcatacaatagaagactggtttcttctatttaacataatgttttcaaggt

SEQ ID NO: 218478 - DNA, 375 bp, Homo sapiens
ctagatcaaaggctgaacattttgctttagtatagatgagggaaatgagcaagtcctaaaaggtttgccctgttacggtgtttcatcactcatactggaaggagaaggaaaggagccatatgactcatttaaaagaaaaactgtaagtcaccttaaattccctatgttttacttcattttttccctattgaggttgttacaggtcatggttgataatagttggtgttgaatgaatgtaatccattatttaaaaacaggtacatttaagtgaaaagataaatgtaaaaagctgttcatatcaaagccaaatagaaatgatttttatgcttataatttacatggtgcaatatatctttttaatttgtttacttttca

SEQ ID NO: 218479 - DNA, 367 bp, Homo sapiens
aggcatcctgtaaaaatcaaatatttttctttttaagtaagaggaagtgcttcacttctcattgtgaaacattaggacatgttcaatgcgatgttccggaagaatggtaaagtgtaatttaatgatgcccataatcaggccatggaatgtgagaagcactgaaacatattcagcattttgcctttgacagtatcagcaattattttcctcccaagacatattgagaacacatataattaggtcatttgagaaattaaacgagggcaaacagcactgacaacataaatgtagctcttattgcccacatctataaataatttaaagcatagccccaccagatgtcatcccactggactactattaaaaa

SEQ ID NO: 218480 - DNA, 681 bp, Homo sapiens
tggtacagaagataggagacaaaaatagtagatgatgtgtacaaaggacttaggatacataagtcttggtataaactatatcagaatgaagaggccctttttaatgttcagcattgttactgagactaagaacaatcttgtgtcagcaaaagacagaggtttgggagccagacacatttggtttcaaatctaggctccatcattccttcctctcctcctccagtaaatatgtattgagtgcctgctatgccataccctgtgccgaacatacaacagtgaatgaaacagagcttctgctgcatggagcctacattctaatgagggaagacaaacagtaaacaagtgaataattaaacatatatgccaattggcggtaagagcagtaagcatagtagggagaatacagagggccaagaagtgattgcgcagcaattgctgtaatgtgcagagcacaggtgttgggggacaaggcagaagcagagagggcaggtaggagactgttgcagtaatctaggcataaggtgagggtggctcaaagcggggtagtcacagtggaggagactggcagtaattaaattccatggtattttttaagtctagcaaacaggatttcttgatggagcagatatgatagacaaatgaggaatcaatgatgattccagggctttgggtttgagccaa

SEQ ID NO: 218481 - DNA, 354 bp, Homo sapiens
aaggttttcccctataaaaaaaaaaaaagcagtaaaataactttttaaacttccctcttccataagagctacttccttcctcatctttatccttcccatctcttctaaaaatacaaaaaaaattagcccggcgtggtggtgggcacctgtagtcccagctgctcaggaggctgaggcaggagaatggcgtgaacccgggaggcggagcttgcagtgagccaagatcgtgccactgcatccagcctgagcaacagagcaagactccatctaatttagtgtacaatttgagttttgacaaatatagttgtccaatctctaccaaaataatgattttgaacatttctatcactcctc

SEQ ID NO: 218482 - DNA, 257 bp, Homo sapiens
gctttctgtaatcagatctttcacaaacccaaattagaccacactcttttttccttgcttatttcagtcttttatattcccttttgagaactcccctggctgttgctgccatcctctctcattttctttctcaccactgttactgcaactgaagttgcatttcatgcctcacctatactgaatttccttagtaacttgaaagttccatatgctctcttatctcttgcttcttgtccttcttccccttcaccttgctc

SEQ ID NO: 218483 - DNA, 322 bp, Homo sapiens
ttgtctaatcatttaggagccaaaaggaagctgacttagacaatagaccctaggtaattaaaaaaacagaaaatagggtttttcatataatttaaaagagcatatgatttaacttagaagagtaaataataaccgagaaaaaaatgtttttttgaatgttttatcatgaatgaggaacatgtgaaaaacccctgagctgaaggaaccacaagcccgcaattgtcctggccttgcagcccttctcctgcagggggtgccctccctcccactcctctctagatgggagccgaagggaagaggtgaatctgagttgagaacaaca

SEQ ID NO: 218484 - DNA, 451 bp, Homo sapiens
agagggccctcctttcgtaattcctggggaaggaactggagttctttcccttgggtggctgcttgaggggagtagcatgaatggaggcgaagtcaagcaatcagccaattagcatttatgcatccaggataaaactactgttacacaggagagaagcaggaaagaatgccttgaccccattgctcagggtggcacgtgggactgcttttgagtaatccctcagtctaagacccataccacagaatcctagagccaggtgggactccaacaggtcaccttctccatccctccctgctccatcccaggaagattacagtctctgttaaaactctgcacagtggaaaaactccatagtatccctgggtaagtccttacagcaccatctaacgcttatagttgcggaagcctcctttagcatctaacctaaatccatcctgctataaagaaagca

SEQ ID NO: 218485 - DNA, 145 bp, Homo sapiens
ctccttaaattaagaagtgagtccattaaggtcacagaatttaagataaacacaatcaaattaattctatttctatatacagacataactcattttatcgttctgcaatttattgtgcttcatagatattgcatttccattgtgt

SEQ ID NO: 218486 - DNA, 425 bp, Homo sapiens
ttgcttgagcctgggtgtttgaggctgtagtgtactatgatcatgcctgtgaataaccactgcacaacatagcaagaccctatttctaaaagaaaaacaaaaagtcttttatctcctggaactctttaaatatttctcccctctgtttaactaaggtatgtgataagagggtcttttctttttcccttttacaatatgtttctgggagactgaccaggaatttcacctaaatacttcccattggtagagtaaagccagcattgcagccttataaagaacattctgagattctcagcccaagtgagggaaggaagactgtcttgtgctttgatatggtttggctctgtgtccattgtaagtttcctgaggcctccccagccatgcagaactgtgagtcaattaaacttcttttctttataaattac

SEQ ID NO: 218487 - DNA, 443 bp, Homo sapiens
ctcttcagaaggagcagctctggcagactgttgccatgtagtcatgtactccaagagcagttctaagagataggggattgagacctccatagctcctttagcaccaactccccaacctttaagataccccaaattgtataacatatatatattcatactcatatataatatgaattatacatattttatatatagtcataggccacataaggacattcagtcaacagtgggccacatatgcaatgtggttccataagattataatatattttactatatcttttttatgtttggatatgtttaggtacacaaatacttactactgtgttacaactccctacaatattgagtacagtaacatgttgtacaagtttgtagcctaggagcaataggctatttcatataacctaggtgtgtagtaggctatacacatctagcatact

SEQ ID NO: 218488 - DNA, 507 bp, Homo sapiens
ttttatatttgtagtagagatcgggttttgccatgtgggccagggtagtcttgaactcctgacctcaagtgatccacctgccttggcctcccaaagtgctaggattacaggtgtgagccactgcacctggcctctttgtttttttttaaagttgttttgattattctgtgtcacttgcattttcatataaattttaggaatgccttgtctatttctttaaaaaaggcaggaattttaatggagattgtattgaatctataggtcaatttgatgtagtgttgtattgccatcttaacaatattaagttttccaatccatgaacatgggatatctttatttaggtcttctttaatttatatcaataatgttttataatttcagtgaataagaagtcttgcatttattttgttaaacttactcctaagtattttattcattttgatgctgtcccaaatggggttgttttatttcatattcagatttctcattgctagcgattctggtata

SEQ ID NO: 218489 - DNA, 415 bp, Homo sapiens
tctctcctttccttcctccttccttccccaggaagtctccaaaccatccctgttttgtgtccaaagcagcactgcagatatctcccctccctctctcttcctgtttcttctggcagaccaggaggaaagggacccaggagcccaagatccaaactcccagtagtataaacactggatgttctgtggtgcgtctgccacccactgcagcctcatctgtcatctggttgtcctaaggcttccaccttccccactcagccaggggccctcccttggagaggccgacctcaattgcttagactaggggtatccaatcttttggcttccttgagccacactggtagaagtagaagtgtcttgggccacatgtaaaatacgttaacactaacgatagtggatgagctaaaacaaaaattgc

SEQ ID NO: 218490 - DNA, 606 bp, Homo sapiens
ctcaggtcactggaaatccgcagcaattcagggaagaagataagaacaacagaagaacaaccaccataggaccaggaatacgtactaggtccagtgttgcacctgcaggaggggaaggatcattagtgaaagctgggccactgccacccgggttcacaatgcctgcctgactgaggctaagtataaaggtcagggcatgtactggttcttcatccctgctatgctggcaagcatcaagtaagaaactttcaaatatagctacaagacacaggttctctctacagagtggtacaaaggagaaatctaagaagagaacacaaagaggagcaggctttggtaacccccacttaccaaataagatatactgaaaaaaggtaaggtgaccaagaagaatttgaagcctctgttgtactgtgggtaaccatagcaacagcaaactcaaacccagtccaatccctatttagatgaacacaaatccccatgtgaaaactatttaccttattctctactatcctatacacaactgtcagatttcaacaataaaaggagaggcatacaaaaagacctcaggcacattgttagaaaactgattatgtaaattatacg

SEQ ID NO: 218491 - DNA, 290 bp, Homo sapiens
aaatcaaagttgggccaggcatggtggctcacgcgaatcttgctttgcagggccaaggagggaggatcacttgaggtcaggagttggagatctagtgagactctgtctctacaaagaatttaaaaattaagctgggtgtggtggcgcgtacctgtagtcccaactactcaggaggctaaggcaggaggatcttttgagcccaggtgtatgaggttacagcaagctatgatggtgctactgcacttcaacctgggtgacacagtgaggtcctgtctctttaaaaaaaagaa

SEQ ID NO: 218492 - DNA, 475 bp, Homo sapiens
cactcagctctgcaaactgtactagaggtgtttcaattcccttatttctctttcatcactcaaattcctacctcttccattaaaaagtatgttatacttttgacagtatttttacttactggtttcaggaagttagaaaaacagagcctgcccctttaaaaccagaggtagagaaatgcagggataattaaattccaagtagatacaagtattcagaggcaatgccagtgagcaaagatcatgttactcacaatccttttaaaaggtaagtcagaaccacattgaaaaaacaaaacacaaaagctggggactgtgaagacagaggacatgagatggaaatgtctacctaaatggaagaaaccgaggcaagattaacagtttatgtgggccaaggctgaggactgcagccagagatatacttctaagttcaggaagtgctctagagacaaaagaggggctccaatttctaaagaaa

SEQ ID NO: 218493 - DNA, 434 bp, Homo sapiens
acccagaagttgccatactgccctggatgggacgcaagctctgaagcagtgactaatttggagaggctggcccacagcagaagatgcagggccggaaaccaaggaaggcaagggtccctggagacagacaccccacccttcttcctgttccagtaccaccaggtggtggacatatcacctaagctcggacagctgaatcttccatcctgggacctgaacccctggcgctcactggatacccagataaagtgctcactggatacctcactagctcctgggacagtgccatggccagtctcccatcacacaccttccggtggctcctccactcccaggagtgagcctggatgccatcccttccctagcctggttccccagccatcccatcaattctgggcacacctggcccccttccaataaattccctttttgct

SEQ ID NO: 218494 - DNA, 298 bp, Homo sapiens
tttttaaatcattttttctaaaagagagaaaatggtagaggattcttgacagacatgagattctctcattgcataatctttttctataccatgttatgcttttttattttctctaatatgcatgaaatgtgtaagggataaaatctgcattctcgtggaaagattatttttatctagccccatatcttattcattaattttaacctagaaatcattttggagaacagccaaacactcagctgctctttgattaaagagaaatttgggactggttggagcatgacattctagaatccca

SEQ ID NO: 218495 - DNA, 572 bp, Homo sapiens
tgccttaaaaaatgcaccaattatcagcctgaccattttaatataaaaaatgtttatattatagtataaattattaatcaatctgccacaatcattactttagttaaaactgaacgtacttgtggctagcataggaaaggagacattttcatgttaacgtgaatttttttaacctaaattattgcagcctattgatcctagatctgaatcttcaaagaaaactgatttatttcattaattggaatattttaaccagagaagtctatcaagttggggtttcaacctgaatgaaccttttccatttagaaaattgatcttccagtcacacttttatgaaccttgagcttttagagcatggttgcttttaaagacagagagatcatctccagtaacatcttatatcattgacaggttggagtatggatgttagagcaaactaagtttgtgatatataaccacccacatacagacaaaatgaacaaggcatatatttaaatatgcaagctagacaacatgcagagcagtgagtaaggagtaaatactgagtcacccttagaacataatatatgctg

SEQ ID NO: 218496 - DNA, 429 bp, Homo sapiens
ctaaggcctcaatgtgttgcttaaatatcaggatctacaaagaccttgaactgtctttgtgagcccctggtcccaccgcactccttgtagacaggaggcagaccattgcagtgggtgatacccagcctgcagcaaggccagcgctcaacctattgctaccaggaacacgtactctcaggcctgccagaggccaccagacagatgtaaggcatctccccctgaagtggccccttttttggatggtaagcattttaaaacatcagttttacattaaagtaaatttggacgtattacttgcatgaaagcaaaattcacgtgaatttgtcaaggtaaactggagattctaaagctgtgttggcaaactctggccccagggccacctggcccttcacctgtttttgtaaataaagttttattggaacacagcca

SEQ ID NO: 218497 - DNA, 415 bp, Homo sapiens
aattaacatccaccattttattctatttaaaaagttaaatgaagccaagatactggcagcacttgaaggctgtcccctcctcctatgccctttgggatagccccaccctagggactgggcaagtgtgggtaccatgaaccttttggcattcatttcatgagtatcagatccccttctccatctcccaggagcaacacagtggagagaacacgttaacctgattgtgggagggcatccactctggcagtgaaagcttcacttgacattctctaaagctcaacaagagtgttaaagcctatctttaaaagaagtgaatgggcttcctctggaaagatggcctcttagccactggtcccctgttagactgaaatctgtcttgtgtggtcaggagccattaatgcgctgacttgaagcc

SEQ ID NO: 218498 - DNA, 385 bp, Homo sapiens
catttgaaaatcaattaaatccattaatgcaattcaccacatcagtaggctaaagaagagaaatcacatgatcccttcaatagaggccaaaaaagcatttaacacccattcatgatttaaaacatctacaaaaaacctgccactaacatcatacctaatggtgaaaaacttgaagcattcctactaagatcagggataaggcaaggatgtctcctcactactccttttcagcattgtactggaagtcctagctaatgtgacaaaaaaagaaaacagaagaaaagaaagatacagggctgggcatggtagatcacgcctgtaatctgagcactttgggaggccaaggcaggtggagtacttatggccaggagttcgagaccagcct

SEQ ID NO: 218499 - DNA, 678 bp, Homo sapiens
tcgaatcaggtttacaaattccgttagttccattataatataattgagagtattttatcatggaagtcaggagttcgcagaaagccaagctgtgtgatatgtcacagaaaattcaagtaaattaaggactaaaaactgtccacagacattgacagtttagatcatatatgtagttgtaatgtgttttctgttatacctgaaaaatcccttaactgctcttaggttgagtaataaacaattaacgggtgttttatctcactttgaacataactaccaaaaaggtattaagattcagagattgctgttttaatattctgcacatagtgtattttaaagcccttgttaaacagaagtattatgtagatacaggcatgggctagttttagtcataatagtaacactgacttaatgttaccgtaatagatggccgaaagagttgactaaactctaaaaacagatacataagcaaattaaagtatatttttctgttttaaaaacaaatttacatactttttaagagttcggacgaaaaacctaagaataagaatcctatctgccattcatttctttttgtagtgaatgaagcttatacagaataaataagttccagataaattcaacaggtgaatcggatacctgctctatgtcaggtgctgggaatatacagaagataaaaca

SEQ ID NO: 218500 - DNA, 435 bp, Homo sapiens
ggttttcagttctctttgtaaataatctatttctgtctaaaatacaatttaaagtcatactactacaagacttctagctccagaaattttactctgtaccaggcattgtgcaaagtatttgacatgcattttaacccttacagttttcctgtaaggcttagattctgttctttccatctcacagattgctgctggtaatactcattgaatagttagtgtgaggcgctgttctaatcactgctgtcttgttttctctgaggctaacttacccaagggtgccccataagctagagccaggattgggtgtgggtggttggcagcagcccacgctcctcccccacgtgtggtacagaggtgcagcctgagcttgtggggtcgctcaacagggagtggggagcgggatcccagcccagatctgcctgtgcttcatcatgc

SEQ ID NO: 218501 - DNA, 1326 bp, Homo sapiens
ccagacatgggagccagttcgtctgtgaggattttctccaggcatagtcaagtgtggaaaatgaggacaatgtggtgaacttttcataaaccaatggattcaggttgaagacctggccatttttttctgagattatatctctccaatctttatccttagccacagtgtcttctttaatgaaatggtgttgattatggatgatagattttttttttctgttggccaaattagaagttggaaaccctaggttgttattccttcccttccccaaatttcaaagctttaccagtttgagaaatcccagaatctcagtcctcaagaaattgaacctctaacaaggatacgtggatgtgcacatacgatgctatgtctcaaggatgacatttagtgccctccaagaagtagaagtgatgccggggaaccaccaaggaagaaggaccagcatctctctggggagcctgcagacggtctgtgcatgaaatgggctttcaaggatggacatgggactgaaagggggaaattgggcatggacctggggcataaggaatctttgtcatattccatggtagagagggcccagaggtgtgagagcagcagttgggtttccagaacagcggttgggtctttcagaccgaggagtgctatgtagaagtgaagggccttggatgggggttggggttcatatataggagcagtgcagccctccaaggggctttggagctgtaacggaggactatacacctggcagtagaggacaggtaaactgaggaaagcagggtcccaaggaggcagtctaagaattaaaaagttaatgggcagtaatttgtggaagagctgatgagaacctgaacttaaatctctgataaaagagttcatatcttgggagaggatattttctcataatggcacaagagagctctctgggtgctggaaacatattcgacctctttgtttgggtggtggttacatgactgtgcacatgtttaaaactccgtgatcgtatcctttgctgggacacggatggagctggagaccattatccttagcaaaataacacaggaacagaaaatcaaataccgcatgttctcagttataagtgggagctaagtgacaggaacacatggacacttatagggggaacgacacccactggggcttttcggaaggtggaggtcggaaggagggagaggatggaaaaataactaatgggtactaggtttaataccagagtggtgaagcaatctatgtgataaaccccagtgacacaagcttacctatgtaacctgcaattgcaaccctgaatttaaaataaaagtttaaaaaaga

SEQ ID NO: 218502 - DNA, 499 bp, Homo sapiens
tggaagtgtaagcgtgcacagacagcaagcgtgcaagtgcaaggatgcacagagcgcaattgtgcaaactaagggaacagagagagcaagtgtgcaacataagggtgcctagagtgcaagtgtgcaagcataagggggcacagagaacaggtgtgtaagcataagggtgcacagagaggaagcatgcaaatgtaaaggcacacagagagcaagtgtgcaagcataagggtgcacagaatgcaagtgtgcaagcatggcatatgggagggaagtcagggatttcttcctgggcagaaatatcaaactgggtctgtaaaatacaaatgggtatgggagggacaaaatgtcttaaagccaaaaggaagaatacaggttgggtacagattgaacaggaaactcttgtgagaaagatgacatgtagcaaggacctgtaaagttaaagaaatgtcccgaagaactaccaaatgccatcccaggttattagccacgctgaacctac

SEQ ID NO: 218503 - DNA, 254 bp, Homo sapiens
actggaagatgttttcaggccctacaagaataagaagtcttaaccaggcccgagttctgcttcctgggagtatctccccaggctgtatctcagcacagctcttgcctctgccctcttgggtgtccctccttttccagcaccttcttggccatgttgaagaatgtgccctttgagaaactttctcaacctccttcctgtcattagcaaattgtgagcccacagaccttttttcactctaaactgttctgtccaca

SEQ ID NO: 218504 - DNA, 276 bp, Homo sapiens
tactaccatatatttgcttggggatggctaagcatggattgatgggcgagcttttggaaaaagcattttttaaatgcttttaaggaatattaaatttttttcttgccatgagaggcacagtgtaagtttggcatttagaaaaggtgcaagctggattgtcctcaggggctgacccgcacagtgttaaattttaggaaatagcagagagagcttggcatgatggattattttaagcagtgggattttgaaaaagagctactatatagtttatatttg

SEQ ID NO: 218505 - DNA, 413 bp, Homo sapiens
ttttttttttttgagacagaatcttgctctgtcgcccaggctggagtgcaatggcacaatctcggctcactgcaacctcggcctcccaggttcaagcaattctttctcagcctcccgagtagctgggaccacaggcgcccaccgccacgcccggctaacttttgtatctttagtagagacggggcctcaccacactggttaggctggtctcaaactcctgacacctcaggtgatctgcccgcctcggcctcccaaagtgctgggattacaggcatgagccactgcgcccagccctgtgtctgctattctgagagcagaagaatctccaatttttataaaatgcaagccattcctcaggtatgaagatgacaacctctggcccattagaagtgagttgtttggattgtcgacgc

SEQ ID NO: 218506 - DNA, 526 bp, Homo sapiens
cttgttgctgtcagaggatgtgtgaccttagctaaagtagaaagataaaagaaggaagatcacatcgacaccttctaagagttgaggccccagattcaaaatgccaaatttatggaaggatacaaatgaaccataagaaatcttatattggctgggctcagtggctcacacctgtaatcccacactttgggagcctgaggcaggaggataatgtgagcctgggaggtcgagactgcagtgagccatgatcacgccactgcactccagtctgggcaacaaagaaagactctgtcgagagagagagagaaagcaaggaaggaaaaagaaaagaaatcatatcttgaacgaagggtaactatatttgaccatctttttttattctatgctttgggataaatctcagtgtcttatgcctcagatgatatcatcagcacacagtgaaacaatattacattacattctcattatcaaactctcacaactataagattccgtcctgtttcccagaaggtcaaaatgtgtttta

SEQ ID NO: 218507 - DNA, 204 bp, Homo sapiens
acatttagaacaagaacagtaattagaaactcttataattacttataaaaattaaggatatcagtatcctcctagatcaaaattttggtgtttagtaagttagaaaacattctgaacaaaaaggaaatatcttcaacctctagtgatcaatagaaaagcaggtatataaaaaagaagtttgattccttttaaaacatgaactaa

SEQ ID NO: 218508 - DNA, 565 bp, Homo sapiens
tggatcacctgaggtcaggagtttgagaccagcctggccaacatggcgaaaccccatctctattaaaaatacaaaaaatcagccaggcgtggtggtgtgtgcctgtagttccagttacttgggatgctgaggcaggagaattgcttgaacctgggaggcagaggttacagtgagccgagatcgtgccattgcactccagcctgggcagcagagcaagactctgtctaaaaaaataaaaaaatttaaaaagcccatgagattggtgaaagtagtgaagcaaaataagtacaagtctatttctgtgaattcacacatagtagctactcagtaaataactgttgaagtgaatgaataaaagaaatgtaaaaggtgttttaaatttagaatctgtggactcagtaatggctgactgtaagagaaatggaagatggagtagttgaagatgtttcaagacaaggagcgccttcaacacggcaatcccggtccaactttggaagctgcaccctagctaagctctcgagacatgaatcaagattaggatatttattgcagcattgttcataat

SEQ ID NO: 218509 - DNA, 391 bp, Homo sapiens
tttcccccccattatggatgaaaattctaatgtaaatattatagcatgaggtttttaatttttttcaacagaagacacattcctttattttcatgacataataataaatgatactattttgatttcattttaaaagtcaattttctatccttttgctgattccttttacttcagaacttgcagcaaatagtttagcattagttcttctgtgcatcttattagtttattagttatacatccaagtgaagggcagagtggtatataccacttaaaaggcatttggaacagaatttaaaaggcaacaagacaacacaggggccagaattaatgagaacaatcattactagcacaattaccagagtatttttttgaaaattaaatacaaaaaaaa

SEQ ID NO: 218510 - DNA, 294 bp, Homo sapiens
cctatcaaaagtgctcctcgtcaaaatagctctgtttttcattctttcaaacatgagtaagttaggcacatcctgtttgctatgtcatggcttttccttaaactaggtcttattctttggaaaatacctatgtgttttgttgttttgttttaatctattctgaaaacatcagcttttatgaattaacccacaagttattaaaaatgacatattttaatgcaaataaaatatttctatatttagacaatttaatcacatggattatcttaacactatcagtttaaaactatgagt

SEQ ID NO: 218511 - DNA, 356 bp, Homo sapiens
aaagagtggaattttgttttattcatgtttgtgtctacctacttatattttgctaggtgggccagatacttgggggtcagatattttagtgtccaataaatattcattgagttaaattgtataaaaatgtaggcttggtgtcttgattactaacaaaactattttgttttgttttgctttttttgagatggagtttcactcttgtcgctgaggctggagtgcagtgacacaatctcggctcactccaacctccacctcccaggagagtcgcttgaacccaggaggcggaggttgcggtgagcctagatcgcaccactgcattccagcctggtgacagagtgagactcttgtctcaa

SEQ ID NO: 218512 - DNA, 481 bp, Homo sapiens
agctccgctggtgagggatcattcatctaaaagtccattgtggctgctgggtcaggtttgagaagcagttggcttccgcagagttgctgctacaaaaatgtggcatctgtctgtttcttttgtttgtaatactttttctcataccccttgtctggccgcttctagatctctgccatttatggtctagaaggtagttgcttctccctgtgttgtgctgtgtttagaaagatagtctgaaattcagaattaggcagttatgttccagtcttctatcatcctattaaagagaaaaagaaaaacttgcgcaaatggggtggattaaaagtttgggtcatgtgaagttcataaagctatatctccagagggaaatgctaaaaatatactcaaccactaaaattgcccatggagggaaataagtttattgctttattggtcatgtaagtcagttaaaatataatcaagtcagcctcctcactgtctt

SEQ ID NO: 218513 - DNA, 501 bp, Homo sapiens
tggcatgtttttcatatgtatatatatattgcatccatcaaactttagggtagttcttaaagctgtgacccctctagtttcttctgtactgttggacctttcatagcttgtcctctcaactcacaaattaccaggtggacactacttatccgccaattctcctgatatcgttgcacccatccatctatagaacttgctcagcaaaaccctgttctgagtttgtgctgtaacgtacttgtttgattgaattcctttggagaaaaattagtaatgttttcattctgttacagatactgagttcttaatgttattgctaatggtagtggtggtatatttttatagcagtaaaattttcatgtgctatatatagtacagtacttttgaaattgtttttacgtgtatatatgaagtgttctttcatgtgtgaatacaacccttttggagcctttcagttttatagttgtgtttacttcagaagccatacaatatctttattctaaa

SEQ ID NO: 218514 - DNA, 151 bp, Homo sapiens
tttgtttttacattcaggacattgtattcttcaccttggaatgtttcctcttcaatagtaattgctataaatctgataggcaaagttgtaccccacctgcatcaaacattttattttcttaacttctagtctcattatctggtcccacttt

SEQ ID NO: 218515 - DNA, 579 bp, Homo sapiens
ccactgtagtctcttacatttgattctcatgtattttcctctaggggagagaaaaggagatttttcaaaaggaaaaatacccctttgtctgactgttctgaaaatagcgcactccagaatataaaaatgaaagtgtgggttcatagtacatgcaggccctacgtgtgacctatcctgaagtgttctttcttgattttatgtggcactggggatgtccttgagggaaaaaatagccaggggttttactttggtgatgcgttacgctagccggcttcatgtctcacgtaaatggtaacctttgctgagtgtaaccctagctctttgtaaagagaacagaattagactccaccaaatgaagagtccaagaccttggcaatcttaccctggaaagatgacaagatacatagagatcagacaaatgaacaatgatgatgcctttataacattgcctgaatagctaggatgtctgcagagttatactagcttcatggatattatataggttcagtggtctgaaaaataggacattagatctatttaaaagtgaacaactgaagaatttgacagtagcttcattcg

SEQ ID NO: 218516 - DNA, 487 bp, Homo sapiens
cacctagagaatttagaaactccttggctgtcttctcattttggccaccaaattatccggtcagatcataggtataaacaagctgcagggcccttaggccaagggttaaatcaagagggaaatgatcacattccttcaaatatagaatataatattcctgtatgatttggcatgactggagaaatattaaataggtgtaacatttcttgcttaagaaagggctggtattccggccatagtggctcagacctgcaatcccagcactttgggaggctgaggcaggagggtcacttgagttcagtagtttgagacaagcctggacaacataatgagacgccatctctattaaaaaaaaaaaaggaaaagaggccaggtgcagtggctcatgcctctaatcctagcactttgggagtctgaggcaggaggatcacttgtgttcagtagtttgagaccagcctggacaacatagcgagacgccatcactatt

SEQ ID NO: 218517 - DNA, 288 bp, Homo sapiens
agatggtgtttttctcgatttcgccccaaggagggtgctcggacttcgacgtgccgccatctttgagcagggcacagctgtttacagccttggaatggatatcaggctgaatggtggttgcttggcaacgccccgccacggtcgccatctttgagtagggcacattgtttactactatatactggaaacctacagggaatgtggttgctaggcaatgctttgggaccatcgcaatctttgatccgggcacagctgttttttccgtttagaatgtaaatcatcaaagcc

SEQ ID NO: 218518 - DNA, 309 bp, Homo sapiens
agttgatacttgttgaatctcattgatgggcatgtgggggttcactttactgttttctgtattatttgattgaagtttttctttctgtttttttgagatagggtcttgctctgtcacccaggctagagtgcagtggcacagtcatggcttacacagcctcaacctcctcccatctctgcctcccaagtagctgggactacagatgtgcgtcaccacgcctgtgctcaagtgatcctccctcctctacctcccaatatgttggaatgacaggcatgagccactgcggctggcctaataaaatatttttta

SEQ ID NO: 218519 - DNA, 428 bp, Homo sapiens
tactttattggttggaagcaagccacaggtccttgtcatactcaagaggtggggattaaccgaatgtgtgaacaccaggaggtggggatcatggaagattcctttgagttcgtcggtgacaataatgtttaaacaactgaattcactgctaacaggaaatgtcaggaaatttcatattaaaactccacgtgtccccagatcttagaaagcctgatgccagatctgcttttacatgccagatctgcttttatgtgaccagtatcagtgtgagctgagaaatagctgcttgctctgagcagttgcattgctactcatctcatcacaatcctttcttgcttattgtatgttgctgttgtttattgtcttgcatgcataggtgcttttcacacatctaggtgcttcaattatttgtgttatctggctggcct

SEQ ID NO: 218520 - DNA, 406 bp, Homo sapiens
tagggagttagctaagccggtatctgagggaagagatagccaggcaggagtccgagcaccaagcctatgggaatgagcatgagcaagatatctaatgaagatgagagctctaggcttctaaaaggaaattggctgcaaaatgaattcaacttaggtagtgaaataaaccattctcattccatatcccctttttttgcaaaacctcttcttgctatcaccacttactagtcttaaaggtatgcctcttcatgtgtttttcaagttatattcaagacacaaattcctttaagctaatagtaatcaaaccttaggaaagccatggttattccagatcatcttgtgcaatcatagtctttagataattgagctatactatattcctgtgaatatagtaacactcagaaga

SEQ ID NO: 218521 - DNA, 240 bp, Homo sapiens
atcgagggcagctgggcatggtccctgcaagaactttttttggccgtttgtcccctgctaaccttgcaccacccagggctgtgggtaggtgttcctgtcctagatattccaggggtcacttgtcccttgggctgcattttctggcatcccagaaaagtgagtggcttgtcatttccttgactaagtcatgtcaattctctgccactaattcagtttgcaaatgagtttcttcagctattt

SEQ ID NO: 218522 - DNA, 577 bp, Homo sapiens
acaaagattgtggaagatgcagagaagcaggggattcaagatacattttagagatagaattaacaggacagttcacaatgataagataacttaagtttttgcctcacaagtttagcgtttcttctattaaaccattatgaaatgtcattgttagctagtaatttaagttagtaattaggttattcagagtcattgatttagcctgtgtctaaaaccaagcaatgtagatggctgccaaattcactaatggcagcagcatgtggtgaaggttaaagaagatttgataactcttttaggtatttaaaatatttgtatatttttaaaaatcaaacttatgagacagtgcatgcagtagtgaaatgtatatatatagctcatttgaggagtactcttagggttgtggttctcaaatagggacagtctcttgccgtaccctcccccaccccccaacatttggcaatgactggagacatttttgattgtcacaacctgaagaatggtgctcatggcatctagtgattagaggccagttatgctgctaaacatcctgcaatgcacaaagtcagtctcctcccct

SEQ ID NO: 218523 - DNA, 371 bp, Homo sapiens
gccactgtggcaaaagaatagataggaacttagtttggagaaacaagatgggagccagatcacttacggacttatggaccaaagaaaggactttgaattttatcctaagaatgctaggaagccatggagggttttgagtagaagagtggcatgatctgatttataattgaagatgttcactctggttattctttgagaattccctatagggaagccaaatagaagctaaaagaccagttaggaagctattgcagaagacctgcaaaactagtgttgcaatgaaattggtaggattcaggatgtactctgaaagtggtggagaggtgatgtgttaatagattgaatgtggggtacaagataaagacaagaat

SEQ ID NO: 218524 - DNA, 379 bp, Homo sapiens
tttatccactatcttacgggctatgttggtaaatactgggatgagacaaccagaatactgttggagacggcacatggcaatgtttttagcctggggtcatctgttctattacagacaggtcagccacttgtctcatagaggaaattaaaaaggtctccgatccacttggtttttctctattactgtctcagaggaacatcactaaagaactttggcagcgaaggaaggtaactcgcactattgttttagtgtatcaccagcactggaatttacgacctgtgcaaaagaacctagaattccacatagctcttggtccctgcccaggcctcttctgcatcagccagcacacttcattttcactgcagatgtgtctgtgggc

SEQ ID NO: 218525 - DNA, 414 bp, Homo sapiens
agaaggtctcttaaaggacttggggaatattaaaacgtgtgcagagaacagaggggagcatatagttcatttgtaactagtatagctaggaagagtgtggccaatatgaaagggtgtgcctattgtggagataattcaattagttttttctttccacagcaatagaagagtttaacttcatggtacttcctatgtgcagcgtctgtactaaatgttttacatggattgtttcatttaaccctcataacacctgcatgagataggaaatagtcttcacatttgacagatgaggaaactaaggcatcaaatttttcagggagacatagctaataagaagcagaaccaggattcaaatttagcaaatgtgattcctcagcccgttcccctaaataaagtctttcgaacaatagaaaa

SEQ ID NO: 218526 - DNA, 474 bp, Homo sapiens
attttgttcttgcttgttgtgtctttgtctggttttggtgtcagggtaatgctgaccttatagaatgaatttgaagtattcccttcttttgaattctttatgagtttgaggaagattggtgttaattcttatttaaatgtctggtagaattctctagcaaagccatctggtcctgggcttttcttatttggtaagtttttgataactgcatccaatctctgtttactagttataggccattcagagtttttatttttcatgtcctcgttttgctaggtgtacatttttaggaatataccaatttgttctagattattcaattgttgatgtataattgttcataatattctgttataattcttctggcatcagttgtaatgtcccctctttcatttcagattttcatttttcaagtcttctctttttcttagtctagctaaagagtttattgattttgttgatctttttttaaaa

SEQ ID NO: 218527 - DNA, 248 bp, Homo sapiens
ttcaaggattcctgtttgcagttcatggagaatggtatttagaaataaatacttgttcactaggtatggttatttcttctgaagtgtcattgcttctaggccctctctgagtagacagctaggaaacatgtaaaaatatgcatatactgtttcatatacagacacatgtctatttcatggtcattctgtgtatgtttagaaccatgagttcacactaatatttccaataccacgttttattctagact

SEQ ID NO: 218528 - DNA, 580 bp, Homo sapiens
tgcctcagcctcctgagttgttgagaccacaggtacacaccaccaagcctaatttttaaatttttgtagagatggggtctccctgtgttgcccaggcaggtcttgaactcctggcctcaagtagtcctcctgccttggcctcctaaggtgttgggattacaggtgtgaaccactacacccagccttgctgtgtctttttactattgtatttccattgcctagcatggtgcctgtcacctaaaaaatattttaaaatatttgctgaataaatactcctatgggtttagaaaatgcagcataaatttagaaatgccccttctgttatgttctgggaacagaacaagggttggagccttggttctgccatttaccatctgtgtgaccttggttgagtcacttgaagtctctgagccttagtttcctcagcttagaaatgaggatcagtaactgctttatctatttcgctaggtttctttgtcagtcaaataagataatgcatgtaaaggttactttataaactgtaaagcactgtattatttttaatcattacgtgtttacacaagttgagctttgctcacaa

SEQ ID NO: 218529 - DNA, 139 bp, Homo sapiens
ggtgtgtgtttgcttgtttttggtggtttaacatgtgggagggtttgtgctgactctgggttccttgaggctggcctcatagtcactgttttgtcttttctttttttcttcctttatttttgttctgtcctgtcttgtc

SEQ ID NO: 218530 - DNA, 355 bp, Homo sapiens
aatttaatcaaaaattatggtgtagcattattgggaggataggggaggggattggcctgtgtggggaagggtagggacgtaagtggcccgaagcctcctcatccgtaagagaaaggcaagcgagagtgtctcaagctggagagtcaataaagaacagtacaagtgtgttgtttccaaatatagagaaaagttgcagaatcaaatatagagaaaagttgcctctgggaagtaggaattgggtggagagagataaggcagggacttttttggtttttttaaaaaataagccttatagttttatgtttgaaactctgtgcatgtgtttttaaattaaaataataaaataagcctatta

SEQ ID NO: 218531 - DNA, 2021 bp, Homo sapiens
tggagatagtaagttttcctttattgcagaatgtctgtgaaagcagtttataatgaaacaaacatttttgatgaaatggttaagaaaaaaaccaccttgatctcatgaggagcaaatagtaatagtagcagtaataataacaaacgttgtctattgttgttactggtactcttgacagctaagctctcctacccctgacacaggttcctggtggaatacctcaaatgtcgacttcctgaggtggttgctattttgttctgttttgattttaaacagaaagcaagggcggaccatggtttgattccagatgtgaagttagaaaaaacagtcccccggctgcaccgtccgtccctccagcatttcagggagcagtttttggttccagggaggcccgtgatcctgaaaggcgtggctgaccactggccgtgcatgcagaagtggagtttggagtatatccaggagatcgctggctgccgaactgtcccagtggaagttggttcgaggtacacagatgaggaatggtcccagaccctcatgacggtcaacgagttcatcagcaaatacatcgtgaatgagccaagggacgtcgggtaccttgctcagcaccagctctttgaccagatcccggagttgaagcaggacatcagcatccccgactactgcagcctgggcgatggggaggaggaggaaatcaccatcaatgcctggtttggtccccagggaaccatctccccactacatcaggatccccagcaaaacttcctagtgcaggtgatggggaggaagtacatccggctgtattccccgcaggagtcaggggctctgtaccctcatgacacgcaccttctccataacacgagccaggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtggcagccctggggggctgagctccagcactgggcaggcacagagcaggggctgcccaggaaggagcacactccaggccaggggtgcatggcagaggaaggtggggagagcccagaaggacattgcagacagacagcctgcatggggactccggcatcagaaagccgaatgtttttgggaaacgggtgggtcacacaggcaggggtgaaacatgggctctgaggttggctacctgattcaaacccggccgcgctgcgcacctgctgggtgacttggccaggatcccccacttcgctgtgcccatatggaaaagagggcaaggccagtcctcactgccgagggccgagaaggcggtgccgagcccctgctgctgcatgaaccttagccgctgtcactgatcccaattactctgatccttttgcccttccttcccataacggcctgctggacgccacagcctgaatactggagagagctgggcattgcccaggtcacaggagagagtccgtagagacctgcgcaggagccgggacccctgctgagcagtgggagctttctgtcatccccatggctcaaggataacctacctgcctgcagagaagagcgaaggtcttgctggatgacttttcacccgcactcacccaggagcaggctcccaagtgaagaaaccaccaaaccatcaccagctcctagaagcctccctcccaccaccttctagtcaccatcccccagaagtaatgactctcaaacctgggggatttgaggccagggggagagccaggctctatgctttctgtaattgtgtctcgtttgtgtgcacgcaggtttgttttatgttttggccattaagattttccccagccctc

SEQ ID NO: 218532 - DNA, 2416 bp, Homo sapiens
gtcgtgatcagacgagcggtgagcgatcgatactcctatgctagcctctggctcctcaggggacacagccgagtggtcggaccaaacgcaacgagtcttcgccagcccaaaggcgactcgacaccgtcccagctgaagagaggcatgggactgaaccagctggtggtggcccgatggctggagacacccactgccccgcagagcccctggccagagaaggcactttatgggaggccctcagggcgctcctgccgcacagtaaagaagacctgaagttggacctcggggagaaagtggagaggagcgtggtgacattgttgcagcgagccactgagctcttctacgagggcaggagggacgagtgtctgcagagcagcgaggtgatcctgggctactcctgggagaagctcaacacgggcacatggcaggacgtagacaaagactggcgccgggtctacgccatcggctgcctcctgaaagccctgtgtctgtgccaggcacctgaggatgccaacactgtggccgcagccctgcgggtctgtgacatgggcctgctgatgggggcagccatcctgggggacatccttcttaaagtcgctgccatcctccagacacacctccctggaaagaggcctgcccgtggctccctcccagagcaaccctgcacaaagaaagcaagggcggaccatggtttgattccagatgtgaagttagaaaaaacagtcccccggctgcaccgtccgtccctccagcatttcagggagcagtttttggttccagggaggcccgtgatcctgaaaggcgtggctgaccactggccgtgcatgcagaagtggagtttggagtatatccaggagatcgctggctgccgaactgtcccagtggaagttggttcgaggtacacagatgaggaatggtcccagaccctcatgacggtcaacgagttcatcagcaaatacatcgtgaatgagccaagggacgtcgggtaccttgctcagcaccagctctttgaccagatcccggagttgaagcaggacatcagcatccccgactactgcagcctgggcgatggggaggaggaggaaatcaccatcaatgcctggtttggtccccagggaaccatctccccactacatcaggatccccagcaaaacttcctagtgcaggtgatggggaggaagtacatccggctgtattccccgcaggagtcaggggctctgtaccctcatgacacgcaccttctccataacacgagccaggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcagcttctggtggtcgtagccaggataggagctgaaagggcctgacatgcagacagcattcatctgttcactaatttcctgggtcctggaatctatagagacaagcaggactgaacctgtgtcctgaagagccttcactgcccagtggcagccctggggggctgagctccagcactgggcaggcacagagcaggggctgcccaggaaggagcacactccaggccaggggtgcatggcagaggaaggtggggagagcccagaaggacattgcagacagacagcctgcatggggactccggcatcagaaagccgaatgtttttgggaaacgggtgggtcacacaggcaggggtgaaacatgggctctgaggttggctacctgattcaaacccggccgcgctgcgcacctgctgggtgacttggccaggatcccccacttcgctgtgcccatatggaaaagagggcaaggccagtcctcactgccgagggccgagaaggcggtgccgagcccctgctgctgcatgaaccttagccgctgtcactgatcccaattactctgatccttttgcccttccttcccataacggcctgctggacgccacagcctgaatactggagagagctgggcattgcccaggtcacaggagagagtccgtagagacctgcgcaggagccgggacccctgctgagcagtgggagctttctgtcatccccatggctcaaggataacctacctgcctgcagagaagagcgaaggtcttgctggatgacttttcacccgcactcacccaggagcaggctcccaagtgaagaaaccaccaaaccatcaccagctcctagaagcctccctcccaccaccttctagtcaccatcccccagaagtaatgactctcaaacctgggggatttgaggccagggggagagccaggctctatgctttctgtaattgtgtctcgtttgtgtgcacgcaggtttgttttatgttttggccattaagattttccccagccctc

SEQ ID NO: 218533 - DNA, 387 bp, Homo sapiens
agttagtgtgctctgaaaaaggaagttcttaaaaactttggaactccagagtcttgggtttgatttctgcttccatcatttaattgaatttcaggcaggttatctaaactctgcctcagtttgctcattgttcatgcaacagagtttctatgcagactacacatagtaatatattttaagctttagacataaatagagttcattcctcactgaccgattttcttttaataaataaatcattcttaaaatttcttttcttgaagtacgttataggtcagatacaatagctcacttctgtcccagcaatttgggaggccaaggtgggaagatggcttaaggccagtttttcaggaccttcttggacaacagagtggggctccatctcta

SEQ ID NO: 218534 - DNA, 426 bp, Homo sapiens
ggttggaaacttagtccaatgttatttacttttcgtcttaaactttgaaatcattttaataattattttggtttctctccacctgattgctgtagtactattaaaactgaattttaaataattctgtttgattctaaacagtcaagtttgcaatagattgccatgttttaacaatatcttcaaattctaggcaagggaaaaaacatttgcatataatttttctctaaacatatttatactatgtatttacaattagtaaatcctgagttacttcattgtttttatattaagtggtctaaatctaataaatggatgcactcacctcaactgcagatattatgaaaaattcctggatgtagcataagtatgagtttaaaattcaacatcaaaaccttaatccattttcatcacacacacaggatttag

SEQ ID NO: 218535 - DNA, 642 bp, Homo sapiens
cggtagctcatacctgtaatctcagcactttgggatgccgagatgggtggatcacctaagttcgagactagcctggccaacatgatgaaaccccatctctactaaaaatacaaaaaattagctgggcgtggtggcacatgcctgtaatcccagctactcaggaacctgaggcaggagaatcacttgaaccaggaagtggaggttgcagtgagccaagattgcaccactgaactccagcctgagcaacaagagcgaaattccgtctcaaaaaacaaaaacaaaaaaacaaaaaacaaaaaactaacgcatcaacataggagtatacattttttagtctatatttacatcatccacaatcagttgtatataattctcaggtggaaaagtcatggtgacttagaggcatacttctgaaattttattgtgttcagcaataaactgcagaactggttcaaatgcagattctgattcaggagatctggggctggggctggggctgcgtttccgcatttttaacaagcttaccagtgacaccaatgcctcaggtccagaggccacacttttgaatagcagagaggttgaacactgaacgaagaattcagggatgatgtggaattgagagttttatgaaatttacaggtt

SEQ ID NO: 218536 - DNA, 335 bp, Homo sapiens
cgcccttagcgtggtcgcggccgaggtactaaattcatagactgggagactcagtattgtcaggatatcaatggtcccactaatgatccaaagattcaacaaaatcccaaaaaaccagcagccttttttgaagaaactgacaaactgattctaaaacatacattaaaaaaaaaaaaaagcaaagcacccagaatagccaaaacaacttgaataaaagaataaacgtgaagaactctaattgatgctaaaacttactatagtcagccccctgtatccttagttccacgttcctggattcagtcaacctcggattaaaaatattcagaaaaaaacaa

SEQ ID NO: 218537 - DNA, 292 bp, Homo sapiens
ctgtgaggctagaaatgttcttcatctctgtgtaaatatagctagtgtgactaataaacttatgtttaatgttatttacttctaattaattaatattaaacttgaattggtgcattttaactgtccactggccaactttggctaatgctactgtacttatagcaaacttctaaattttatattaaaatgcataggtttatgaaaatacagtgtagcttaaaaatattagtattccgaattagtatacagtttatatgtgtgtgtatacacaggtgtgttggctaattgtcta

SEQ ID NO: 218538 - DNA, 506 bp, Homo sapiens
agaaagaatttaaagattaaaatttttataataaacagtgaaggattatcacctgaaaacagactaggaaatgctgttctaaaggaaataagctagtagtacaaaggataatagggtatatcacagaaaaatatttttagactcttctgagctttatttttctcatctataaaaaaatcaagattgaactagataggtaggtttcaaacttaaggcactgaatgggtgtggtggctcatgcctgtaatcccagcactttgggaggccaaagtgggcaatcacttgagctcaggagttcaagaccagcttgggaaacatggtgaaaccccgtctttacaaaaaatataaaaattaactgggtgtggtggggcacacatgtagtcccagctaccagggaggctgaggtaggaggatctgttgagcctggcaggccaaggctgcagtgagctggattgtaccactgcactcgagcctgggcaacagagtgggaccctgtctcaaaaaaa

SEQ ID NO: 218539 - DNA, 446 bp, Homo sapiens
agttaaggtaccagctagttcacacggcacccacgtcttgttgtgacagctccctggacaccggcttgatagtctcatgaatggagtccttcctgccattcagctagttccttgagcagcttagtagaggagtgtagcacagggacccagaagcctgatgcatccaatgcagatctctcacctcacagtctctgcatctcctgggtaaaatgtatacgccagtgctcgaacctcttagcttggtgtcaggattcaatgtaggcagggtgcttaccagaggcctggtacatactaagtgctctgtaagtggtattcatagctttaacactctttcccttaaatacatccaaattccttttaaggatatatgacttgtaatgagtttcaagagaaagtggccttagcatgtattccagggattacaaaacgtgcccccccccatccta

SEQ ID NO: 218540 - DNA, 323 bp, Homo sapiens
gaaaagtgttcaaaataaaatgattaagctatgaaaaatagaacaggccaggaacatgacacattcacttcccaaggaagaagaaaacagttactactgtgtaagaattcagtagagtaattagttaagcttgtaggctttgtagccaagacctgctgggtcccatccagtctctaccactcaccatccagctgacttttgagaattagatgaactaataaagtattcaaaatactgcccgacacatagtaaatcttcaataaatcttagtagtgatggtgatgttggtgactaggtgatgccactaccccacaataggttac

SEQ ID NO: 218541 - DNA, 459 bp, Homo sapiens
tcttataaactgttttttgcaaatggaagacaatgccatctcaaaacccaaaaagcaattctggctttttatacttttgtggagaacaggtagaagacaagaaaaggaatgaacatgctgctgatgtcacttaccccttcagcgacaagaaacaggtacagaattcatgaactgatattatttcttcaaaaacatgttccatgacctcgagtgacttgctaaagcctagcaagtacaggtcacattacagatgtcattgtcttgtaaggtggacaagaaagtccacatcttttttacactgaatggaacatccttggctttgagtcaagttttgttttggttcttttgtttttttgagacagagtctcactctgttgcccaggctggagtccagtgagccgagatcacgccactgcactcaagcctgggtgacagagcaagactccatctctactacaa

SEQ ID NO: 218542 - DNA, 175 bp, Homo sapiens
tttacctgtccaaaaaccggataagtcttacagattagttcaggatctgcgtcttatcaaccaaattgttttgcctatccaccctgtggtgcccaacccgtacactcttttgtcctcaatacgttcctccacaactcactattctgttctccatcttaaagatgcttttttcact

SEQ ID NO: 218543 - DNA, 476 bp, Homo sapiens
gggtttcactgtgttagccaggatggtctctatctcctgacctcgtgatccgcccacctcggcctcccaaagtgctgggattacaggcgtgggtcaccgcgcccggctaaaccaggtattatttaaggtcaatgtgttactatgactttttgtggcttcatattgcagatacatgagtagtcttatcatttttttgagcacttagactgagagcatggttattgaaataattccccaaagtaaaccttattattttcaagggatttacaatatattaccaaaacttgagcaatgataggtaaatttgagctagttctcctcttttccctcttccaaactgcttttacatattggtgatagattaatatttttcaaaaaaatgtaggtcttgttgttttatttccttatttggaactcttggcattctgatgtttcttgaagcagtgcaaacacctgagatagtattttaggtctta

SEQ ID NO: 218544 - DNA, 512 bp, Homo sapiens
cctattgcagattcatttgcaaacatcagaatagcaagaccaataaaacaaagtctagaatcaagcccatgctcatagaggaatataggatacaataaaagtgggtcttaagcaaggttagatagctgactgcatagaaaaataatatagatccatacttcactttatattaaaacttttagtagattaaaggttaaatataaaaatgaaactataaaagtaattgaggctgggcacagtggttcatgcctgtaataccagcactttgggaagccaaggtgatggggggattgcttgagcccaggagtttgagagtagtctgggcaacatgatgcacctctctctctacaaaaggtacaaaaattagctgggttttggggcatgcacttgcagccccagctacttgggaggctgaggtggaaggattgcttgggccctggaggtcaaggctgcagtaaacagtgatggcgccactgcactccagcatgggcacagagcgagaccaggtctca

SEQ ID NO: 218545 - DNA, 682 bp, Homo sapiens
tgtggtggctcgcgcttgtaatcccagcactttgggaggccaaggtgggcggatcacgaggtcaggagatcgagaccatcctgactaacacggtaaaacccccatctctactaaaaatacaaaaaaattagccaggcatggtggcgggcgcctatagtcccagctacttgggaggctgagacaggagaatggcatgaacccgggaaggtggaggttgcagtgaaccgagatcgcgccactgcactccagcctgggcaacaaagcgagactctgtctcaaaaaaaataaaaaagaaaaatgttctttcacttctccatttttctaaaaccaaattaataagaacagccaagaatatacagtacttattttagcacatcttacaagtttaagccgtattagtgaatacgaatgttaattcaacgaatatttaaaaactttcatcaaacgcagtatgctggggagctaaaaattgaaataggtaaacaacctgaaggagcccactatctacttcacaaccaatatgtaaccccccaacctataatacaatataaaatggtaattagttccctgaaagatatctaacatagcttattgaaaaagtgatgatttcaacaaatgattacaaataggaggaaaatctaaaccttaaataatgtattattttaattgttgccaaccctag

SEQ ID NO: 218546 - DNA, 371 bp, Homo sapiens
caacattattttcaatgtttatttcttatttttaagtattcctcaaatagataatgcatagttggattttgctttttaattcaatatgaaaattttaatttttaaagtagtataattacagttttatatgtgttgctttttttttttttagacggagtcttgctctgtcgccaggctggagagtaggggcgtgatcttgaatcactgcaacctccgcctcccgaggaggcgattctcctgcctcagcctcccaactactcagaaggctgaggtgggaggatcacttgagcccaggaggttgaggctacagtgagtcatgatcgtgccactacactcaagtctgggcaataaagggaaacccagtctcaaat

SEQ ID NO: 218547 - DNA, 316 bp, Homo sapiens
gcccgcgccccgggctccccgccttggccgctgcggcctgcatagagcggcgctgcgcgtagcggccaggggagagaagaaggagggcggtggcgggggtgatgtggcggcctctttgggaggcgcaggggccgcagccagccagacgctgcagcagtgtgggcagctccagaagcttgtgggcagctccagaagcttatccgcatctccattggcagcctgcgccggttgcgcaacaagtgcgctgtgtccaaggacctcacccagcaggagatacggaccctggaggtaagggggtcgtggacccaggctgggc

SEQ ID NO: 218548 - DNA, 508 bp, Homo sapiens
ctagaaattattaagctaagtgagaaaggcatgccaagtaagtataaatccggagttgtccaacttgagctgaagtgctattagatctaccaagtcataagactgaatggtcactgcaaccatctatcctataatggatgcaatatgttttagggcaagagaaaatgcaaaagacaaaagtaggctgaatgaacagttggcccagatccctatatcactgatgcctctctctcagcttatacatacagtctcctaggtccttccaaccagctgataccttagtaaacaagccaggcctaatgcaagggcactttggctaggtatattggcacaatatgtcaaccactcagatgtgggacctcaaatataatccatgagggtaaacctactctgataagtagaatacatagattcatccccatccatagaaagggttcagaaaacaggagctggccctgtgcttttacagagctttatccttcccataagggcaggaccagatattatc

SEQ ID NO: 218549 - DNA, 642 bp, Homo sapiens
  misc_feature (613)..(613): n is a, c, g, or t
catctgagatgctgctggctcagctctgctggtgtctcttttgagcatggagcggtgtcctcgttgtcttcttttcattgcttatatctgctgcttgctgttcagggaaagcacaaattcactttctcctcttgttaaaaaaatagtttggcgggcgtggtggctcatgcctataatcccagcatgttaggagaatgaggtggaaggattcttgaggccaggaattcaaggccagcctgggcaacatagtgaggccactgtctctataaggaataggctgggcatggtgacacactcctgtaatatctgcactttgtggggccaaggcaggtagatcacttgagcccaggaattcaagaccaacctgggcaacatggcaaaactctgtctctacaaaaattagccaggtgtggtggcacacacctgtggtcccagctgaggtgggagggtcactggagctcaggagatcaaagttgcaatgtgccatgatcatgccattgcactccagcctggccaacagagggagaacctgtctcaaaaaaaaaaaagtcggatacaaatcacctggccgcggtttacaacgtcgggacttgccccttgcggtacccacttntcgctttgcagtcccccttcgccggtgcg

SEQ ID NO: 218550 - DNA, 518 bp, Homo sapiens
ctcttcacatttgttatgagggtgtggctgacctgggacctggtgaaatcaattttctaaaataagaaaaataaaaaagaaaaagacttctgaattctaaggggtcagagaaggatcttccagagattgctgagtggggagggcctggggatatggttctacagtttttggtcataaccacaaagattagcatctctgctgcctggtcgatgaagcatcccaaatagtccatcagcgagggcaaagtgatggaaacatttggagtcactgattaacatgcttgagggctggatcccttatttgggaggtgggagtacttccagagcttcttttcacttaatgaaggctgggaagctcagagctcagtggtacagggctggaggaagtcattttcatatatagagtctttcttgtttggcctcttttgtagcaatgactccccaggaccctccagtaacaattttcctttacctgcatcccccaccatcctcaggttcctgagatcaccttgaaaaaaa

SEQ ID NO: 218551 - DNA, 636 bp, Homo sapiens
atgatgtgttataaagggcgcaaatagggtaataatatggccaggcgtggtggctcacgcctgtaatccagcattttggaaggcagaggcaggcggatcactcgaagtcaggagttcgagacaagcctggccaacgtggcaaaaccccatctctattaaaaatacaaaaattagccagacatggtggcaggggcctgtaatctcagcctcccaaagtgttgagattacaggcataaaccaccatacccagcccacccagatttttgaggaaggctttgtataccttttctcagaggcaaatagtgttaattttggaatttgactgattcacaattcttaggtgcacctcagatttacttctcattgttattaaaattggtttctgaagaggcaaattggaaataattgtttcctcccctcactcaccttgttagggatactgacactttaacatctttttactccatggttgcttcagtaaattaagagttcagttttcaggttttctctgcacactattatttttcacttttttgacagccccttcaagtttatcttcagtagtgtttactgaaaatgtgttgaagatatatgaattgataaagctgaaagctctgtttcactaaatcgtcagcc

SEQ ID NO: 218552 - DNA, 464 bp, Homo sapiens
caagcttgacctaaaggacatttataggttcttaattcaccaattagacaacatacttttttctcaaacacagaagggttataaaaattgatcatattctagggcaggattctgcaaaccttttctgtgaagggtcagatagtaaatattttaggttttgtggacaaggagccaaaattgaggatattatataggtatcatataacaagaggaaaatcagatttccaaaagatttttattgacaaaatttaaaatttgatttatgaacactgaaatttgaattttatgtaatttcaaataacaaaatatcattcttcttttgatttttttcttctcaaccacttaaaaccattctcagtttgtgggccatacaaaaataggtgacaggtcagatttggctcacaggccatagcttgccaatccctgttctacgacttaaataaaaaacagatttccagtgtcag

SEQ ID NO: 218553 - DNA, 268 bp, Homo sapiens
aaaaataaacaagcaaagagaaaaggaaaagaagcaggaaaaaaaaaaagtggacataagacgactcctccagggacagcctcatccctcttccctcctcgccatgtggctttcagaaagagcagcctctggctcttggtttgcttgccttcccttcacactgcagccctcctatcttctgcgccctatgttggtacagctcaatccaatgcacattttgcaagccttgattatgactttccagcagtatctcccctcggctgccgag

SEQ ID NO: 218554 - DNA, 1111 bp, Homo sapiens
tcccttttagtgtctcgggagtggattcatacagatgaagtgggcattgcttcttcctggttgcctggtttcccgatagactacatgtaactaagtgacacactgcttttcttttgttagtattttatgtgtgggagtatgtgactgcgtgtgtgtgtgcctgtgcgtgtgtgtgtatactcagcacatgtatgttactatgtgatgtggtttaaaactaatggaaaaaactgaaagtgcctgaaactagttttaagcttagacagaatctctttaaaaagacttgaatgttcagttgaacttttggagtttgctttttccacctaaatattgtttctaaaattttaggggcggagttgaaaaccaccaatgctggtaattttataaggtattttaaaattaagacctcttggttcatagtaattcaattggtgatggattgcctggtggcaccaagggttacagatctttttgtcagccagcaacttacacgatgtgtccgttttgttattcactcatgaaatacaatttaaaatatttaaaatattttgtattccaaaaatataatacaaagaagtacctctgagaacattgaaaaaaatgtataatttgaaaaatgtaacttataagggcagctgtcttcctgcaagagttctgttgccaaggaatttcttaatgtcgctcattctgtccagggggtttggggcgattgggctttgaaaaaatattcttaaaagtttgtttagcagaaaataatcacttttacattttgtgcaaaacattttacattttcagataatttaaatgagcactacatactgtcagtgtgaatgtagggccttgaaagcattttgcttttttttttttttttttttttttgagcttggttataaaagcaatctcctgtgttaaaaacgtgtgaatagtttgataatttgtacacataatcaagagcatctcagctggactttgtgttggctgctgtatagaacatgaacaaatgtcaagggatagaaaattactttggatatttaaaagagaagaaatatatagtctatttgttttgtaacaagtttctgtaaataaaataatttatactatttataagaaa

SEQ ID NO: 218555 - DNA, 1050 bp, Homo sapiens
tcccttttagtgtctcgggagtggattcatacagatgaagtgggcattgcttcttcctggttgcctggtttcccgatagactacatgtaactaagtgacacactgcttttcttttgttagtattttatgtgtgggagtatgtgactgcgtgtgtgtgtgcctgtgcgtgtgtgtgtatactcagcacatgtatgttactatgtgatgtggtttaaaactaatggaaaaaactgaaagtgcctgaaactagttttaagcttagacagaatctctttaaaaagacttgaatgttcagttgaacttttggagtttgctttttccacctaaatattgtttctaaaattttaggggcggagttgaaaaccaccaatgctggtaattttataaggtattttaaaattaagacctcttggttcatagtaattcaattggtgatggattgcctggtggcaccaagggttacagatctttttgtcagccagcaacttacacgatgtgtccgttttgttattcactcatgaaatacaatttaaaatatttaaaatattttgtattccaaaaatataatacaaagaagtacctctgagaacattgaaaaaaatgtataatttgaaaaatgtaacttataagggcagctgtcttcctgcaagagttctgttgccaaggaatttcttaatgtcgctcattctgtccagggggtttggggcgattgggctttgaaaaaatattcttaaaagtttgtttagcagaaaataatcacttttacattttgtgcaaaacattttacattttcagataatttaaatgagcactacatactgtcagtgtgaatgtagggccttgaaagcattttgcttttttttttttttttttttttttgagcttggttataaaagcaatctcctgtgttaaaaacgtgtgaatagtttgataatttgtacacataatcaagagcatctcagctggactttgtgttggctgctgtatagaacatgtccccgtacatcgttagaagcttgaattcgagcagtagtagtagtaggcggccgc

SEQ ID NO: 218556 - DNA, 587 bp, Homo sapiens
gctcacgcctgtaatcccagcactttgggaggccgaggcgggtggatcacgaggtcaggagatcgagaccatcctggctaacacagtgaaaccccgtctctactaaaaatacaaaaatttagccaggcatagtggcgggcgcctgtagtcccagctacttgggaggctgaggcaggagaatggcataaacctgggaggtggagcttgcagtgagccgagattgcgccagtgcactccagcctgggtgacagagccagactccatctcaaaaaaaaaaaagaacatatcacagtatttacccaaatgaattgaaaacttatctctacataaaaacctgcacttggatgttacaacagctttatttgtaattgctaaaacttggaagcaaccagaatatccttcagtacgtgaatgaatacataaattatgatacgtccagacaatggaatgctattcagtgctcggaaggtatgaggtaccacgctatgaaaagacatggaggaaatgtaaatgcatattactaagtgaaagaagccaatgtgaaaaggtcacacactgcatggctccaactgtatgacattctggaa

SEQ ID NO: 218557 - DNA, 616 bp, Homo sapiens
agtataacagtgatagaagttatttccattttcagcccttcattcatggacctgggaatcctagcttttagagaaagggcactatacataggtcactgattcagagcatatgctatatcctggaggacattatcccagccttcaaagcattgccacccagccagtgccataactgaatattccaaaaaccacttaacccatcaggtcagctgcttcgggttgatggtgtattagtcagttctcatgcttctaataaagacatactcaagattgaataatttataaacaaaaaaggctttaatggactcacagctcctcatggctggggaggactcaccatcatggcagaaggcaaaggaggagaaaggcacatcttacatggtgtcaggcaagagagcttgtgcaggggaactcccatttataaaaccatcagatcttgtgagacaaccatgagaacagtgtgggggaaaccgcccccatgattcaattatctccaccagagtccctcccacgacacatgagaattatgggagctacaattcaagatgtgatttgggtggggacacagcaaaatcatattagatggggacatgataacatcaataaattttattag

SEQ ID NO: 218558 - DNA, 645 bp, Homo sapiens
gctcatgccagtaatcctagcattttgggaggcaggggcaggtgaattgcttgagcccagcagttcaagaccagcctgggcaacaaggcaaaaccctgtctctactggaaaaaaaaaaaaaaaaagggtatttgacatgtaatagctttggatgactttttaaaaataataaataggagtaattaggccaggcacagtggctcatgcctgtaattccaacactttgggaggctaaggtgggaaattcctttgaatccaggagttagagactgcagtgagctatgattgagacactgcattccagcctgggagagagagtgacaccccatctcaaaataaaaaaaaaagaattctctggcttaggcaaagacttggttttatatggcttggggtcaatggacaggtaagatgatgctgattgatactgactatggcagctctcctccatgtttctgtttcttaagagttcacgggtgtagaagaggctacaagtattggaaagtactggtataactggtctcaaccatttttggagattgccagtacaaaggaatataacttacttcctgtatgaatcatataccaaaggcaattgctttcctcattgttgatgaactactgtaacagaaaaggtctgcttatagt

SEQ ID NO: 218559 - DNA, 239 bp, Homo sapiens
atcccccccaccccaccaccaacctttctcccagaggttttaatatccattgatgattatctctccaggtctgaatttcttctataccagcaggaagcccagcataaggacgagctttctctctcactgtttggtcactggggcaggaattgcaggctggcgtaggttgcagtgagctgagattgtgccactgcactccagcctgggcaacagaacgagactccgtctcaaaacaaaaa

SEQ ID NO: 218560 - DNA, 434 bp, Homo sapiens
ctggtgaattctgtcctaatctcctcttcttataaggacatcagtcgtaatggattagggtccactctaatgacctcattttaccttaattactttttttgtaaaggctgtgtcttcaaataaagtcacattctgaggccccggggcttaggacatcaacatggattttgggggaacataatttagctcataatacattataaatgtcattttaaaatgtttgttttaatgagaaacctttataaaagaaaaaattttcagtttccttagtattaacataaattattttaaaataatgccacttcaaaatgtacaaacatagaaaggtataagctttttatgtatatagctgttgtacaattatacatctaagtagatttccaagtgaatataagattccagaccaataaagttcatgttaataatgatataat

SEQ ID NO: 218561 - DNA, 525 bp, Homo sapiens
aaaacgccactgcactccaacttgggcaacagagcaagactttgtctcaaaaaaaaaaaaaaataccaattttattcaatatttacatgcacaaaggttttcatagaaaagaagatccaaagaaatggttaaatttggggggctttatactattgtgtccggaattggtgggttctcggtctcactgacttcaagaatgaagccgcagaccctcgcggtgagtgttacagctcttaaggtggcgcctctggagtttgtcccttctgatgttcagatgtgttcagagtttcttccttctgatgggttcgtggtctcgctggctcaggagtgaagctgcagaccttggcggtgagtgttaacagctcttaaggaggcgcgtctggagttgttcggtcctccctgtgggctcgtggtcttgctggctcatgagtgaagctgcagaccttcgtggtgagtgttacagctcataaaagcagcatggacccaaagagtgagcagtagcaagactcactgcaaacagcaaaa

SEQ ID NO: 218562 - DNA, 498 bp, Homo sapiens
ttctctttcaatcctcttccaccttcaggaaactgccttccatccgccgaggaatctccaggctgcacatgtggccacaggaggccccatccctgcagactggggaaggcgcgcccttctgatcttgcaagtagacacatggggcccaatcgcaagggttcctcggtcagtgttcgctcagataggggacatggctctgggcaggacagcgctggccaaaggacgaagtgactgacctgcagccactcagactctcagacttgagataggagccccagcactgccaagtcctacttgtgggctgggtcaaaccaggttagctttccgaggtcttgccaggacacctgcttcccaggcttgttgtgagaattaggcaagacaatgttcacagagtctctggtacatcacacggagaagacagaggaccacaggtattccctaggagacctgtcacttcactgctcaggatttcagcccctcccggtacgtgatctcatg

SEQ ID NO: 218563 - DNA, 190 bp, Homo sapiens
acttatggatacacaagcagtttattaatcaatacagaaggaaatactaatatcatttttattgaaaacgatggaccctatttgcaaccctatctctacaaagaatgcacatatatgaacatatgcattggcatgcactggtacaaatacacaccataaaacaacacaaaaacaaaaataaacccagaac

SEQ ID NO: 218564 - DNA, 388 bp, Homo sapiens
gctggttggtgcaggtactccaatctcaggctaaatgacaaagacatcttggagaatacgtttctattcggtattacttcttagatttcttgagttttcctttaggcatcaacgttgagaaatagaacaggtggttcaacataaatatgcaactacacagtttatattagctaaattcagcagacaagaaatggatcttgagtgcctagatacactgtgagatggaagattcaaattaacattttcatacaaaactgaacttctttgttgacattgtttatttgaggcacagtccttttgcaaagtcttgcacagatcttaccacaagtaatgctaaatgtttctgtttgacttcaattctaattatgatttacctaattccattgtg

SEQ ID NO: 218565 - DNA, 519 bp, Homo sapiens
cagtgactcacacctataatcagagcactttgggaggccaaggcaggcagatcacctgagttcaggagttcaagaccaccctgaccaacatggagaaaccccatctctactaaaaatacaaaaaattagccgggcatggtggtacatgcctgtaatcccagctacttgggaggctgaggcaggagaatcgcttgaacctgggaggcagaggttgcagtgagccgagatcacgccactgcactgcagcctgagtgatgaaagccaaactccatctcaataaataaataaataaagaggcaactagctaagccttttgcccttccaccttctgccatgtaagaacacagagttcgtccccttcagaggatccagcaacaaggcacctgccatctcggaagcagaaaccagaccctctgaacttgccagtgtcttgacccttcagaactgtgagaaataaatttctgttctttataaatcacccagtctcaagtactttgttatagcagcacaaagggactg

SEQ ID NO: 218566 - DNA, 493 bp, Homo sapiens
tggggcgttggtagtgacaatcaaaaaaatagcctcaatgtatccataattgatcaggacactcagagcattcttgtataactccccaatgaagctaggctactgacgaatttcactaaatacacttgcccacatttaacagagtggtcaccagtccgtggccacagcaaacataggaatttactcctaagaaactagaaataacctaataatgtaaaggatctttcacataaatattctctaaatgttcaaaagaaatacaggcataggatccataaaccaagacaaacacagtataacctttatagctcactttaaacatcgtttacataatacgcattgccatgatgtataacactgaaaggaaacctgattctatttccatgttttgcctttaatatcaataatgtatacagatattaaaaaaaggatattttgttttttgcttgtaaattcattaagattaataaaaaggacatattaatatatttta

SEQ ID NO: 218567 - DNA, 589 bp, Homo sapiens
ctgatctagaggacccggtgattgaaacagcccagagatcatttgacctcaagtatatctccctttcctggagttgtagaaggatgttgaaatatttattttctggatttggctttccagagggagatgaagaaagttatatatcaaacactgatgacctcatgggagcaataccacttttgtttctttataattcagtttgctgctgctatttcttctcctttctaggaaaaatattccatgggcttctttggaaattaaggtaaatttgatgactgggctttgatgcaaattttatgcatgatgttttattttattgtgtgattttaaaaaatgtgtataaataatatttttcaaggtcttttatgtgttagtgttaaaatgaatattctcctcttttgccagcgctcactattaacagaaaaatgtatatcttttaaaaacaacaaaccaggcataatataataatgctctgaaaattgctattgctgttttcccttaacaccttgtggaaaattatgtctgtacatacagatccacctcatccctgtgtatttgtgttctactccattgccagaattctttcagt

SEQ ID NO: 218568 - DNA, 331 bp, Homo sapiens
gggcagggctccctgctgggtgctaagaacatgataccatgtcagagtaggcccttgcccgtgtagggtttatgatctaaacaggtggacgggtcagtcacctactctaaggtgactaacagtactaaggcacaccatggaaagagtcaaacgtggttcagtgaccagaggaagatgaaagcacagaaccagtgtattcgggaaagaatttattaagaattaaactggacctggaagatgcagagataaggaagacttttatcctttttttctaggaaagaataagaaattgagcaaatgcttagtatgctcaggtaggaccaagaaggag

SEQ ID NO: 218569 - DNA, 405 bp, Homo sapiens
cattaattctcttatttctgtgcaaataaaaacatatttaagttcaccttcccataaaattaataatgaattaagaatcatagacctggccgggcacagtggctcacgcctgtagatcccagcactttgggaggctgaggcaggcggatcacaaggtcaggagatcgagacctgactaacacggtctggctaacacggtgaaaccccatcctggctaacacggtgaaaccccatctctactgaaaatacaaaaaaattagacgggcatggtggcgggcgcctgtagtccgagctactcaggaggctgaggcaggagaatggcgtgaaccaggaggcggagtttgcagtgagccgagatcacgccactgcactccagcttgggcaacagagcgagactccgtctca

SEQ ID NO: 218570 - DNA, 412 bp, Homo sapiens
agcaatgcacagtgtaatcagagaaagagtccttggtcaaatgagatcagtacaagagagaaggcaatactaggggtttgggagtccctgagccaactagactactcagtgaggacttcccggaagaggtcatgcctgacatgagtcttaaggatatgagaactggacaaagtataaaatacaaatgcaacaaaaagtccatgtgcctgcattagaggacacagtgagagaagccaaggtcagtgggatggcaggaagtcctcttagaagctgctcgttctcctttgctgtgcaccagcaggtgctctcaggtctgaactccttttcctaacagaagtctgcctctgcagtaactctgactcctccttagtgcttgttacagggaattaaatttcttttgaatagatctacc

SEQ ID NO: 218571 - DNA, 199 bp, Homo sapiens
attccgactaatgagtctggggggcaagccgagttcttccaagcagaaagcaagcaagtgaaatctctctctcacttacttctctctctgtggccaatgccatctgctagctttaaaaataatttttaaaacaagtgttttggttctcttcaacgtgcagcaaagacagatgctatttttaggcttgttttctattaaa

SEQ ID NO: 218572 - DNA, 256 bp, Homo sapiens
tggcataatttaggtgatataattacaattacatttttatacttcattaatcattacttccctaagatctcagaaagcagtcgtttactggtatatttgcataacactgataatgaaaaaattgcagtaagtccttttgtttaagatacagtcaagagaggccatcaatcattgtctaaaattcatacaattttactactatatgaaaacttgctgtctttatgccatttaaacttttaaatgaagactcacatta

SEQ ID NO: 218573 - DNA, 270 bp, Homo sapiens
aaagctgggtgcagttttggttatttaataactatttttttgttgcatcgtgttttttgagacttgctttgagtcttgctctattgcccagattggagtggagtggtgccatcttggctcactgctacctccacctcccagtttcaagtgattcttgttcctcaggaggctgaggcaggagaatggcgtgaacctgggaggcagagcttgcagtgagccgagattgcgccactgcactccagcctgggcgacagaggagactctgtctca

SEQ ID NO: 218574 - DNA, 366 bp, Homo sapiens
gcctcggcctcccaaagtgctgggattacaggcatgagccaccgtgcccagtctcaaagcaagtttttaaataagtaactggctgaataactaagaaatagttttcaaattaaaattcaaggggaaaataagaaaatgttatatcaacattaccaagagctgtctggaataaagacatagtaaaggcattcatgcatgcaacaactgtcgtcaatctaaatgatgcctaatcatgctactatttcaaacctaaaaggtaattcaaaattctctcgataatgagataatgccgtaacaggcaggcataaaggagctaaaaatacaaatgatcaaatatggataaatgacagaaaagggaaagaaaat

SEQ ID NO: 218575 - DNA, 534 bp, Homo sapiens
cctccttcttgggactggtctggtctgaggtgatgaggcctcgaatgaggtccgtggcagtggagcagggatgcagacatggatgacagagtcactgaaatggtacaaccagcattatgataaaacagagaaaagtcaaatgtgggcctggtgcggtggctcacgcctgtaatcccaacaatttgggaggccaaggcgggcagatcacgaggtcaggagacagagaccatcgtggccaacatggtgaaaccccctctctactaaaaatacaaaaattagctgggcgtggtggcgcgtgcctgtaatcccagctactccggaggctgaggcaggagaatcacttgaaccagggagtcggaggttgcagtgagcggagatcgcgccagtgcactccagcctggcgacaaagcgagactccatctgaaaaaaataaaataaaataaaaaataaacatgcccataacacggactccactcctaggtataatacgtcaccatagcagtactttcttggttttttttttgagacatggtc

SEQ ID NO: 218576 - DNA, 464 bp, Homo sapiens
ggtgcttgtcacaattatttgaggagtttcctcgaacaattcctaactttcctttccttctcccaaaatcacttcataaagctcctcagtgattcgctacctccctgaggtggaaagattgcacactattgctttgattattcaagaggtctcattacctgaatattcataatcccaggcattataattatagcactccacagagaagtaaaatattatcaataaattgaccacttacacaattagctccctcaatcatgcctccctgactaatactatcttggtagtatctgctggaaagcctagctgatttttggatggcatttcaatgcaaagtgattacaaaatgaagatgaaaagatggagaatttcatgaagttgattaaactgatgctggtgatgctggggaactctaaatcacaagcaagaaaagtgaaaatcagtgtatgaaggccagataattg

SEQ ID NO: 218577 - DNA, 447 bp, Homo sapiens
tttgaccattttgactcataattttaacttaattgggagggaaaaagaaaattcatactaaaaacccaaagcattaagtgtgacatcagggataggaatacattaaaatgctgggcttttaattgccacagaaaagcaatatgtatttgtgtgtaatagttcaagttgctgtgcaattcaaactgttctcggtggctcatggtaactcccatctttttttaaaaaataaaaaaaggcctcccccacatttatttatttatttcagatagagtcttgctctattgcccaggctagaatgcagtggcatgatctcagagcgagagtccatctcaaaacaaaaacaaaaacaaagttccttacatcctggagcatacattcatgatgtaacataccaataggaaatacagagtggtaatatatgacagaaaaaacaatgaagcagggtaa

SEQ ID NO: 218578 - DNA, 257 bp, Homo sapiens
gaagagatgggttttaaccaaccaagggacgtaatggttccattccctggggttcttccagttttctattcctggaggagagggaccaggacttttccatactttgcaacttcttactgctcaccatccaccctcgatcacaatcccagatgtgagttatggatatttaatacagatttgtgtgcaaatgaattggaaagaaggggatagaaacatcagtgggttaccccaagcgagtcagaactttttgcatcaat

SEQ ID NO: 218579 - DNA, 807 bp, Homo sapiens
acaatgctaggtggtagatatggttttatcatttactgctggaagcatgtagggacagatatataagaacttatccaaggtgggcacagtggtgcatgcctgcaggcccagctactcaggaggccaaggtgggaggattgcttgagcccaggagtttgaggccagtctgggcaacacagtgagatcaggtctcttaaaaataaataaataagaaagaaaatataacttatccaaggactagaaccaggaaatagagctgggattcaaatccagtgtgactcttctggtgattattttccctgaggtgctgagaaagcttttcagatcactgaacagaaatgaaatctttgttacatctggagaagcaggtagattcctccttgggagtaaaaaaaaaaaaaaaaaaaaagactcaggttgaagaaaacggtcacacccaggttccctactgagatgactaggccattcaattaaatcaaccagagggcaagtctcctgcctcctttctcagtgtagtctctggaaatttattaagtctgtctgctgttctgagttctggtcaagtctcactgtttggggaccactgatcaatgtgattaccacagatcttgttttcttttcctgtggctatctatattgcagccatgttactgcttaccagctcaatgttaaagcttaggcaatctgaaattctagagaggaagagataagtgcataacttgaatagctgttgaacagctgttgtaactggagctgttgtaacgtggagctgttgtaactggagctgttaactgggaccggctgata

SEQ ID NO: 218580 - DNA, 364 bp, Homo sapiens
agaaaattcttacttaaggaaactgaagccactatttgtgtttggaaaccaagagccttaacttacgtgaattcaatttagttattatacactacacctgtgctcttcagaattgtgccagattcccactactctccctctcattttactcctaatctttcttttcaaacacctgcccttctaccatttttttacaatattcattttgaaaacgtgtagtttttttctggagcaaactcaggcacagtcttttaaaagttggttaaattgattagtaaaattgataagattaatgataattaataataatagttattcaccaagatcagtggttatagtcaataaacaatttcttttcttttcc

SEQ ID NO: 218581 - DNA, 350 bp, Homo sapiens
tagccaagactattagtgcaagagctgagtaactgtatttatttctgtgtgagaagactgaagcctaagagtaaagcatgttagctgggcactgtggctcacatctgtaataccagcactttgggaggctgaggcgggtggatcacctgaggtcaggagttcgagacaagcctggccaacatggcaaaaccccatctctactaaaaatacaaaaattagccgggtgtggtggcgggcacctgtaatcccagctacttggaagactgaggcaggacaattaattgaacctagaaggcagaggttgcagtgagctgagatcgcgccattgcactccagcctgggcaacaaga

SEQ ID NO: 218582 - DNA, 382 bp, Homo sapiens
aatggaggatttgcacttaatgaccaacccataggtttactcttatattacaagatttccatactctgaagaaaggagctgctagattatttgttgtctcaggcagggttgagatgtgctgtcgggagatggtggctgtacttgggcaatgtcttccatcttcagagggaagagcatctgaactctcgggactgccagcccagccctttcataattagtgaattcacttagttgtccacccaactccaacccctcaccccagcttaaagtaacgttggagagaaagggttctaagtcagcttttctgaaggcagtggtagcagactgatttttacaagcctttctcttagtaggaagccatcgtagcatcaaagcacactta

SEQ ID NO: 218583 - DNA, 599 bp, Homo sapiens
tataaatgccagtgcaaaaaaccaattcaggcagccacttgggacaggagagccctggggatcagagaggtggcccaggacaacagcagtgaccactgtgtggcggccacagtcgagagatctgcgcccgagcctgtcttcctgttgtggagtcagtccctgtctctgccatttcagcaccagcttcctttagaccatgtggaaaagagagataaactgtccctccaaaccagcgggtgagataagggcactcctgtctgtccctgtgtgtcctacacggggtcctgggcatcagggcctgtgcctttgggaaaggcaggaagaggcggctccccatggggaggcagggctttggccaggaatcatttagcggggaaaggaaggaaaaggtcagcaaagtgttcccattacaggggggacagcaatcaaagccccccactgtcaatggcaggaggagaggcggtgtgaaaaccacatggcaatcagggtctagaaacaaaacctgaaatctcgctgtgcactgggagggtgggagactcacctggacccttgccaactggagtggagaaggtcacagatcccacagagccaggccctcc

SEQ ID NO: 218584 - DNA, 415 bp, Homo sapiens
attctttaaaaacttttcgagcacattttacatttcttctttaaaaaaaaaaaatctctgcgtatttattttactggattcttaaactgttacttttttattaaaaagaaaaagctttgggctgggcacagtggctcatgcctgtaatcccgtcattttgggagactgaggcaggtggatcccttgaggtcaggagttagagaccagcctgaccaacatggtgagaccctgtctccattaaaaaatatatatatatacacaaaaattagccaggcatggttgtgtgtgcctgtagtcccagctgctgaggaggctgaggcaggagaatcacttgaacccaggaggcagaggttgcagtgagcccagatcacgccactgcactccagcctaggcaatagagtgagactctgtctca

SEQ ID NO: 218585 - DNA, 199 bp, Homo sapiens
ctgtttcattcttttgtctcaactcaccacatggaaatttcttgcccttgagaatacctctcttgccactaagtgtgaggacgacgttggttcctgggtcccacctgactagtgtgacgagtcacgtgacgcaaggagaataacgggcctgtgttctcgggctttttgtttccgtcaagcttcatgacctgcaggaagt

SEQ ID NO: 218586 - DNA, 531 bp, Homo sapiens
aatgatgctatttcagattgagtaattagacaaggtaagttgatattttgattgatacctgaataagtaagggagccagtcatgcaaaaatatggcagaaaagcattctagacagaggcaataggatgcgcaaaggtcttgaggctagtgtttgatgtgttcttgggccaataagggagtgcattttttctgaagcagggtgagtcaggaggagagtaaaagatgaggtcagattgtgtagaacattttaaaccatggtaaggacttaggacttgattctgtaagaagtagaagccactgtagatacatgatatggcttgagttttaaaatgataatgccagcctgtgaattgagaacagactagagagtcggaagggtggaagcttggagaccagtttggaggctattgaaataatccaggcagaagatagtggatgaggttgacattgggatggggtggtaagtggttggcgtgggctatatttttaaatagtctggaggaattgctgatgaatgggacatggaatgtg

SEQ ID NO: 218587 - DNA, 218 bp, Homo sapiens
gctttttcccaagatctccagttgctcctggtaacatcaaatgaagacagaaattcttgtattgcccatgcgagattccccaagtccctcatcctacagacccaagaaggaagcatgtgaagagagcgaagctaaacgttgaaggtcctggttggagttggtggtcaactccactgttgcttggatcactaggcattaaagggttctgaggctgcatt

SEQ ID NO: 218588 - DNA, 330 bp, Homo sapiens
gtggtagatgtcgactcctatttatgtaagagtccttttcccttaataacatggatccctaaattttctctattaagctgttaaattttacatttaattaagcatgagttaaaattgtaagtttccaaaaccataactcaaataataaatgaagtgccaccttcatcatattaaaccaatgttctgaatattcattgttcagggttttatgatattaaaagtgaacatcttagttcactagtggtatggaagctagagctagtttttgttgttgttttgacacggagtctcgctctgttgctaggctggagttcagtggcgcgatctcag

SEQ ID NO: 218589 - DNA, 380 bp, Homo sapiens
cgcttttgtatgtcaatcatatctcaataaagtggttaaaaacaaagaaacaaaacaaaacagaagctagtcacaaggaaccacatattaaataattctgttcatatgaaacatgcagaaaacaaatcaatagagacagaaagtagatgagtggttgccaagggcttgggatgagatgggggactgaagagtgatgactgaagggcatagggtttctttgggggcttccaaaaactgtctgaaattgattgtggtgacagttgtataatgctgtgattatacaaaaattattgaattgtatactttaagggaattgaatagtgtgtaaattatatttcaataaagctgtttttaacaaaataaaacatttctaaatgctt

SEQ ID NO: 218590 - DNA, 441 bp, Homo sapiens
gaaagaaacaaattctctcaagcatcctaatcagtttccttttcagtcttcttatccaagcaaatggattatttctcaacaattttatcttcaatgttcattcagtttatatagtgactcagaagggttgtagctatacttcttgtagcctttccctgtgtagaaaaaagacccgtgtacactacagcatttaagttgagtttctctgcatcaaagtcaaaatgcaaaaatttgcacgcacacacacacacacacacacacacacccccactcacccacacaaaccaaaaaccatctactgaccctatcatctgcagacattccctcaaggggctttccagggagctaccaactcttacaggccccatcactctgaccaagctgcctggacagtggtgacaccttaccacccattgataaccagcttcctgtctggtggag

SEQ ID NO: 218591 - DNA, 495 bp, Homo sapiens
catggagctgccttccagctggggtggagagtgggagtgaggcaaacaaaaggacttttgatagggtctcagtgtgggggacagccagccagtgaggcctgaggcctcattattcctacaaagaaaagtacatgcctttgtaccagaagaaatgtcacatttgcacagcagagcaagaggtatctggaaaaacatacaggagtataagaaggacaaaatttaagagcaactttatggtctgttctaaagaccagaattcactgcagtatatttagaattgtgatctttgacaaataaggatcaccatgtctggacttttttgggaaagcacttttgaacccttaactacgaagttttgctcttgcgatgtctttgagacccttcttttagtttactccagcggaatgtaactcgtggcataactaagcatggcacaagagagtagacagatccagatgggcccttgggtcttctagaacgtccttggctatttta

SEQ ID NO: 218592 - DNA, 437 bp, Homo sapiens
gagtgtagtggcacaagctcagctcactgcaacctccacctcccaggttcaagcgattctcctgcctcagcctcccaagtagctgggattacaggggcacaccagcacccccagctaatttttatattttcagtagagatggggtttcaccatgttggtcaggctggtctcgaactcctgagctcgtgatccacccacttcggcctcccaaagtgctgggattataggcatgagccaccgtgcccgacctgtgcattttttaaaataaagttttggccatagtaatggtgcctcagtgtgaatcaggcacagccttacagatgtgggacacgtggcacttagagggcactccctctgctgtggctggggatgtcgtggacgtagatggtgacgggggatagggccaccaggggctcacgcctctgtgtcatcgccta

SEQ ID NO: 218593 - DNA, 107 bp, Homo sapiens
aactaatcctatttagctttatgctggtctacaataaataattcatacttgatatttcaaatgctgtattatttatgtaaattttctcctaaaagactcacctaaga

SEQ ID NO: 218594 - DNA, 396 bp, Homo sapiens
agggtgtttttttttttctcttcaatttcttactttggggaaaactctggaaatgctgtgtgtttttggagatttccaggggttattgtaggaagggtagaagactcccccatccacactggggtgaccctctgggaagggtagaagactcccccatccgcactgggatgaccctctgggtgccaccgacttccctgtctgcagaccctcggaagctgctgttccggctctagtggaagtgactcctcatgattagaaaaggcattttcagcacaaaactctatagttttgcatcatgctgccttactcttctttccattagggtgaacaaatgttttataacaacttatcaggtatctacttgtcacctataataaaaacgctgagcacttgcta

SEQ ID NO: 218595 - DNA, 638 bp, Homo sapiens
accaaaatttctcttttcaatctttgcaaattaaaaaggaatcttgccaagaataaacaaatcttcatttcatacctaattttaaaacgaattgtgtccccaaatatggtctattctggctaatcattttttaagcaaatcctcacttactttttctgagtcactttagtatgtaactaggataaatttcatagttgatcagaatgcaaatgttctaacttgacatttttgcccaagatacgttctttccaggtatagctgaattaagtaggaaaaatataaataattgctcttttaaaactataacaacttgaatgcctgcggttttatttccatctaatttaaaagttatctgtaacctttgtttgatagaaggtctgttgaagtgtctaagaaccatgttgaaatatttgtgataaataggccacaacttaaggatattatgcccaaaagtgaactgacagaggaaagtactcttcatataactgcacagtgaacaatttagaaagggaacagatgaccagacacagtggctcatgcctgtaatcccaaagctttgggaagttgaggtgaaagaatcacttgaggccaggagttcaagaccagcttgggcaaaatagtgagaccgtatctctaca

SEQ ID NO: 218596 - DNA, 405 bp, Homo sapiens
tacctcttcaatgcctctttcagcaatatgaagttaaaaccagaccactttcattacatcgccactgcgaataccacctgtactgtgtcaagtacaaaaaaaactccagacttggcccagtccggaggcacaagcccacttgcgccagcagcgcgcctcagcaagacagcagaagcaggaagagagccggccggaagacacttaccctggccggaagacatgtacccctgaggatcgcgagaggccatccggttgctgcgtagcagtcccgtcagactggaacacttcctgtttacaggacactgtaaaacccctgctcagcactcatttggtgctgacgccattttaggtctcataccgtctgcacccaggcgcccaataaaacagcatgttgctccacaccac

SEQ ID NO: 218597 - DNA, 379 bp, Homo sapiens
tctgctgctccaggctgagggtgggtccaggatcaggggcccgggagaaggagagtttggctaaccagcactctgttctggtggatcggcccagtccggaggcacaagcccacttgcgccagcagcgcgcctcagcaagacagcagaagcaggaagagagccggccggaagacacttaccctggccggaagacatgtacccctgaggatcgcgagaggccatccggttgctgcgtagcagtcccgtcagactggaacacttcctgtttacaggacactgtaaaacccctgctcagcactcatttggtgctgacgccattttaggtctcataccgtctgcacccaggcgcccaataaaacagcatgttgctccacaccac

SEQ ID NO: 218598 - DNA, 373 bp, Homo sapiens
tgctttttttagcctgcgtgacaaagacatgagctcacgattattacagcatccagccgaacagcaaggattcaaaatgaatatgggaagatatctccccaaatcactgtcttattttgtcttatgactacagcatttctgattcttaatttattcacagaccactttcattacatcgccactgcgaataccacctgtactgtgtcaagtacaaaaaaaactccagacttggtaaggagtcactttatagaaaaggattattacaagaggaaggggaaggggctgttgtaataggaagagggggactatttcaatagggagaacgctcctaaaatgaaatctgccagcatctcaaaggttgggtagaaagggg

SEQ ID NO: 218599 - DNA, 464 bp, Homo sapiens
gcttccagatagggaaaaggagggtcaggtgcctgaagctgggtgggggtgtgtgtccgcattttctcaaccattttctgaactctaaaagacagaccagaccccgctgcacagccttggggtgctggctgggccccttcccaacccagcacctcacttctggtctcctaaatcctctcctctctcctcctgaggggtagggtaggtggcgtcctgtgccacaggtgccacactggacatgtcaggccagagacactggaggccggcagtgggcaggaccaggcctccgggagggagcgtgcgaggacaccacgccctcaggccggacccccacccagctctgccaagtcccagtccccaccacctgaggcctccccagtacccctgcgaaaagggtgacaactgggctttgcccatctccccaccgccctcttccccagctagacccacaaggaaggcggccg

SEQ ID NO: 218600 - DNA, 482 bp, Homo sapiens
gcttccagatagggaaaaggagggtcaggtgcctgaagctgggtgggggtgtgtgtccgcattttctcaaccattttctgaactctaaaagacagaccagaccccgctgcacagccttggggtgctggctgggccccttcccaacccagcacctcacttctggtctcctaaatcctctcctctctcctcctgaggggtagggtaggtggcgtcctgtgccacaggtgccacactggacatgtcaggccagagacactggaggccggcagtgggcaggaccaggcctccgggagggagcgtgcgaggacaccacgccctcaggccggacccccacccagctctgccaagtcccagtccccaccacctgaggcctccccagtacccctgcgaaaagggtgacaactgggctttgctcaatgccccgggcaggcccatctccccaccgccctcttccccagctagacccacaaggaaggcggccg

SEQ ID NO: 218601 - DNA, 434 bp, Homo sapiens
ggctctgtcattcagtgtcctttctcctgctgggaagggcacatcctgtggctgggtggctcggctgggagatggacccagatcctctggagagctgccccccaacctccctgcaatgggaaaggtgcttaccgcacagcctcagagagcttcccactgggctgccctgtacaggacaggagtagcaactgtgccccagaggtgtagtccccatgtggtctgctccctgggcctttaaaatggggggaaataaagtcagaatgaagacttatagatctgctgagaagagcaaatgcgctggcatacaggacagcacactggccactgacacacactccccaggttacaacacaactgtgttgatgtggatgatgatgatgatgatgatgttaatataatacatttgatataattatatgtcataataattattg

SEQ ID NO: 218602 - DNA, 412 bp, Homo sapiens
acttgctttcctagagtttgacatgtggtgagggaggttttttttctttaaaaaagattactagcagttggaaaaaattaaaaggcatatggcaagtgttcaagaaaagtttttgatttaagaaccatcttgaccgggggcggtggcttacgcctgtaatcccagcactttgggaggccgaggcaggcggatcacctgatgttgggagttcgagaccagcctggccaacatggtagaaaccccgtctctactaaaaatacaaaattatccgggcgtggtggcacacgcctgtaatcccagctactcgggaggctgaggcaggaaaatcacttaaacctggaaggaggaggttgcagtgagccaagatcagcgacactgcagtccagcctgggcgacagagctagactatctc

SEQ ID NO: 218603 - DNA, 469 bp, Homo sapiens
gtacacacgagtatggctgtagaagtcaggatacaaaaaaataaaagctaggttaggagaccaaagaaaaactgggggcaaaatctaaatgatgaattggaaaaatatttttctgttggattgtaggaagagaagataaacaaagtagttagtatcttccattttaataattggtttggaaatattttttcatggaggataagggttttattggggtgctagtattttccataattaggcttacagtatttctgaagataatacataatttttaaaaggcataattaaatagaacatcctcattgtgtttttgtgcctcacagacttatgaatattgcagtttgtggattattctgttattacaaaatatttttacatttcgaaagaatatatgtggcaagatgagaggaatccaattttaaattctaaggcaaatattaaagaatacatgtatgccttcatagagtag

SEQ ID NO: 218604 - DNA, 1068 bp, Homo sapiens
tcttgggtagacttgtgactttaattgtttccgtactcactgttgggtttcacctggctggatcgcagaatcggaatcctgatgcccttactggaaatgtaaatgtgttggcagctaaaattgctgttctgtcgtccagttgcacgatccaagcctacgtaacatggaacttaattactctctggcttcagaggtgggtagaagattctaatattcaggcctcatgtatgaaaaagaaacggtcgagatcttctaaaaaaagaacagaaaacggagtgggagtggaaacttcaaatagagtagactgtccgccaaagaggaaagagaaatcttcataatctttgcaagcgcattgattaatgtctgcaaaggaatctgctctttgaggtttctttctgcactagagatttttctgtttttgaaaatagttcgtgctcttcggtttttgttattgaactgtttcatgtattttttaaagacatttgaggggaggaggattattatgaatgggaaaaaaagattttggttgagactaaattactcatcgtcaaaataatgtcaaaatagttttggggatcaccactatattttgttttgatttttaacctttcaacattttcctaatgatttgcagagataactgcacaattttgcatatcaatgatactggttcttactcccaccagtgtttcataatactaacaagatggtctctcctagcaagattatgtgtttaatgcttgctttggggtaaaataaaagtacgaaaaaggtggaagtcaaatcagtattctgtaattgttagaatttattttttaagaacttacaactcagaaaagattgctagactcaccaaaataataaatgttctttattttacaggtagtgattattagtgcttcatccccatttaaaaaaacacagtactaatgggtaacacatatggaggtttgctgccatatatattgcatcaaaatatcattaattaatataaaaatattaaaatcattcctgtccattccacttgtaaatgggaattcatgaaattaaatattactttaaaaagga

SEQ ID NO: 218605 - DNA, 460 bp, Homo sapiens
gtttctaactgatgagatctgtgacaaatccctgtggtcagcagcaggcattggatatgtaactttattctgtcccattgatcttgtagtcaaccctggtctgttctgtattgttttaattacataatctttgtaataatctttaatacctggtggagtgctctgtttacttatttctgcataattaaccacccctaagcttaacttactcatggttctgcaggatgactgctctccatggttataggggtttctgcatggggcctctcacatgtgctacagtcaaacattagccggggccacagtcatctgaaactcacttacacggctgacaattgatgttggctgttgcctggagaagacatatgtggcctggtggaatggaatggtgactagattcaagaaagagcttcccaggagcaaggctaccaagagaccgaagtagaggcttcagtttctt

SEQ ID NO: 218606 - DNA, 352 bp, Homo sapiens
ccttctgtgatttctttcctttattctttcaccgaacacatccttactgagaccttctaggtgctgggtgctgttctagatcctgagaaagatatagagacctgtgggagacaggctcctccctgccttcaagaactttgcagttgggtaggaaaataagcctaatcaagttactaccctgtaaaggggaaagaagggagtgtctcaaaaggtgtgtgaaggatgaggaatggggaggggctcattagtctggcagggagctgttaacagagacaggcatgggcatcggatgaagaggacatagtcagtgtaagaaattaatgattaaatcatgagaaatatttattgagta

SEQ ID NO: 218607 - DNA, 524 bp, Homo sapiens
gtaaagtttaccaagaacaactggtttgattcaaggtattatattattttgcagtataggaaatgttatttagatttaacaaagggctgaacagagcagccagtccaaagacccaaataccaaaggattatctttaaatttagagaatgaaaaatgcaagagcattgtattttgggcatcagatgataattctttcagagaatatgcctgggtttttgtgtccttcaaatttcgtttgaatgaacattttatggatttttgtgacactgagggatatgttaaaataccattgcaaacatgtcaggcaactcaagtttagaagattctcaacttgaattattttagcattctgctatttgaattacttgggggaaaacaggagttgtatgacaatttggaggtccttttctttgtctcccaagtgagtttgtaggttcactgaatttccccaaagaagatcctgagacaagaatttgagtctaaggacatgagggagggggatgtgagacaggaatgggggaggt

SEQ ID NO: 218608 - DNA, 676 bp, Homo sapiens
gcagtatctatttccggaacatttcgtcgtcctaaacagaaaatctatacccattaaacattaactcctcattctctctttcccttggttcctggtaaccggcattctactttattttttatttttcatttatttttgtttttaaattttgtttaaatcagggagcaactgatggcagaaattacagtcattcagggtgtagtggctgcctactctgctttccgactctgaacttgactagtccagatacctaccataagtggaatcatccaatatttgtcctttgaagtttgacttgtttcactaagtgtaatgttttcaagtttcacacatattttggcatgtgtcagcacttcattccttttttggctgagtaatatttcattgtatgggtgtatcacattttgtttattcatttgtcagtgaacatttaggttgtcttcaacttttggctcttgtgaataatgctgtggtttattctgggaggatgctggtagatttactccttagtgaatgcaagttgctcaggaaacacgccacttttaggaaaaagtgttttttcctgtcagcaaattccatttgagtctgtagcattctgcaaggacaaacttttagagtggagatattttgttttgtgaccatggggccctgcaagccttagagttgcttaatataa

SEQ ID NO: 218609 - DNA, 516 bp, Homo sapiens
cacagaccctgttcactgtcaccggttttcacctgcacatatttgtgtgtgtggttctctgtggttttctctgatgtatagatttatgtaacaacaaatgcaaccaagattcagaactgttcgatcaccacagaataactaccatgtgatatccctttatcctggctccctacgccatccaacagggagcattttgagttccgccaccacctgtctcatggtgaaggggccacagatgccaggcctaccctgggctgttgctgcgtgtctctgaggccattgctgcgtgtctgtgaggccattgctgcctgtctgtgagcaggggcggcccatcctgcctgtgctgctgtcttattgatataatatcttcttttacaaatctatcttgccgtctgctctgtccccccttccattgacgattgtacctttgagtggctcatagaatcatcttgtgaaattggctctttttataaatcatcctctccctgtttcgtgttgcatccaacctgattttgg

SEQ ID NO: 218610 - DNA, 527 bp, Homo sapiens
  misc_feature (27)..(27): n is a, c, g, or t
  misc_feature (29)..(29): n is a, c, g, or t
ctcaggatactcaagaaggcatctatngnaaaaaacactgaagagcagtagtatctccaaaagcattttgaaatgtttaggtgtcagaagagttactggcattcagtgagaattaaggatgaaattaaacatcttgcaagaggccaggtgcagggctcacggctgtaatgccagcattttgggaggctgaggcaggaggaatttcccaaactttgactatatcttgttttcctttaaaaacaaaaaacgaaaaaaccagctgggattagaggtgcgagctactgtgtctggcctgctgtttcttgagtacattcgcttctcttttccttacatgttcatggctttcctgtgaccttatctttcctttcttggtatttcccatcatcaagagtaacttctaaaaatgttcatttgatcattttgtctgttattaggcaaaacaggcctaaaacaaatccaagataacagcggcttaacagagtaaaaatgtatttcttcctcaaataattttcattgaggatgtttca

SEQ ID NO: 218611 - DNA, 390 bp, Homo sapiens
ccacaagtgttggaaagattaatataactctcagaaaaaaaagaaaataaaaaagaagcctaaaataatttcagtgggaggaaaagatctcttggattccactagtcacagccaacactactctatggaaacattgtcctcttttcttctgtgcctgaactcccaaattaatttctagtttgaaaatattctgaccgggtgcagtggctcacacctgtaatccacacactttgagagactgagatggggggatcacttgaggccaagagttcaagaccagcctgggcaatgtaatgagacctctctataaaaaacacaaaaattagccaggtgtggtggtgcacacctgtagtctcaactactcagggggctgagcgagaaccctgtctc

SEQ ID NO: 218612 - DNA, 216 bp, Homo sapiens
acagacaataaacaaaataaatgaattttaaaaattagaggctgatagatgttttgaagaaaaagaatgcagacgagggaagtaagaacactgcagtggcaacatgctgcgtgtgtggagtggggggaggagcgttaattttaaacggtgttaccgggaaacaattactgaaaaggtgaccttttaatagaggcttgaaggaggggaagtggtgag

SEQ ID NO: 218613 - DNA, 436 bp, Homo sapiens
attttaggtggtctcccataaccatcatatacacgtttgtgacgtcatttacaaatcaacttgaaaatgtccctaagtagctgaatttaaccagttcacatttactatgattaacaatatgcttcaacttactcctgccatcttatcctttcctgtttttttaatttcttctcctaatgtttactggatcaagtgaggcaagcaaaacacagaggattcagttctttccagacactgcctgtttcaactataacaatgtggcaacaacagctccaggaagtagggcttgctgctctaccagactctcccgtcatcctccacagactgtagaaacaggacttacccttgagactaagtccctgtgggtcttgaccttatctcagaaaggggagcggggggcacacaaggatggaagagtatcaggggtaaaaaaaaa

SEQ ID NO: 218614 - DNA, 194 bp, Homo sapiens
ctgaacccatcttcagatgaatggatcttaaagagtgacaactgacggcctggcgtggtggctcacggttgtaatcccagctttgcaggcagaagcaggcagatcacgaggtcaagagatcgagaccatcctggccaacacggtgaaaccccgtctctactaaaaacacaaaaattagctgggcgtcgtggctc

SEQ ID NO: 218615 - DNA, 494 bp, Homo sapiens
agtctcccatctccagctaatttggccaagaatagtcacctggcgcaaggtggggagggagctctcaattggccagcaacttctgacgtgtgacctgactgaacaatgagaggctcgagtgaaattaccagctggtagtaggacagaggatatagatacatggaatggagctgagccaaattaatgacaaaggactagacaagaatgactgttgatgatcacctatgctgagatcacaaagctgccccgagtccagaagcaggttcactgagggaggctcaaccatgttaccaatcttgtttgagattaatgttccttgttgtaaacctcaagtctgtttcttgcaatcaaaccattctaaattgaaacaactacttagaaagtgtttctatgggttcagtgggacatttcaaccaaatgaaatatgataatgatcttaaatgaactaacaatagtgttgcagaaataaaatacaaataccagaaagatagcca

SEQ ID NO: 218616 - DNA, 594 bp, Homo sapiens
agcttcctgagcacaccaccacgcctggctaatttttaaaatttttttatttgtagagaaggagtcccactatgcagcacaggctggtctcgaactcctgggctcaagtgatcctcctgccttagcctcccaaagtgctggattacaggcatgagccatgttacctggcctgaatttttaatattaaatttccatttgaatttgggctatacaaaaaattaatagaattaatgttaattaaacttagaatttaagttacttcacaggaatttttatttaagtctgcttaggaattttttaggaacattaaattaaacattaaacattaacattgaaacaaacacagtcatctccattttaagcagaattcaaggagaactcattttattcttaagattgcttaaaatggagatgatcgtgtttgttttaattagacttcaaggctttgggatggggagtggaaacaaaaacaaaatacttagcctctttttctctttttctttcaatttaattaatttttttttgagacagggtctcactctgttgcccaggctggagtacagtggggccatcatagtttattgcagcctcaat

SEQ ID NO: 218617 - DNA, 324 bp, Homo sapiens
agctccatgaagataaggagcatatctttttgcttatctttgtggccactgcgcctgtcacatagaaggcactggataatcctttgttaaatgaataactagacctaaaaaatacttcaaggtaggtgatgcagtcattaagttcacactacaatgaaagacagttcttcccaacaggacattatatgttttttctactgtcatttctatttgctaaattgactttgagtttgagaaattgggctatgacgcaatatgtgcataaaatgttcaacaaatactgtgttccatttttttaaagcaaggataaggatgagtcgacgc

SEQ ID NO: 218618 - DNA, 472 bp, Homo sapiens
agtagtagagacagaatagagtaaaaaataagctatgtgtggctctcatgagactaatttagactttcatgacttcttttttcccttgatttttctttaaaactggaggcaaaacaacaaaaataagccaagctcagggctgatatcaggttgttttgattgtaagaacataaccttgccaatattgtaccaactccactctatgtaggcatgttgttctttggctcacttagagatgaagaaatgaaggttcatggatttttgagtcactggctaacccaccttcctccccaccactctctctgttgccagcatattcttcattcagcctttgtcccatgagggatataaatttagaagagaaacctgtaggtaattaacagtccggcatgtctgtcattcctttgataaaatgtgttgggtgtggtttctcagcatgcagttgataaaatgcattggtggtgttccattt

SEQ ID NO: 218619 - DNA, 468 bp, Homo sapiens
atttttacatagcaattcttcacgatctattgacattgtatttatagtcaacctgagtagatcatcataatgaccaccatttattgggccaggcacaaagcttaagacccaaagatcatacaattagcaacagcaattctggggttcaacctgggtcagtctttctatcatatcgggataccacacatgctttggacctatctacataagtctttccacttcttggcatgatgaggtcaagcagagtggtgatcgtggcaggacatggggagagggtgaggatacacttctgtgtgttcagatgtagccctccaactggcctatatccctgagtccttcccaagaccaagcactaatgatcacctggttgtctagacatctcctagccatcagtttccaaaatctatttcccagagtcctcaggtttggtggaggttattttggaggttgccttaaggagcaagaagg

SEQ ID NO: 218620 - DNA, 540 bp, Homo sapiens
tgtgaattttatacaaaaaatgagattgataatctgaatttttaaatgtttaaattaattgagcactttgtagcctataaacaaacatcttctttttaagcatccagggaacactttaaaaaattgatcaacttcttggtcacacatttcaaaacatcagaaaagttgctcgggctgtattctctgaccacaagcctataaaactccaattaaaggacaactttttggtgggacttttaaagcaatctcctcaattacaacagagaattcaaaactaccgttaaaggctattagaaaattacaacaatgatgaccctgtacgtaaaaactcaggatgtgaccaaaggtgtactcagatgaaaaacatccttaaagtttttcaggcacaatggtgtgcactgatagccccagctacttgggaggctgaggtgggaggatcacttgagcctaggagttcgagccagtagtggactatgattgtgcctgtggatagccactgcctcagcctgggcaacatagggagaccccatttttaataac

SEQ ID NO: 218621 - DNA, 458 bp, Homo sapiens
tacacgaacctcctgctctgatcaaacagcgctactcaccattgcccaacgttccactttctcaccagtgtgtttttgttcacccccatcttctcctcccacatttctcctccctaatccctccttcttgaccataccaaaaactcagtatcctctatttaaatcctatatgccttttacgaggcagtataatttctggtcctccgtgaggacagctgcagagaaattatagatgacctactgtttattcctgtagttggcattttcaatttagattatgttttgcctttaaaaaaatgtttttagattttaaactcctaaagggcaagaacggactctataactctgcatacaaccaagagccctgtgtaatttagaactcaaaagttaatgcttttaatgtcactgatattatgaagataaatagaggaatgcaatagggagagttgttaattact

SEQ ID NO: 218622 - DNA, 574 bp, Homo sapiens
gcagtgcatcctatcttctcatagtcgttcttgagttataccccgttacctctgcctgggatatgagaggatgtaactttttgaagtgcatcaacttttaagaagtctcgttagggaatccacattgttataaaaaatatcttgaggtgagacacagacacaatgggcaaaattctccattaatattcagatttcttgtattgcctgccccccacccccccaaccccccattttataagcagttcaagtcagggctgaaatgctgtttgtttaagatagagaatagtcacccaaatgggagtccctgtgatctatggggctttgtgtcaagctgaatagaaccaaggaagtttagcaattattcaactgttcctaagtgccaggtttcagcagcttagtatgatttcatttaattctcaccacaatgttattatgtagaactggtaatattctcattttaccaaaggagaagccaaaacacagagaggtcagtaacttgtcccaggccacaaagctgaaggctgtgttcctcatggtctttgccctcatgggaattaggctccagatggtgaaa

SEQ ID NO: 218623 - DNA, 380 bp, Homo sapiens
ggcttaccaggaccatggggaatatgaaggtgacgggggccctgcccttaaggagcacccagcctggcatccttatggccttccgctggctggaccattctctgcccactgttgacactacagagctggaagctgcttctacttttgttttgttttgtttgctacagcatcttgctctgttgcctggactggagtacagtggcataatcatggctgactgcaacctcgacctcctgggcttgagcaatcctgctgtcccagctcctggggagtcaggcaggagaatggcgtgaacccgggaggcggagcttgtagtgagccgagatcgcaccactgcactccagcctggccaacagagcaagactctgtctcaaaaaaaa

SEQ ID NO: 218624 - DNA, 337 bp, Homo sapiens
ccaagaggcctttacctttcttggcctgtggagtaaatagacaatatattatgaaaggacttgtatgtaccctttctgtttacaatgagatgtttaggtttcttaattttgaacaaattcaatttaccaaatattccagaacacttgatttcttctttttctttgatttgtttcttatctattcattgtctgtgtcttacttttttcatagtaagattgttcttgaaaaatgaaacttctaggctttctaaaaggctggagtgcctttttagaagaagtcaacagctaatagatttgttcttatcattgaaatttcaaaagttataccaaccctcca

SEQ ID NO: 218625 - DNA, 397 bp, Homo sapiens
tgatctgtctgcctcggccttccaaattgctgggattacaggcatgagccaccacccctggcctgtagtgaagaggggtcgttgcttggtcacaaggctgctgagtctgcactagggtccgcctttagttggcttgttacaaggggcttgggtagttgtaatttccattttatttttggactttcctctgtagggcagaacactagggcagttttttgcagtcgggtctgcatatggtgggctttatatcaggttgtggatgagtgcggttttcactgagtaccagagaggatttccccaggtaactgtgtgggtttctagttaggcagaactggccataaaccatggctcagggagctggaacagtcattgaactgcttcagggtccacagtaaag

SEQ ID NO: 218626 - DNA, 676 bp, Homo sapiens
tggtaaagacattcaggcttgctaaaatctaggaagaggtcatttggcaggatgggttacataatgctatctgatactaccaaataaaatgagagagaagccttaggcatgtaacgtttggagatagaaaatgtaccttcactatgaaggtagtgtgtgtaagatggcagttgaaagcattgcttgtgtttatgtttatacccttgatctctgatgcccttacctaccgtacttaaaactctgttaatcattgtctttctccccctcccacaacttctgcataaaattttaagatctgtgtttcattagttcaagagtgcctagaatagggccaggcactgttatacagtatgtggtaaaagactattgagattccagttttcaaggaagagtgccattaccgttttgttaaagctggcaaacaagacaaagttgtgaaatagactggttgctttggagccctctgaccgcttttcctgtagctccttctacctcccttgcctcccaatagattttttaatatgtcacattatctatcgaaattagtactccacatttatatgcactggcttgtgctaggctctgccaagactcctgaaataaaaccgttttgtcaacagtggcacaagatgccaaggaaaagtcaagctatgaaggattcttgaaaatagaacaa

SEQ ID NO: 218627 - DNA, 554 bp, Homo sapiens
ataaaaataatcacgagataaattgtgctaagctaaagaaaatatttattattctacaacggaaacttgtataataaatgttaaattactattttgcccacaaccagcattcaaaattctatcctgccaccttgtgttacttatcggtgaagtatccatgtctgtcaatactttttttttttttgctgcctgttaattcctccaagcagtatgttgccacagatagatgaaaaagatataaatcaaccaagtgaaaataattacttactagaagaagctgggcacagtggctcacgcctgtaatcccagcactttgggaggccgaagcaggtggatcacgacgtaaggagttcgagaccagcctggtcaacaagctgaaaccccgtctctactaaaaatacaaaaattagccaggtgtggtggcacacacctgtaaccccagccactcgggaggctgaggcaggagaatcacttgaacccgggaggtggagcttgcagtgagctgagatcatgacactgcactccagcctgggcgacagagtgagactgtctca

SEQ ID NO: 218628 - DNA, 208 bp, Homo sapiens
atttgcactcccctttcttcctggcctttcaacccctccctttccttcctcctcacccctcccaccccgcacccgagagacagcctgccgtcccaggtccagcccgcgcctctgcgcacctcccggcacccggcgcaggtcgccggccagggcacacacgcgtccccgcctgctcgccggcccgcaaggcccgggctgcggcggccgc

SEQ ID NO: 218629 - DNA, 417 bp, Homo sapiens
ctatcaataatagcattgaatgtaaaagggctgaatccttcaatcaaaaaacagagtggttacatggataaaaaataagacctgtttactctgctgactgttcctttcgctgtacagaatctcttcagtttaattaaatcccacctatttatcttagtttttgttgcatttacttttgggttcttagtcatgaagtctttgcctaagccaatgtctagaaggggttttccaatgttatcttccagaatttttatagtttcaggtcttagatttaagtccttgatccatcttgagttgttttttttataaggtgagagatgaggacccagtgggagataatcttcacagtcaatatatccgacaaagggctaatatccagaatctgcaaggaactcaaacaaattagcaagaaaaaaa

SEQ ID NO: 218630 - DNA, 463 bp, Homo sapiens
ctggattttgacatttctctacctatacagcttgcctgctgggtatccatgtaaatcactccctgcatccttttcttaaatgtcactttctcaatattctacttaaaactgcaatgcctccacagcagggcactccttaacccctctgatgcctttatttctcccacagcatttgtcaccacctgaaaatggtggcctctgagagtcagaataaggtgtggagaggtgaggcacaggactactacttttttaagtcttaagtttgtgaaggattatttgacatttacgttgtatacatgtatatctttcacttgtttattggtagagattaaaaactgccagagaataaagtctgagttcccatcaggcttcatgaatgaggatgttgagttcagcctcagcttcatggccagtagacgagtactgtgggcaagaaataaatctttgctgtttcaagccactg

SEQ ID NO: 218631 - DNA, 552 bp, Homo sapiens
ggatataagggagtttgggggctgggcgcagtgactcacacctgtaatcccagcacgttgggaagctgaggtgggctgatcacttgagcccaggagttcaacaccagcctgggcaatgtagcaaaaccccatctctaccaaaagtacaaaaattagccaggtacagtggcacatacctgtattcccagctactagggaggctgagatggaaggatagcttgagcccaagaggttgaggctgcagtgagctataagcatgccccactacattccagcctgggtgacagagcgagaccctgtctcaaaaaaaagatttttttgaaaagttgaaaatgagtatattcgctgaatacgagatgagttttcccaagaatttatccctcagaatctttcacgttcttcctcctccttctcctcctcctgctttcttcttcttctttcttctttttctgtttcttcttcttgcttttataaagtcttagctcctgtggagttttctctcagttacttcttatttatttatttgagacagagtttcactcttgttgccca

SEQ ID NO: 218632 - DNA, 531 bp, Homo sapiens
ggattgtggcctatttctttgacttggcttatcacatgtgttagatgcattgaacactcaaaaggggactatattgactgtgccagatggaatgagaatttctttgtttcctgcataggttagttgggtgtaaatctaggtacctcacttatctcctttatctttcctgtactacctacgttgagtatacctatatatctgtttaaatcttggacaatccaatattctgaaagcattaaaacaggagtacttagccctactattatattaaggcattaaaccaattaaattgagaccctactatggacaaaatgctttactatactgagaaatataaagaaaaatgagacatggtctttgccatccaagaactgacaatccaattgggaaaacttgtgttgaagaagctccaataaaagtttacaaaaaaattactggccaggcacggtggctcatgcctataatcccagcactttgggggctgaggtgggtggatcacaaggtcaggatatcaaacccatcctggctaac

SEQ ID NO: 218633 - DNA, 493 bp, Homo sapiens
tgagacattctctgttgcccaggctggagtgcagtggagtgatggagtgatctcggctcactgcaacctctgcctcccaggttaaaccggttctcctgcctcagcctgccgagtagttgggattacaggtgtgtgccaccacgcctggctaatttttgtatttttaatagagacggggtttcaccatattggccaggatggtctcgaactcctgacttcgtgatacgcctaccttggcatcccaaagtgctgggattacaggcatgagccacagtgcccggctaatgattttgagcatagaatacggttaagccaggtttatccccctcttccctggctgggcctgactcctaagccttttcacatctggcagaagccctcccactcattcttatccttcctccaagcttgggaccttgagcaaggctgaggtgtttgatttggccagaagagcagaactgaaggtgtctagggggagcctaccccctgcctc

SEQ ID NO: 218634 - DNA, 365 bp, Homo sapiens
gccctcaggaacttacaatcatgtcagaaggggagaaacacatacttcttctcatggcggcagcagggaaagtgctgagcaaaagggggaacacccttataaatcatcagatcttgtgaggactcactcactatcacgagaacagcatgagagtaacctcccccatgattaaattacctcccacttggtccctcccatgacacgtggagattatggaaactacaattcaagatgacatttggttggggacacagccaaaccatatcagaggctattcagaccagtggggagcactggcttcccattaagctatttccatggactgacaaccagtcagctttcaaaccaaaggtcccaggatgtgc

SEQ ID NO: 218635 - DNA, 273 bp, Homo sapiens
gactcattccagacaaactcacagtttttttcagtgctccaactgttgacctaagggttgtatttagcatctatcccattaaaacaattatcttattgtatttaaatcatctgagtttctatcatccttgaagagctgatactttatctttttgactgataatccttactccttgaacagtatatattatacatttgtcactcaggacatgttttctttaataaatatttgtctgaaaatttgagtttgattctatattactccatctatcag

SEQ ID NO: 218636 - DNA, 763 bp, Homo sapiens
cgtcactgaactccagtctgagcaacagatcgagaccctgcctgaaaataaatcaataaataaactcaaccgaaatgggtatgaaagttgaaatgggtatgtaagttgaaaaccagaagttttgagaaacatcctttgttaactttcatcctacaaattgggtcattcatgtcctacgcagctaaaacagagcccaggagccagggaggaaaagcagtcaggccacacaccattgctcccaaaatggacttctctgcaagcctgactcctgaaactgtgcattgtaccctgaaaccagctttatccatagcttctgcaataaatggctgtaagtcttggactccttgctataatcgcagctattcagcaatggaacctcccagttcccaacccttcctagtgcccatgggctttcccataggacaagagaacatttctccttttctttttttttttctttgaaatggagtctcgccctgtcacccaggctggagtgcaatggtgcggtctcggctcactgcaacctctgcctcccttgttcaagtgattctcctgtctcagcctcccgagtagctgggattacaggcgtccaccaccaaaccaggctaatttttgtatttttcataaaaacgggtttcatcatgtttcccaggctggtcttatttttattttattttttgagatggagtcttgctctgttgcccaggctggggtgcagtggtgcaatctgggttcactgcagcctctgccgcctgagttcaag

SEQ ID NO: 218637 - DNA, 608 bp, Homo sapiens
aacgctgtctcactaaaaatacaaaattagctgggcatggtggcgcatgcctgtagtcccacccactcagagatcttaaaaagactgacgctgtgccagaactcttggacagctctgttctcattaaggcattcaatcttcagttctttctgcagttgctatcttagacacagtttgagcagcctcttttacaaagtgtcttttcagctacctggtcttggaagcaggagccctctgatactcatcatgacaaggtagtttaatatacctgagagagccctctcaagaaaataaggagatttttgtcgtctttaacttttgagcttttcccccactccttttttgctgtgatctaaagccataatttgccaccttggtttctgaaatatgggaaaagaagttcgtgtacttatttaggaaaatcgtatttctgttacctaaggagcttgcattgttgacagggcttctttcgctacagaaggccccatcaatgtctgcttgcttgggctgtgtatgtctggttggtaaacatcactaatgaaactcgtgcggtcttgacatgtcaggattgcctgcacgaagagagctgctggcagcctttctccttg

SEQ ID NO: 218638 - DNA, 634 bp, Homo sapiens
gccctgtgtgcccccgtgcccggcccagacttttttttttttcttgaggcactgaagttggctcactgtgttcattctgttttcccacccactcagagatcttaaaaagactgacgctgtgccagaactcttggacagctctgttctcattaaggcattcaatcttcagttctttctgcagttgctatcttagacacagtttgagcagcctcttttacaaagtgtcttttcagctacctggtcttggaagcaggagccctctgatactcatcatgacaaggtagtttaatatacctgagagagccctctcaagaaaataaggagatttttgtcgtctttaacttttgagcttttcccccactccttttttgctgtgatctaaagccataatttgccaccttggtttctgaaatatgggaaaagaagttcgtgtacttatttaggaaaatcgtatttctgttacctaaggagcttgcattgttgacagggcttctttcgctacagaaggccccatcaatgtctgcttgcttgggctgtgtatgtctggttggtaaacatcactaatgaaactcgtgcggtcttgacatgtcaggattgcctgcacgaagagagctgctggcagcctttctccttg

SEQ ID NO: 218639 - DNA, 451 bp, Homo sapiens
tagccaaggcttccagagtgcaggatggagatgggagtggtgaggggcaaagcccttcaggaaggcccactgcaatcaagcaagtcttggggtccatgttgccaggaagggagcaggcaaaaggccaagcctcactggaatgtagaaggtggtgctgctctccagaagctggggatattcagagaggagtgattgctctctctgccctgggtcttagacctttggaaagacctgatttaagcccttcattatcagggtgaagtttcttgataaaccacacaggtgactccttttctctttacgtgagagatggagagtagcttcccatatagtaaacagtcttcccacacgatcatgagttatgctggaaaggaagcccctcctgacactaaacagggtattgggactgcactcagcattgacctgaatagttcatcttaaagtcccactt

SEQ ID NO: 218640 - DNA, 424 bp, Homo sapiens
agctgttaaaatttaaaaatatatatataataaaataacaaaataatgatgaagccaacacatgttaagaatttatcatatgcaaggcattctgagaaactcatcacaaggattacttcatttaatactcacatagtcctctgaagtagttgctatcattattccagtttgcagatgaagaaatgcaggcacagagaaggaaaatatttggccatgggtcacacagctaatggacttagttctgtataactgcagaactcatactgttagcaactgtggttgtctgtaattaatttaaagatagaataagttaaatctggtattttcatttcatagtgtttaatgtcctaatgattaatttttaagtgtataaattaatgttttattatcttcaaaagcaaataaagcaagcatttttttattg

SEQ ID NO: 218641 - DNA, 431 bp, Homo sapiens
gctgtgccctgccactccagggtacttgccgccactgtagcctgtctcccagaacctgggctactgtgatgttccactagcccaagatttggagtcaccattgtgtggtgccctgttccctggggcctgagttgctgctgcactgacactcctgtgacctaacttgattctctgccccacactctggggcatgagcctctaaagcacctgttaattccctgagccatgtcactactgcactctgccactcaaagtcaaagagctcatgaacaattagaaaacaaaatacaaaatggcagtagtatatcctcacctatccgtaataaccttgaatgtaattggactaaattcaccaatcaaaggacataaagtagctgaatggataatgaaataagatgaaactggaggagccaagatggccgaataggaac

SEQ ID NO: 218642 - DNA, 341 bp, Homo sapiens
cacttagtctcattattcactcattcattcacactcgtctactctctatcactctcctgctcacgcattccctcatcagcacaagctttcccagggagtcagctacaggcacagggcctggcctcactgagggagacagacgaggaccaaatggccgaacagcccccactgagtgagagaagagagaggagcgtggtcccatcaggaacgcaaggcccagggaagccctgtggggtcatctgagccgccacgtccatggggaagggcatggaggcccaggaacagcaggagcgtgggaggagcgttaggaggcagcaggggtggccccagctgggaaagcg

SEQ ID NO: 218643 - DNA, 539 bp, Homo sapiens
atgtatcaataatttgttcatttttattgctgcatagtattccacagtatagatgcaccagtttgtttaaccattcaccttctaagaggcaactgcaatattgacagttttgggatattacaaataaagctgcaatgaacatgtgtgtacaggtttttgttgtaaaaataagttttaatttttctggaataaatgccccaaagtgcaaattactgggccatatgatgtgtatttttaactttataagaaacagtcatattcttccagagtggctgtagcattttctattcccaacaacaatgtatgatctagcttttctgaatcctcacctgcattttgtactgtcactgttgtctattttagccattttgataggtatgtagtgataacatagttttaatttatatttccctaatggctacgcatattgaacacctttccaagtgattattatcacatgtatatattatttggtgaaaagtctgttcatgtcttctgcctactttctagtgatataataaactttattattttttgca

SEQ ID NO: 218644 - DNA, 502 bp, Homo sapiens
tattatgcttctaaatccaccattctgtgtagattccaaattcagagactcctcatcgtttcatattcttctctcaactgaacagccagatttaattactaaaacattttcagaattaagttttgcagtaagcatagatctggttttcttaggcttttcaagtaatttcttcttcacttagcccctcctcttatccctggtattgaaagtgagttttacaggccaggcatggtggctcacacctgtaatcccaatactttgggaggctgcggtgggcggatcacctgaggtcaggcattggagaccagcctgaaaaacgtggtgaaaccccatctctactaaaaatacaaaaattggccagacacggtagcaggtgcctgtaatcccagctacctgggaggctaaggcaggagaaccacttgaatccgggagatggaggtagcagtgagccaaggtcgtgccactgcactccagcctgggcaacagagggaggctctgtctc

SEQ ID NO: 218645 - DNA, 977 bp, Homo sapiens
ggtcctctagcccagttgagccttcagaagacgacatgaggatttgctgcagttctgcccaacatcttgatttcaagctcatgagacagcctaagcccaaaccacccagctaagccattcctagattcctgacccaaagaaactatgtgagattatgtgtctggtattttaagcactaagttctgggataatttgttttgaagcaatagttaagaaatacaatgagataacactaaacgcaatgagagagcactaaacactatacttggtgtagataaggtcatggagccacaggaatgctcattttgtgctagtggaaaaggaaattggaaaaaccattttgcaatgtataaccaggtggcaatatctacagttttaaagctatgcctattatatgatctcacagttccacttctaggtatatagtgcatgatcctgtgcacaggagacatgcacatgaatattcatagcaggaatgtttgtagtagcctcaaattggaaaccatccacatatccatcagtaatggaatggataaataagttttggtagcagttgagccttgaacaacacgagtttaaactatgtgggtccacttaatatgcacattttctgggtccacttatatgcagattttcttctacctctgctacccctgagatggtaagaccatcttccttgatccacttccacagtaaatacattttctctttcttatgattttcttaatatcattttcttttccctaagcttacttgattgtaagtgtacagtatgtgataaaaataacatgcaaaatatgtgttaatcaactgttaatgatcagttaatacttctggtgaacagtaggctgtaagtagttaagttttggggaagtcaaaagcacatgcagatatttgactgtgtggggtgttggtatccctaacctcgtgcattgttcaagggtcaattgtatttgtacaataaaatgttatacagc

SEQ ID NO: 218646 - DNA, 724 bp, Homo sapiens
ctggtgattattttctagcagagcataaaatagtagtaaagactcatatttttagagtaagttttaaaaccaagtgttggctggatctggtggctcacacctgtaatcccaacactttgggaggccaaagcaggaggatcacttgaggccaggagtttgagactagcctgtacaacataccaagatctcatttctacaaaaaaataaataaaaaattagctgagtgctgtggtgcacacctgtagttccagctactacggaggctgggttgggaaaattgcttgagcctgagaggttgaggctgcagttagccataattactccactgcactccagcctaggtgacagaactagaccctgtatcacaaaaacaaacaagaaaacaaacaaaaaacaagcgtaactactgttgcattgccttctctatataagttgtcttgtatataaatcatcttattttatactgcctaatagatcagtgtatgcagtatacgctcaggaaattgattatctaatagtaacattcaaaacatttagggcaactgatagtaatgtggttttggaactaataataacatattgtccctattattttaaaaaattcctttttaagggaagtttggacttttgactttcttcactgtcaaggtgtttgaatgttgttagtctagtgctgtatgtttacgtgtgaggtggtggtatcaccaattgtaaagcaaaatag

SEQ ID NO: 218647 - DNA, 455 bp, Homo sapiens
gtgacacgtcacaggagaggtgggcagggcccggtcatgagaaccaatttggaactgaagaaaacaaatggtaaattcagtgttttccttacagtttatattgcattcccctgtaaacttgaagtgcctcgtttgctgtaaagtaaaaatgcaattcttttcctgtagctggaaatagaatggtattcaggactaagtgatgtgttcggggttgccatgacctgcatcagcgatctaaccaaaaaccaaatctgccaagccactatgtcatggggtgtccttgattatgactgttttagttgtgcagagtatatcagtagtacttggcaaagtttaacttgtttcctgttcattttggtttctctatgttagcctttgttttgataacttttagaccttctacaaatctttcgaattttaacttttgaattttaataaaatgacctaacaacaac

SEQ ID NO: 218648 - DNA, 381 bp, Homo sapiens
aagattgtgccactgcactccagtgtgtgtgacataacaggactccgtctcaaaaaaaaaaaaaaaaaagaaaagaaacacatggaaccaaatcaggatgaaagaaactggaatagcagtttgttataggctgggcttgttggcttgttcctgtaattccagcactttgggaggcccaggcaggaggatcacttgagtctatgagtttaagaccaacctgggcaacaatgccagatcccatctttaaaaatatgaatagcacattaaattcattgattttttttttttaagtcttgctctgttgcccaggcagaggttgcagtgagccgagattgtgccactgcactccagtgtgggtgacagagcaagactgtctcaaaa

SEQ ID NO: 218649 - DNA, 428 bp, Homo sapiens
gctgtaggttatcagaccaggatgaagagggaaagatcaagcaggagtatatcatatctgacccctccttttccatggtgacagtccaaagggaagatagtgggataacctgggaaaccaattcaagtagatcttctactccttgggcttcagaagaaagtcagacttctggtgtgtgtagtcgggaagggtcaactgtgaattctcctcctggaaatgtttcctttattgtggatgaagtgaaaaaggttcggaaaaggactcataagtcaaagcatggttcaccatcattacgccggaaaggcaacagaaaaagaaattcttttgaatcccaagatgttccaacaaacaaaaaaggcagtcctttaacttcagcaagccaggtactaaccacggagaaagagaagtcatatactggcatttatgat

SEQ ID NO: 218650 - DNA, 834 bp, Homo sapiens
tggatctttctctggatccgttaattattctccttccctgaaagtggactcagaagccaaatgactcacacattggggagtcttacagtaagagagtgtttggagcttcggcagagcatatctgtgtcactataaaaacaagaagatgacacatcttgttaatgtggtcagaagtgctacgatggtgtataagtgtgtgtgatgtgtaaaacatatggtttctaaaagattctatgaataactctattttgtcctgtacatctggcaattactaagcatcatctgtgtacctacaacatgcaaagctttttatatacatgctctgtgttaggtgaatgaccatttatctctgttactgggaatacagcctcacctgcagtatacactcaatagatattttctgaatgtataacacacaaatttggaccattgccactatctatgttataggtgggtcaaccaagccatgaagacaatgtgtgttttgcccagtcacacagccggaaagcaccagaaccaagattcagcgaagattttctgaatccaaagtcagcacattgcccaattgtctagtgaaaccaaaatataatgtaggaaaaataatataatgtgaaaattcataatcagtccaagaggattttgaacttgtagaaaagagatgacaagaagttttacctgattcataaatggaaatgagcttgagaaggaagagactcagctgaatacatgagagagaataatacaatttcagagttcataagaaaaagaaaaaagataattgccaataaagaataaaaatatgtaaatttgctgataataaagtcatgcaaacta

SEQ ID NO: 218651 - DNA, 755 bp, Homo sapiens
taatctggctaagttagcatttgaagtctgcaaagctggacttaaagagttcaaattggagctggaattgctctaagcaattccagggccttgcaattttacaattaaggaagacttaaatatatacatagtcagggtggcaaggtaaaaggaggtctgatttcctctgcgatgttcttcagctaagacctaaattctgaaaccgttaaaacctgaagtgcctttaaatatattatttcatcagagccccaggttcattgtgtcacttatcaaggtctgatttagggtcctcaaggactaatcttgttagtgtttaaaagcaactaggttttgtttttggcattttagttccatcttctagattctgttgtcttgcagatagagatcagggagcccagctacacattcattcttctagtcccttgtactcattgtatttccttctgccttagggccttagtttgtgctgttccctgtaccaggaactctctttgctgtttctcggtttcttgctcaaatgtcacttcaaggaaggctttcctgactgacttcttattttttaagttgttacaacattgtgtacctttgttttatagcacttacatttatttctatgaatatttccttaatgcctatattccttcctaaatcgtaagctgcacgagagcaggatcatttgtgtctgccttactaaccttttcatcttgagtgcctggcacagtgcttggtacctggattgatacttaataaatatt

SEQ ID NO: 218652 - DNA, 562 bp, Homo sapiens
ggaaacagcagggaagcctggggagcgccaggtcatgcggcccggagagtgaccttgagaaggtgtcactgccgtccaacacctcagaaagactacatgagaaagacccaaatgaagtcattgtttctggcgacctgtggtccttggcgacctctagaattttgcagtgtttgggctgtgggagactgatggggatattgcatttggttctttcccacaggtggttttagaagccactgtattccagtacgctgttgtgtccttggctgataacacccctcacccccatgcctacaaccgggctgtgtctctgggctccagggaaaaataaaaagggtggtgagaaagagccacttcgtaagaaactctgtatggcattggggtgtgaggttgcgcaactgagaggcctccaagagggtcaccccgtaagtggggagagaagaggggatagaacctgatgttgttgcccagagcaacatggcctcctctcttccctggctgcacacactggaatacacttcccagcctcccttgcagttagatgtggccacgtgactgagtc

SEQ ID NO: 218653 - DNA, 734 bp, Homo sapiens
accgaggccacggagctcgtggaggcaaggccaaggataaggagtagattcccatcaccaagctggggctcctggtcaaggacatgaagatcaagtccctggaggagatctatctcttctccctgcccatcagggaatctgagatcattgactttttcctgggggcctctctcaagcacaaggttttgaagattatgccggtgcagaagcagacccgtgccagccagggcaccaggttcgaggcgtttgttgccatcgaggactacaatggccacgtcggtctgggtgttaaatgctccaaggaggtggccactgccatctgcagggccatcaacatcctggccaaactctcgattgtccccgtgcgcagaggctactgggggaacaagattggcaagccctacgccgtcccttgcaaggtgacaggccactgcggctctgtgctggtgcgcctcgtcgcacccccaggagcacgggcatcgtcttggcacgtgtgcccaagaagctgctcatgatgactggtatcgatgactgctacacctcagccaggggctgcactgccaccctgggcaacttcaccaaggccacctttgatgccatctctaagacctacaactacctgaccccggacctctggaaggagactgtattcaccaagtctccctatcgggaattcactgaccacctcgtcaagacccacactagagtctccgtacagaggacccgggctccag

SEQ ID NO: 218654 - DNA, 449 bp, Homo sapiens
caacccaaatatctatcaactgataaacaaataaaccaaatgtggtgtactcatacaatggaatatcattggcagtgaaaacgaatgaagtatgtactgatacatgctataacatggatgacacttaaaaacatgctaagtgaaagaagccagacacaacgaccatatatgattccacttatataaaatgttcagaataattaaatccacagacaaagattagtggctgcctagggctggtggggagaggcagaatggggaatgactgctaatgggtatgaggtgtctttttttaggatatgaaaatgttctaaaactaggtactagtgatggttatacaattttgtgaatatgctaaaaaccattgaattgtatactttataaaaatggatgaatggaatggtatgtgaatgtatctgaataaaaagtaaagaagaaaaaacatatat

SEQ ID NO: 218655 - DNA, 445 bp, Homo sapiens
ctgcaatcccagcactttgggaggccgaggcagccagatcacctgaggtcaggagttcaagaccagcctgacccatatggcaaaaccccctctctactaaaaatacaaaaattagccaggtgtggtggcaggtgcctgaaatcccagctactcgggaagctgaggcaggagaatcacttgaacccggggggcggagattgcagtgggccaagattacaccactgcactccagcctgggcgacaaagcgactctgtctcagaaaaatacaaaataaaaaaataaagtggaaataacttcctctgcttctaactatgcagtttgcttgaaaaaaaaaaaaaaagtaacctgtaggtgcagtacaactatcagcacaaatgtaattatcttagagtatcttaatagttcctacttcaagtagaacttatgaaggagtttaactgtggt

SEQ ID NO: 218656 - DNA, 577 bp, Homo sapiens
taaccgcccaatttctaatgttacattcaacagtactttaaaccttaatgaagtttctgtgtagattaaataaaatatgcatgtaatgtgcttagtacattaactaccagaatgtcagtacccatatgtagcatcaatattattattatcgttattcatttttttgagacagagtctcactctgttgcccaaactggactgcagtagtgtgatattagctcactgaaaactccacctaccaggctctacagattctcctgcttcagcatccaagtagctgggattacatgtgtgcgccactacagccagctaattttttgtatttttactagagacagggtttcaccacgttggctgagctggtcgcaatctcccggcctaagtgatcctaacgactggactgcccaaatgctgggattacaggcatgagccaccgggcctggccagtattattattactaatacagtaattattgtataaaaattcctgatagatcagtgatgccatcattaaataatcaatgcataaaaacattcaaataaatgatatggacatctttatgcatgcttatgaagt

SEQ ID NO: 218657 - DNA, 607 bp, Homo sapiens
caacaaagctatgacattttgaaagattctgcttactcaagagcagttactaggaataactgatccattttcacatttataactccagccataagcagagcaacctcatgcttccacagcttgcttaaccttacaatattgtctccaaatatagaattaccacgagacatttgaaatactaaacttggctcatgggccccattactctttcagactctttggggtttagggggcataattggactagataacaccttagggtctttttcagctctatcatttagtcatttcagcgtttgatcactggcaacagtatcaattatgcaggcacttatcagagaaagggattggcatctgctctcttgatatgagccatttccctctaaggtcatactgctcctgacagctctcattaaccctgaaagctgcaaaagcagcaaaaggcatggatgtatgcaaagaattaatgtattttaatgctggaagagtctttagaaatcacctggcccaatactctccatggcatccttctccaagtgactcgttcaacatcacacatctgttttggggtagaactactatcctgcctcttgacgcagtcctcttc

SEQ ID NO: 218658 - DNA, 562 bp, Homo sapiens
gaggggaccaatcagaggtactttcatttttcaaccgccaggcagaaaaaggaggggcagcaactgtcgcgcagaaaaagggggtgttgaagagtagcctctgatatccagtgagcatgaaccggccttaggtttcctgcctccagaccctattctcctgcctcatttccccccctgagagacaggatccccgtaagtctttatgtgagacagagggactgatggtcttttttctgtaactgcgtcacactgacttgactgacagtccctgcctattggaatcacagaactctcaccctgctctgtctagtggagacagggtagtttcttgatggccaggggtggtgaattcatttggaactggctggaaaccttactgcacaatcatctccaggcaagaggaaatgaatggttaaaagatttcatgggaacttcaggaggtggacacctatgctgtcaggaatgtttgttatagaaatgaattaaaagattctacttaattactatgaaggaagtgattccaactgtttgaaagaaggtaattaatctgcaaaaaaaaaaa

SEQ ID NO: 218659 - DNA, 489 bp, Homo sapiens
aatagtttccttttatcgagaaactttaaaaatattaaaatgtcatactatagcctaaaaggcaaaaagatggaagtcaagactatttttattcaatgcaaaataatgccaaatgaatttagacttatggagtgatctggagagggaaagtccatatgaaatccatatagttttataattaccttttggaaaagcatttcctctgagacagtttgaaattttgtataaaaacctttttgacagtttgaaggatcattattttaagaaaattgttatacttcactagcattcatttttctctgaagctttactgcctttaattgcacattaaactgtatcaactttaagtatcaaaaggggaagggggaaaacacccatctggagtttgtttctgttggaggcaagatttctaattgcacttggttgtactcttgctaactctattgttcattcaaaggttttctgtttgttaaataaacataatattag

SEQ ID NO: 218660 - DNA, 312 bp, Homo sapiens
tgtttagaggaggagagggctggggtttgagagccagctccgtgttttccaaacggctgcccacttgtctcctgattctttggtgaatgatccatttagcccactgaattgaaatgtcacctcaatcaaatgcaaattttccctaagtcctggaggactctacaggttcatactgaacacatttcttaaagcaatgtttcttttacttagcagataaccagtgaacacaggtaaatggttaaaaaatggttagttgaattttcttgctaatcttgtctttctaagcaaaatctagaaggaattttctttccc

SEQ ID NO: 218661 - DNA, 832 bp, Homo sapiens
ttctactgaattccctcttagagcatcattcagtagtagcttactggtgataaagattactattgatgtctttactattctgggaaagttttaaagtttacaaggagaatgttagaattcagtatataaaccaggaaaaactttactttgttatctgaaaaagacctaagtggatataaggcctcattataccactcaattttcattcacttcgcaaaattgacttttatgaagctaatataatacaaggtgaaaaaaatggtccatgatcctggcagtgttgctatggactaatttccatcactttgagtcatattactataaaagggcagaaaacactgggggaggctcttagcagatttctaactactttgtttactttggttgatagggagtttgctgtcatatttttgaaaggtggtggtggtgggattgtctgctatctcctttctctgccacctcccaggtatataggtgatggttacaatttggaaaatatagaaagaaaaaaaaatatacaccccattaccttgagatacttaacattttagttttcttcttgcttttttctctttcttacatgggtttaaaaatagtttttaaaatattaaatcatataccattattttctcctttttcccccctttaacactgtgttcccttctgtacagttttttttttttttttttttttttggagtactgtttttaagggatagcatcattttgttctttggagctatcccatttaaccagttctctgttgttagacagcaacgtcccccctccaaaacaacttttcctctcaattccaacattatttccttatgata

SEQ ID NO: 218662 - DNA, 753 bp, Homo sapiens
cagcatttcgcaggtgcatagactgcaagccacagtaaggaactgcttggctttctaactttgaatgaaaaactcagagctgataggaaggctgactgtccccagatgcgtggttaatgaggtgcttctaacagagcgacatgttcagtttactggaaggataagaatctcacataaagaacagggcatcctgttcatacaacaacagtataccttcaacaagggaaacgattcttcatgttaccccacacgacaagtctgcaggatcccagaggccaagcctactgtgtaacagctgacaatgccatcaatttctgtggtgtttatggcatgttccagcacatcacacataaggtatcatgtgactagctgaatgtgattttaagagagtgatctccaaacttttcatttgccttaaggatgacgcctctgtgcgaaaacactttaaactctcttttagaatttccttcaaaatctacagcattttttcctgaaaaacccttcacttttaggtcaaagttttattcgcccaactgggtacctaactcccactggtctcagtctccctaagggaaccttcctctacccccacaatcttagctggctcccacaacactctctcaaggcctcatcaactctcccaagtgcaaaaagcaccacaccacctcaatggtttctcaggcttaaaatgtttacttaataaaccagtggattctgcaggccagtgctgcctaacgcagcacccacgagcca

SEQ ID NO: 218663 - DNA, 630 bp, Homo sapiens
taaatctcacttgactttaaaatcattaaggtcaaccatgggacactgctgtatatttcagggcatcctgttcatacaacaacagtataccttcaacaagggaaacgattcttcatgttaccccacacgacaagtctgcaggatcccagaggccaagcctactgtgtaacagctgacaatgccatcaatttctgtggtgtttatggcatgttccagcacatcacacataaggtatcatgtgactagctgaatgtgattttaagagagtgatctccaaacttttcatttgccttaaggatgacgcctctgtgcgaaaacactttaaactctcttttagaatttccttcaaaatctacagcattttttcctgaaaaacccttcacttttaggtcaaagttttattcgcccaactgggtacctaactcccactggtctcagtctccctaagggaaccttcctctacccccacaatcttagctggctcccacaacactctctcaaggcctcatcaactctcccaagtgcaaaaagcaccacaccacctcaatggtttctcaggcttaaaatgtttacttaataaaccagtggattctgcaggccagtgctgcctaacgcagcacccacgagcca

SEQ ID NO: 218664 - DNA, 366 bp, Homo sapiens
cagcatttcgcaggtgcatagactgcaagccacagtaaggaactgcttggctttctaactttgaatgaaaaactcagagctgataggaaggctgactgtccccagatgcgtggttaatgaggtgcttctaacagagcgacatgttcagtttactggaaggataagaatctcacataaagaacaggtattcttttccaattttagaatacaactaaatgtggtttatatctagctactgcatgtcagtgtcttctcattttactgacaagacctccaatttccatggtgtatatatggtgtattctagcactgttcaatttactctcagtgaactgccaatattttatataaaatatttccttgtca

SEQ ID NO: 218665 - DNA, 388 bp, Homo sapiens
cattgtgtagcaagatactttatacattaatcagttatataaataagacttgtattatcttccttagagctaaagaaaacatgccaagtgccaaaataagtgctctaaaagctttcattcaagactggacaccatggctcatgcctataacccgagcactttggaggccaagctgggaggatcacttgagccaggagttcaagaccagcctgagcaacatagggagaccccatatctacaaaaaattttttaaaaaatcagccaggttggccgggcgcggtggctcacgcctataatcccagcactttgggagtccgagacgggcggatcacgaggtcaggagatcgagaccaatcctggctaacacggtgaaaccctatctctacta

SEQ ID NO: 218666 - DNA, 411 bp, Homo sapiens
agtatttccaactccgagtcaggtcctctttgcactgctttttcctgtttcattgcaatttattgattttattgtggttttttgtttatttggggcaagaacggagatgtgaaccaggacgagccagcagacccccgagccagtatctcctccctgggcagggaacaccgcctgcaccggtgcatactaggagaccctggcggagaatgtaaacaaaccgggcgccgagcccttgatctttatttaaatagaggcttgtttatcggtgtcatcctaggaggattaattagatacatctcttcacaatttggtgtctgacactccatcttaggaatgccttatcataaggtgttaattggggccactcagccacttacgtttctattaaacactgtgagggacttttcacaa

SEQ ID NO: 218667 - DNA, 630 bp, Homo sapiens
tgtttgtcattcaaaatagctgaggtggttgggagaggacagccagtattccccaaatgtaatcaggttccaatgaatatacagttaccatttattcctcttctttccccactgtgaatcctaacagctcctcctcaccaagcagtgagtacacccttggattccccaaacgattgctgattatgggtctagagagtcaatgatggctggcgagttaggtcactgagtctttgaaatgatgttttctgggaaatgcctgaaaggttgatggtacaatagtagataaaaataaactcaagattagtgtctggttgcatagaaagtcttggtgatggtgagtaatcaggaggacaaaaatcagaacaagtcatccaggctcctcacttagcaattcttttcataaggcaagcaggaggagagaaaaaaaatcccctaaataacagtagtcactaaaaaaagcattaagtgcttctttttggtagagtttatccctctccaaggatgtattttcctgtaacttttcctataggtggattttgaaatggagactattaaataaatacaacagccatactgcatatgatgctttcagatgcaagtaaaagaaaacccaactgaagatggcctacc

SEQ ID NO: 218668 - DNA, 650 bp, Homo sapiens
cagcttgttgagaggcagtggaagggggaagggccatagcctcaatgatagatgtggaagacactatagcatagcctgcctttgccagtgattggtgattgggcctggaagaactaccatcaataaaccaagtgtggtctgggtggggaacaggaaacagggaaatatggggaaatggggagaatgtcatatggattagagagatacaatcatggggttcagatgtagtatcaggaataagatgagaggccggattgaagtctgggccaggaacaatggtaattgtgggaaattcaacgaatggtgagtacagttgaaggagccagggggcagaaagtatatgtgtcaagtgtgaggaacaaaatagatattgaaagttatgggaactgtagagagtaaatggagcatagcttgtggttttgagggcctctaaaagtattaaagtggtggcagccaccacatggagacatgagggcaagcctaaaacagtaaggtcaagttgtttggacagaaaggctacagggcgtggtcccagctcttgtgtaagaattccaaccacacagttctgtacattggctgtgtgtaatgaaaagggttgggatgagttagggagagctagtgtgggagcagcttccagggctgtttttaag

SEQ ID NO: 218669 - DNA, 444 bp, Homo sapiens
agctgtcccagccaccagccctgtgacatcgtagcccagagatgggctagtcagcaagcagcaccccctcccctcccaggggtccacaaagaacgccccctcccttcccagccctcacactagcagctgaggctgggtcacccctcctgctttcccacaatagagctttctatgtacagccacgtctacacaggcactgcttccccccagccctcctccccggcacctccccgtgggggtctggaccccccctcctccccggcttggaggcagacacagggtcccttgcaagacacgacccagcaccaaccacggaacagctccaaggcccctgggcccctctccggcctggggctgggagctacgcgcgagggcccccgcgggcccccggggcgcgcaccctgggtgcgggcccgcgcgggaggggcggtgccaggccctgcg

SEQ ID NO: 218670 - DNA, 331 bp, Homo sapiens
agacatgatggaaatctcctaggcccagccttcaaggagatgtggctttgtcagtgagccaaggctcagttggaaatggtcaaggtacattcatctggagtcactggggagctgggcctcagaggatgcacaggctggaggtgggcaaagggaagacacttctggtgaaggcaggggcctgtgccaagacccggaaacaggactgcttctgggagctctgggacctgacccagaagtttcgcgggtagtttgaggtgagcttggaaagatcaggcagggtcttggatgccaggccaggagcctggacttgtttggggcagggatgtgatta

SEQ ID NO: 218671 - DNA, 436 bp, Homo sapiens
aaatatatcagttatatcttttttcattatgatcttgatattttctatatctttactgactttttctgttcatttattagctactaatagaagtgtgttagaaaacttccattattatatatgcgtgtgtgtttatgtaatatgtgtattttccttttgttactgtcagatttactttatatattttcagatgatgttaatcagagcatagatttagagtaattgtatcttcttaattaatgaaatattccatttatctttagtaatgtttcttaaaatttaaattgtcttattgcagctacatcagatttcttttagttagtgtttgtagcatatcttttttcgcttttacgttcacttctgaatacatgtatctctaggtgtatctcttgaaaacatttgatatttttattcaaataaatcatctttgacttgt

SEQ ID NO: 218672 - DNA, 216 bp, Homo sapiens
aatacaaatagtacagtataatgactatttacatatcatttacattgtactaggcattataattaacctagagatgatctaaagtatacgagatgggaccaggcgcagtggctcacacctgtaatcccaacactttgggaggccgaggcaggcagatcaactgaggtcaagagttcaagaccagtctggccaacatggtgaaaccccatctctact

SEQ ID NO: 218673 - DNA, 1792 bp, Homo sapiens
  misc_feature (146)..(146): n is a, c, g, or t
  misc_feature (445)..(445): n is a, c, g, or t
  misc_feature (605)..(605): n is a, c, g, or t
  misc_feature (1581)..(1581): n is a, c, g, or t
taagatgattaagataataaataattgttaattgaattaataccctgttcagatttagtctctaggttagccagacattttgtgaataaatacgattctttaaattatttttattaggaacattcctttgtgtagttatcccaacnttgaccttctgttgaccttataaattccatatcttgttctaataaattatttgcatgagattatccctaggactttccagagcattattgtccaatagaactttttatgatgctgtccaatatggtagacatctgtgattattgcgcacttgaaatgtagcaggtgtgactttgagagacaacatttttaacatatttgaatagccattgtggctagtggtgaccttattaaacagtacagctccagagagcaaaagcaagatgagtccagaaactaacagtaccctcccgcctgcccntgcccccacccccaaagccacccagctttggagcttacctagagaggacagtaacagtgtaaaagatctgtgtggactcaaagtgaaatcattcccaattaatttatacattctaaaaaatagagaacatttattaaatctcaatcgcagctcactgcancctctgtctcctgggttcaagcatttctcttgcctcagcctcctgagtagctgggactgggactacaggcgcccgccaccacgcctgaccaaattttgtgtttttagtagcgacagggtttcatcatgttggacatactggtcctcaggtgatccactctccttggcctcccaaagtgctgaaattacagatgtgagccaccacacccagccttaagtctcttaaattgtgaataaaatgtaaatcttaaaaacaaaacttgagaaaggttcttggattctttggtggggttttttgttgttgttgttcgtttgtttgttttttggggtggatgctatctagctcttgtgtgtaatgtacatgagagtctcaaatgttgtactttaagtccttaggttgtatgttgaatttaaactgttacttgttacaaagcccttacctttaccttatgccttcaaaagctcatatttaaataaaatggctctcaaagtaacctaccttttgcacgttttttgcccaccttgattgtacatgtcagtcaagcaaactaaaagtgcttatttatataaagtatatgtacatccctgtgactgtccttaaatgcttattagatcattgaattgctgaatatagaataacaaatatggaagacaaaaaattttaatttgcttatttttattaatcatgtttaagagtttgaaagactgcaagagtaagtttgtaaaagaaatcaaagactttgttgttcattatagactggctatctccctatagtagccagagtttgctttttattagtttaagcccctaggcactgtagtatgttattcagcaatgtttatttttaattttttagggggaagctaaagagctactcaaaattcttgctaggttactgtttctaggtcagaaaggttatttttgtttgtttgtttcagacttgcaccataatgtgatttgagtaggtctttttttnttaacgtgtatatattttaaatcaatttttaatttttggaaagccaatacatccacatggtttaaaaatcccacagtgtgcaggcacctgtagtcccagctaccaggaggctgaggcaggagaatggcatgaacccaggaggcggagcttgcagtgagccaagattgtgccactgtactccagcctgggcgagagaatgagactccatctc

SEQ ID NO: 218674 - DNA, 677 bp, Homo sapiens
atgtgtcagatttttttgtgtaaagttccttatgtctaaaatattttgtacatatgaagtggttttagattccagatgtaattatattctgttgagtagctggtagcactgtcactcagtaaatgcacagtgctgtatatgacaacatcacatttttcaaaccaaactgttgtgtcattaattgagggttattgttcttctgaggggtgtgaaaggagaggggaaatacatggttctttagctgataattgtccatggtcaatgaagtaaaaccatgtttgtgcagacaaaaatgtatggtttcagttgacgtgtatgcttatttaaaaatacttctgttagatctctgctcctttatgaaaaacctaggcctctccaagagcacttaaaaaaaatcctacttggaatcataacttttattattcatttttgaacattatcttttgataccattacttttgctcttaagtgaaatttcgccaatattatatttaaatttgctaatgcataaatggatgcaccaaactgggtgtccaaactgggaagttcagttgcaatggataaagagttatttggaaaagtaattaccagataattttacatctaattaaccatgtatgtttatgtaaacataagtacattatatattgatcttgaaacaaactttcatgatatct

SEQ ID NO: 218675 - DNA, 267 bp, Homo sapiens
ttacaaattagggtttcttttttgaaaacaaatccagcaattcccttggccaggggcggtggctcacgcatgtaatcccagcacgttgggaggctgaagggggcggattacttcaggtcagcagttcgagaccagcctgggtgagagtgtggacagaggcgggctcacccaagggaagcgtggaccaagttgggctcgccccgggagagtgagcaggcagaagggcgccgcctgggtcctcgggaccccggagcctcaagacctgcg

SEQ ID NO: 218676 - DNA, 824 bp, Homo sapiens
tgtttttaaattataaaagaaatacatgcttatgtgataacaaatgaaacaaatacgaaagcattttaaaaagttaatctttttcctacttcacccctccccagttctacccatctctacctccaatcagccaattcatgtttattgtattttcagaaggctgctgagaaacttttgggatgatgagtatgttcattatctgattatatgattgtttcacagatatatgcatatgttaaatatcaaattttacactttaaatatgtacatttaattgtatataaattatatctcagtaaagctgggtgttttcagatgtccaaacttgttaggtatttcttttggtctaggggtgcagtgaagaaattactaagacaccaagggcattgtgaaccaagaagttttgggaacttatgacctagtgaatatctttccataactttttttaaattaattttttatttacatatagtgaaattcactctttcttgtggccagttctcggaactttgataaatgtgtatagtcacgtcttccgcaccacagtcaggatatagaacagtttcttttggttttgtttgtttgtttgtttgtttgtttttgagacggagtctctgttgcctggctggagtgcagtggcaccatatcagctcactgcaacctccgcctcctgtgttcaagtgattcttctgcctcagcctcccgagtagaagaacagtttcttcagcctccggacctgggattacagggattcgctaccatacctgtccactttaccttaatacttccttcttttccctatcctttcttttttttttggggcc

SEQ ID NO: 218677 - DNA, 321 bp, Homo sapiens
gaagccagtcatagatcatggcaatataagggccccttttgataatcttcaggatacatttgcttatagcattgctaaaatacagatttagcactctgtatttgaatattctttaaacagaaaagccccattattttcaaatttttgacttactaattttcataaatacaaatgaagatgtccctcagggtagcagcatgcctgctcccctctaccatgggttggagggtggtcatttgtgagacgtcactttgggcatattccagggcaagttggggaggcggaggggctttgaacagtgtttaggaacttaaacctgtt

SEQ ID NO: 218678 - DNA, 351 bp, Homo sapiens
ggttctgttgcccactggatttcttctgtacattcactcagatttcgtgcctgttactgtcagtttcttaggacttcagtgcgatctttttagaattaccaaaatattaccaagagtttatataatacctcgttcagaagagtcatattttattctcagataaaaatcagtgctatccaaatggaagggatttaaagtacttaacctgcatagaaagctggcttgtctaagaactcttgaaaagttcagtgattttgcccttttgtaattattaaaacataaggcaatgtgccgtgctctagcatagcacagtggtctctctctaatggattttatggccttaacctcttt

SEQ ID NO: 218679 - DNA, 518 bp, Homo sapiens
tgtagatgacaggttgatgggtgcagcaaactaccgtggcacatgtatacctatgtaacaaacctgcgtgttctgcacatgtatcccagaacttaaagtataatttaaaactaaaataaattaattatttaaaaatttaaaaataaataaaaatagtggcttggtgcagtggctcaagcctacaatcctagggctttgggaggccaaggcaggaggattgcttgagcccagggatttgaagctgcagtgagctatgatcacaccactgcactccagcctgggtaatagagtgaggccctgtctcaaaaaaaaaattaaataaacattaaaatatcactttttctttaaaaaaaagaaaaagaaaccaaaatactaacttattgcttttaaatcattttgttataaaatataacacttagaaaatgcataaaacatacagtttacctagtagtcataaagtaaatagacaactaaacactacccaggagaagaaatagaacaatgccagcacactagtg

SEQ ID NO: 218680 - DNA, 414 bp, Homo sapiens
tctaaataagtttttgaaaccttccccccacctttagtgagtggtatgttttttatatttagaaacaatctccctcctccacaaacatgcaacattcttacacaataatgtggtataagaaaaaatagcattgctgcttatactgccgggattttttcccccccataagcttcttgatttaattcttttcttataaataatttagtctggaacaagatagggagttaatgacttaagtgctgctgatactgaaataagttaatatttattttaaatataatttggaggccaggtgcggtggctcacacctgtaatcccagcactttgggaagctgaggcaggtggagtgcttgagtccaggagtttgagaccagcctgggcaaaatggcaaaatcctgtctcttaaaaaaaaaa

SEQ ID NO: 218681 - DNA, 396 bp, Homo sapiens
taacacttttctgcagtctttgatatcatcttcctgtcaaatcacagaaatcaagggactgggctgcaaagcgggacactcgtgtgctaatttccatgtcattgctttgaatggttttctagcatggagagctgttacctgacttctggagacatactaaagtgctgagacccattgtagatggcctaaaaattcacttctcaatgttcataagccagaattatagaatgcactgccatatggcttttttttcaaataaatattgttctgtttgagctctgttatgtcactggaagtcacaataaatcacacacctagtatgctttctaatgaatgcttgttgttcaaaattcccaatacctgaaggaaagaaccttctgtccccaaagtctgtga

SEQ ID NO: 218682 - DNA, 210 bp, Homo sapiens
ctgctaaacatcttccaaagcacaggcagcccgcacaacaaataattatctggccccaaatgtcaatagtgctgaggctgagaaaccctgacttgcagagaactcagccaccctggctaaggaattcacactcttttttttttttttttttttttgaaaaaggcaaaaagtgagggggggcacccccgccccaggggcccctcatccctc

SEQ ID NO: 218683 - DNA, 463 bp, Homo sapiens
ggccggcgcggcgctggaaggcgccggcgttaaccccgcgaggcaggcgacggagggggagcggcgctaatacataagagcactgcatcacgctaatcttctcccagaacagtatgcgtcagcagtacattcacgttctgactgaaggacaaaaggatgagagagcagtctgcgtggctgccgcctgcaacaccgcgagcccggcgcgaggaggagacggtgggcgccgcgcgcaggggccccgctgctgctgctgccgccgctagccagcggggactatgttcctgggctccggagcgtttcccgcagccgcgacccccgctgctcacgccgctgcagcagtccgctggcggcgcggccactgagggcgccgggagccgaagccgcgaactcgctccctccgcacaaagccggagccggcggcgcgccgggggccgggcagcggcgggcggcgacgggcggt

SEQ ID NO: 218684 - DNA, 163 bp, Homo sapiens
gctcagttaataaactagctaaaaatctagcagttactatatattttgctctaaaatatctttattctaggacaagtgcactcattaagaagttttaatgaaaattacagtgtccatttgattaatgtgttataagttttagagacccttctacgtgatagtc

SEQ ID NO: 218685 - DNA, 726 bp, Homo sapiens
caattaaaaactgtacatcaaaggacaaaaatcaacagagtgaaaagtcaacccatagaagatatttataaatcagatatctggtaagcagttaatatctagactatctgaagatctactataaaaaaaaaacactgaaaatcacacaagtgttggtgaggatgtagagaatcggaacctttgtgtaccgttgatgggaatgtaaaacagtgcagctgctatggaaaatagtatggaggttcctcaaaaaattaaagataaaattagcatatgatacagcagtcccacttctgagaatatatccaaaagaattcaaaataggatcttaaagagatatttgcacaatcatgttcattgtagcattattcacaatagccaagaggtggaagcaacctaatgtcggtagaccaataaatggataaagaaaatatggtgaactgccagtcgtggtggctcacacctgtagtcccagaactttgggaaactgaggcaggaagatcacttgagttcaggagttcaagaccagcctgcacaacgtagtgagatctcgtctctataaaaagtaaaattacccaggcatggtggcatgcacttgtagtcccagctactgaggaggctggggcaggaggatcgcttgagcccaggaggttgcagtgagctgagattatgccactgcactctagcctgggtgacagagtgagaccctgtctcaaaaaaacctcaaaa

SEQ ID NO: 218686 - DNA, 772 bp, Homo sapiens
  misc_feature (605)..(605): n is a, c, g, or t
aaactatgtgtagcacaactagcagaaaaccgtctggtcggccatccgggagaaagcgcggatcagaaacaagcgacttcgatgcagggaaccgcgcagccactgaagaaagtgacccacgtggcagtggtgccagcgaaacactgcagtttggacggcagctgtggggatgccacagagaaacatgcactgccactgaagtacatccagctccgcggagctagtgttcatatgatcaagaaaccgccagttgggctctgctagaaacttttagtcctcccttaacggctatcctacccacaacagacaatgcctttacccagcacctagcggtgctgagacccgcctgggccagcacagagcgcagagcagtacgggtacggagaaacgccggactcagtgaaaccagccttgcctccagcggattccccggcttcgccggacgccacaggcagagtgccgcggggaaacctctggctccctaaaccgattagattgtgggagtgggggggacactcacaagttgtgtggaagggaaccagcggcaatgggacccggcgagcacttgcccgcagcaaatgcctgcgctgctgcaaaaaaaaacngaaggggtgcctgtcgggcgcctgggaccgagcgatttatatcgagcatcttatacatgaggcgaatttgagctactaggcaattctcctatagtgggtgtattacaattatggccgcgttttccgtgggactggccctgggttcccacttataggcttgggacatc

SEQ ID NO: 218687 - DNA, 354 bp, Homo sapiens
agcgcctagctaagccgccgcgtctgtggttgttcctctccacaccgggtcttagacctgggttgctaagagctggcccaccgagccctgctccgctccagctccctggaggcgtctagtgcaggagggtgaagtactgcttgaggagaaggctttgaccaaatgggatctcttaccccagttgcttgaggctgagcgtctcctaacctggacgcttttggatctgcagactttgcccacaggagtttcctaggtgtagagaccaaagcttgcaggccagcgagaggtcccgagatcttgcattcccacccctcgccccaagctggggcacttttggggggctgcagcggccgc

SEQ ID NO: 218688 - DNA, 286 bp, Homo sapiens
ctatgaagacaagtaagaggacacatgtaaagcactcagcactggaccaagaaaaggctccataaatgttagggacacaggtgtctggggctctgagagcacttggttatgcggcggtctcactgcactccaccagccttgtgagatgggtaagaaagcactcggaggcttcagaagccttttcccttctaaactattcagatcatcttagcaattcaaggaacagctggtcttgagagatgagactcgcccacatcccctggaacccgttggacccaagcagcac

SEQ ID NO: 218689 - DNA, 417 bp, Homo sapiens
tgtggtggctcatgcctgtaatcccagcactttgggaggctaggtgggtggatcacttggggtcaagagttccagatcagcctgaccaacatagtgaaactccatctctactaaaaatacaaaactagccgggcatggtggcatgtgcctgtaatcccagttactcgggaggctgaggcaggataatcgcttgaacccgggaggcagagggtgcagtgagccaagatcatgccaccgcaccccagcctgggcgacagagcgagaccccatctcaaaacaaaacaaaaaacccccatatatgtattacctttgtttcctaaaccataagctataaacatcatggaccattctccataaaaacttgggtatgtatttcctaagaataaaaatattctcttacataacctgaagacagtt

SEQ ID NO: 218690 - DNA, 491 bp, Homo sapiens
gtcacagagacagacaaatgctcttagatgtttgggtttttttttgtttttgttttgatttgcttgtctttttgtatgggttggtaggtaggttggctcagtttggtttggcttgctttggcggcaagacacatccacatttctaaattaaccctgacctcatttgcaattcctgcttttctctgatatttctacatgactattgagctttgccatgacaggcctacaagtgctcctgacttgctcattgttgtctagtgtactattcattctacctataacacttagaactgaagttgagagttatggacgacttctggtttcataggagatagtttcttttctgttttcttttctccctccttgttgatttgaggtgttttcagagataagatctgtgatgagatgtctttaatttaattattattattatccttaattaattatcacctagttgctatttatcctaaaatttgatctcattatgcaaa

SEQ ID NO: 218691 - DNA, 573 bp, Homo sapiens
ctataaatcatctataaatgctgaaagtaacaaaggatgcagcttatgttttctccattttctttataagttttgtttgcatctaatttatttccaggtacccctatgatgtaaattaccatccagtcttcacctactaccagaaattgaacttttttatttcttctgaaagtttaaagagttctaatatggctctgtattttttttagctaaaatgtcatagtgaatttctttaaacggtggttattgttgactcagtgtttatctctttttcacaaagggtttgccagtgtctttctttgacaaacatgtgttgttactattatgtgctcactgggatagtgagcaaaaatagacataggtcttgatctcccggaacttatatctaaagatagaaaaggatattaatgaaataatcatacaaataaatgcaaagttggaactgtttcagttgctgtagagaggtacgtaatatgagggcttttagaaggagaatttactcagtgcgatcaagaggaatttttttttggaggaagtgtttatttagctgagatctcaagtaagttaatttga

SEQ ID NO: 218692 - DNA, 472 bp, Homo sapiens
caatatttgttttatttttattttttaaagacctatgaagtagatgataaaagtgtaggttctggagctagattctgtaagttcaataccttgtattgccatatactagctgaatgatcatggggaagtttcttaatccttatgatgtggattgtctcatttgtaaaatggcaaataacaggccaggcatggtggctcatgcctgtaatcccagcattttgggaggctgagatgggcggatcatatgaggtcaggaattcaagaccagcctggacaacgtggtgaaaccccgtctctactaaaaatattacaaaaattagccaggcatggtggcaggagcctgtaatcccagctactcaggatgctgaggcaggagaattgcttgaacccacaaggcagaggttgcagtgagccaagatcatgccactgcactccagcctgagttacagagagagacgagactagttcacca

SEQ ID NO: 218693 - DNA, 528 bp, Homo sapiens
catgacaaccaaagaagagttattctttcttataacaaatacagaagacagaatatttttgacaagcttggctagcctttttccagggttttctatgtgacgctagccagatcagaaagaaatctaagtaacatgctgaagtggaagcttggcagactggaaattttatatgatgtttttcagtgctagaattaaatctattatgtgaaccattatggaaggtctgcttcaggaagcccagctgattatattagggtcagtgaacacatcagggaatatttatatcttgttttcagaaggtgtattatggtcactttgccattcattgattatgattatttaaattggcttcaaatgacttgtttcttagatcatagtccactcttttgtggaacagatgggaaggattatcaaacccttggaagaaggttcagttaaaaaccagtagtcaaaatgcatatattacttactatgtattagaattaattctgctgttacctatttctatatcataaaggccctattata

SEQ ID NO: 218694 - DNA, 258 bp, Homo sapiens
tagttttgatcctaaagcctcagagaaagtctgtctgtgacccgctccagagctgcctcactttctgacatgagcggtgctcttggacagccggcaacgaagccacgcttgtgaaggacgcagcggttctcacctgtggcacccggggcaccagtggctggccactgccctacactctaaagagggaaactaaactttggactgagaattatatatttaagaaagccttcagaaataatacatttacattatacatga

SEQ ID NO: 218695 - DNA, 371 bp, Homo sapiens
cactccatcctgggtgacagagaaagaccctggacaacacactggacagatttagcatcttctgcacaagtttaaacagttgagtaagggaaaagtaggattggaacccgtgctgttcctgattttaggacactagtcttagccccttccttaaacagattaacttaggtgggccacttgttatgcaaggaaaacttcagttactttgactggtgatttaataaaactcgacatcatgaagattccaatttacctgccttcccttagaatctctggtaaccatatgaaggtgcaaatcattcattcccacgttcacaagcccttcattagctgactaggccatggaaagaagggacttagaaatgattaac

SEQ ID NO: 218696 - DNA, 450 bp, Homo sapiens
atcatgggcagataacttcatctcagaccttctgcttgcttctctgtaagcctggagagaactacctgtcttctcatcaagttgtttttattggagttagtgtagcgaaaactctcaaaccgtgtttttttctactctcacaccaccacaaaaatcatcatcaatacagaagaagacttctgtgaccaaaggtatgggggtttttccctacacaccaagcagtgcacatcagctgggtattctccagttcaattctggcactgtctacctggagaatttaagaacatgccaacctatccttaagataccagtcacaagtccgggccaccccatccttcagacaccagttgcaaatctgggcctctggaacttctgaccaactggtttcaagttgggttcctctttgggcccacttcctctttgggctcaattaatttgctggagtggtgc

SEQ ID NO: 218697 - DNA, 494 bp, Homo sapiens
caaatgttcatagcaacactattcacagcagctaaaacgtggaaacaatacaaacatctatcaatgatgaatgggtaaataaaatgtggtcttacccatacaatagaacattcttcaataataaaaagaatgatatatgaatacacattacaatatggatgaacctccaaaatgtactaattgagagaagacagtcacaaaaactacatattttatgattccatatttatgaagtgtccagaagaggcaaatccatagacacagaaagtagtttcctggttacctagggctggaaacactttggggaagtggaggaggggtgtgattgctaaagggtataggtttcttttgagatgctgaaaatattctgaaattaattgtggtgacagtcgcacaattttgcaaatatactgaaaatcattaaattatgctaaaaatgggtgagctgtatggtatgtaaattagatctcaataaagctgttacaaagaaacaa

SEQ ID NO: 218698 - DNA, 405 bp, Homo sapiens
tccactgcccctccctcacgaaggccaggttgacatcccaccgtccctgggaggtgggagaaggtcccagcctgtgccagctgagattcactcccaggttcaagttggcctcttttggccaggcgggaaggctcatgcctgtaatcccagcactttgggaggccaaggtggatggatcacgtgcggtcaggagttcgagaccagcctggcccacatggtgaagtcccgtctctactaaaaatacaaaaaaaaaaaaatcagccgggcatggtggtgcatgcctgtaatcccagctactcgggatgctgaggcaggagaatctcttgaacccgggaggtggaggttgcaatgtgttgagattgcaccattgcactccagcctgagcaacaagagagaaactatctg

SEQ ID NO: 218699 - DNA, 642 bp, Homo sapiens
acccggcctatccccatcttaaaaaggaggcagctaagtgctcagagaagtcatattacaagtctagggcagagcggggactatattctggcttcctgactctgagttcagtaacctttctagaatactgccctccctaaacctacactgctgcagcctggaggttccacaagccctttctcatagaccccagcaaggtgctttctccctggaccccactcagcacctatttctggacctttattggcaggtgggtcagagaggacacctgtgtgatcagagaaacaaagtctggtgagaggagcaagtgcagttatgcacagggagcagctggtccctcagaccttgccagccacttctgcggtggttgtcggtcttggaaaagctccatcttcagaggggtttgtgcccagcagctgatctctgcctgtaatcttcagagggcaccagttcttaccagacaatagctgtctatgacctcaagccaggcctaggacaaagtggagacgtcctgtgaggcaggcaggcctctgtctcagcatcaccaatagctcaccctcctgtccactcacattgtggcgcccccgacccttgccaatcccgtgcaaaccacgcaatgtctgccagcgctcactgccttcc

SEQ ID NO: 218700 - DNA, 443 bp, Homo sapiens
agctccagccacaccagccttctctcaccccttcaccccatctcactccctgctgccacaggggctttgcatgtgctgctgctggatctgttggaacactcttctctcttctcctagtttacctttagctttcagctgtgggttactttctaactaagttaaatcccccattaatgagccctctttatcataccattgatctctcctttgtggcacttctcacacatgaagtttttcagtccctaccactagactgaaagccctatgagggcagacagtgtctgtttttgcttcccattgactcctaggacttgtacctaatagtcttaagggcagactgtgtactgggcacatagtaggtgctcagtaaatatctgctgtgtgaatgaatgaaaaacacaaattacatttttaaaaaacactagagggagagcttggctgga

SEQ ID NO: 218701 - DNA, 426 bp, Homo sapiens
agtactatgttgaagaggaacggtgagagtaggcatcctggtcttgttcccgttctcagagggaatgctttcaacttttccccattcggtattatattggctgtgggtttgtcacagatggcttttattacattaagagaagacagctataactccaaaagtgagagaaagtagaagacatgccagtgctcaaaagctacaaatgtaaccagagccgtggcataaaatgaaatacttctggttcatatacttccactgagcagcattgcattttatacacttcttctttaatggttcagacatatagttcttaacatcacatggagactcataaccttcagaatacagcatgaatcagctggctgcactgcaaagagaatacaaaataccatcaagaatgtcctaactggaacagtaaacttttaa

SEQ ID NO: 218702 - DNA, 675 bp, Homo sapiens
gccgcggctggacatgcacacccagtgccggctccgggcgcgcacacatgcaggtagccacactcacctgagccggtgcagagggcggcctgggctgggaaggggccccctgcgccgcgggagtggggagagcgggaggtgccacagcgcggacctgcgaactgaggtgatggcccgttttccttaactctcctgcagcacctccgcccctgcgccggctcggctctggccacagcagcgaggacagaggggccccgggcgcggcggactcgcgggcgcacgctcccaggagcgcgccgagaggggcgccgcggcgcaggaaacttgggcgaagttagttgcaagtgccaggcggctgccgagaagagcgaggcggggacgcggccggtgccaggcctgcggcgccgcgtggaggctgcgctgccctccgcggccggcgagctccgggagccctaagtcggcaggcgcgcctgaaggggctcggagcgaacagagccggcatggcccaggggacggccggacgcggctcctcggcgagccgggagaacttcctctgaggccgggcgacccacgcttgctcaagcctcatccaccctccttcctcgccccacccgtcagtccagcagcgggagaggaagactcgagaggcaggtgctgcgggggacagctcccccc

SEQ ID NO: 218703 - DNA, 1222 bp, Homo sapiens
agcgggaggggcgtctctgcccggccgcccatcgtctgagatgtggggagcccctctgccccgccgccctgtctgggatgtgaggagcgcctctgcccggccgcgaccccgtctgggaactgatgagtgtctctgcccgatcgccaccccatctgggagaggaaaggccatgtaaggacagagcaaacaggcaactgtctgcaaaccaggaagagaggcctcaccagatatcaaccttcatggcaccttgatcttgatctttccagactgtgagaaaattaacttctgttgttgtttaagctgcactccaactccgtctgtagtattttgttacggcagcccaaacagactaatacatcaagtaaccacacaaatgcatgtacaattaaaactgacctaactgttaagaagaggagatagggcaagagtatatttatcgagggtattctatctggtcagagatgagagagaaagatttttctgggtaaagttaacaaggtatatagggtggggtgaatatggagtggggaatggtcccagatagggccaattgcttgtgcaaaggccctggggtgagacagagcacagtttattagagaaaccaagtggcagctgtgtgattggggtgctaagagtgaagaggaaggtgatacaggtgagggtggagaagagggtgaggcctaacttcccaggaccatgcaggattttcactgctaacttgggccacttgcacaccagactggagctggaaatggtgggtatgggagacagagatcaaaataacctctagatgtccacttgcatagctggtaggtcacgggaccattcatgatagggaagcccaggagagaaccagatttcaaagagaaagtcatgaatttgcacgtgtcaagcttgttgtgcttttgagtcacttagaaagagacatttgtttgcggacctatctacaagtctagactcagacagagacctgagtcatgtcattacactgacaaggtgggagaggtgattcaggacagtcattctcagactttgagtttcaagacccctttacactcttaaaaaccatcaaggacctcaaagagcttctgtttatgtgggttatatctgtccatatttactgtattagaaatgtaaactgaaatattaatattaatttataataaacctgttttaccttaacataaaaaaaagaaataaaacatgcaaaaataaaaaacta

SEQ ID NO: 218704 - DNA, 591 bp, Homo sapiens
ggcaaacatggtaaaaccctgtctctactaaaaatgcaaaaatcagctgggtatggtggcgggcatctgtaatccccgctactccgaaggctgttgcacagagaaatgcttgtaacccgaaagttgggggttccaatgaaccgagatcgaggcactgcaatcccgcctgggtgacagagcgagactccatctccaaaaaaaaaaaaaaaaaaggtacagatccccacaccccacaaccaagtttctgattcaggaagtctagggtggggcctggaatcttcatctctaacaagctcccaggcaatgatgatgctgccggctgagaaccactgcttgacccaatctccatccaatcattagcccttttggagcctctccgcctttctcatctgtgaaatagaaacaaaacagctgccccaccgctgtcactggagggattaaagagaacatccacaaagcacctggcacagagctcacaaagtacacaaggcacttagcacgtactcaaaaaacagaaggctctattattagtcacgttacaatggaggtgtcggtgtgctgtacgcgtgcaaccctgcactggcccaacct

SEQ ID NO: 218705 - DNA, 428 bp, Homo sapiens
aatataaattaagaaatctatgctggcttcaatgtataatttatttgctacattggggatatactagtcctcagtaatacacgtttctagctttacaggaccctggaagactctatgcttttcctctccttgaggtaattataatcttccctgttccccatcccctgtgaataactcagaagtatctatttagatcctttgctcatgttgaattgggttatttgggttatttttcccattgagttgtgtgagttccgtatgtattttaaataagaacccattaccagatataagatttgcaaatattttcttccatttcataggttgtcttttcatttagttgattgtttccttttctgtgcagaagcttttttgcttgatgtagtttgacttattttcgcttttgtttcctgtgcttttattgtcac

SEQ ID NO: 218706 - DNA, 468 bp, Homo sapiens
tagagctgacagatgctttcctttgagtaaacacattatgtcacctatgaaattttagtagctacagagtaatgttcatacagtatgtagtcttatactgctgaaataataaatttaatgtctttatgttgtcacattttaagaccataatgaagcagataaattgatatcttgtacctgaaataagtattttgaaattaagattcaattaagtgagccactttgacacttaattctagatttcccagatgaactgaagtgtgttgctctgtcttgtggtgcttttccttcagtggctcttttatgtattttagttggcataactttattttgattcatatcaatgtgacttaagtctgaaaatatgtcagtctcacattatgtatttttctgaccacttaatattttaaagacatctacttgttataaaatcacaatttggaataaatgtggtaaattttagcaaaa

SEQ ID NO: 218707 - DNA, 644 bp, Homo sapiens
agtcgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgtaaaaaaaaaaaaaaaaaaatcaggataattatgagattcatccatgttgctgttatcaacagatctttttttattgctaagtaatattccactgatgaatataccatggattgtatccattcacctgtgggtggacatttgggtttcttctagtattcatttttcttaaatacttggaagtggaataattgggtttaacgtttaaaacaaactgtttccccaggtggttggtttgagaattcttgatttattatacacacgagcccttgtcagaaggacaaaaatatatttgttttttaagcctgtatattgcttaccttttatttgtattcttttgtgtaccaccaatttccattggtatcattttccttctgtctgaaaaacttcctttaacagttctcacagtgcgaggtggctggcaattaattcagctttt

SEQ ID NO: 218708 - DNA, 534 bp, Homo sapiens
gtacgataatagtctctaatttatagatgaggaaattgaggttcagaaaggttaagcaatttgtcaaggtcaaacagcttgtaagtgacatagcagaaattccagatcaaaaactctttccaccaaggcgggtaggagatgagctagctggtgaaactctgagcccctcagatggtggggaaactgagtcccttaggtgttaaggggactttcccaggcttctggtgttagtcaaagagattgccgggaacagaacccatctgttctagccctaaccactagaccacacggcttctccatggcttcagctgggaaggtccaaagagaaactccctttctagccccagtgtggagtgtagactcttccccagctaacacggttatccctgcggaggccaggctgggccagggtgcagtgggggatgctggggggtttctgcccacacatatggtttccagattccaggggatgaaaaggaggcccttaggggcggaaatgggggatgtgtgatgacaaatttagactgattgctt

SEQ ID NO: 218709 - DNA, 285 bp, Homo sapiens
atgaatgggattagttcccttataaaagaaccccagaaaactctctttcccaccctctttcccaccgtgtgaggatacaatgtgaaatcggtagtctgcaatactggaacttggccaggctggcaccctgatatcagacgtccagcttccctaactgtgagaaataaattcctatttttttataagccactcagtctgtagtatccaattatagcagcctgaactaaggcattttacaatgggtagattttaatggtatgtaatttatactcaataaagttttta

SEQ ID NO: 218710 - DNA, 477 bp, Homo sapiens
tggtaatagctgcttgcaatgtcatgggcttgtactggttcagctgggaaagtgccacaatcaatcaccaatgtttgcgatgggctccatatttgacgttggtgttgggggatgtgggagttgacagctataatactacataaactaacttttgggtttgaatattagaaatctagtaattcttttcaaacatattcatttagtctctcttatgtacaaggcctcaatatctaccttgcaaaaatgtgttgtctcttggttaaattgacatctctgtgtccagaaaacctaaactgaaggattcttctatcttagtgttgtaagagtggctttgaattgaaactgaactgcatgtaagaaaaacaaatttttcagacaatgtggtaaaagaaggcctgggttagcagtatctgacactggaaacaacagtaagacttgactaaaatttatcctaataaaacaaaactttatattgta

SEQ ID NO: 218711 - DNA, 346 bp, Homo sapiens
  misc_feature (150)..(150): n is a, c, g, or t
  misc_feature (231)..(231): n is a, c, g, or t
  misc_feature (234)..(234): n is a, c, g, or t
ctaaatcttctctccagatgttttgactcattagacagtctgtgagtttcatcttcttgaggagatttcttcaggagcattttggtctggaatggttaccaggtatacctggtagtataaagctctcatcctgggattgaccttcaccantcattttggagacttgcttcatctctcctttgttggatcttctgtttcttatatctcatatcatcatattacccgaggcgntgngtggctcacacctgtagtcccagctactcaggaggctgaggcgggagggttgcttgaggctatgagttcgaggccagctggggcaacatagtgcgactcctgtctttgttta

SEQ ID NO: 218712 - DNA, 476 bp, Homo sapiens
cagtttataagcatacaggaatgacttaattgctttaataagtaaagtaaatccaaaagaagacatttatgcgaccagcaaacatattataaaaagctcatcatcactggtcattagagaaatgcaaatcaaaaccacaatgagataccatctcacgccagttagaatggcgatcattaaaaagtcaggaaacaggccaggcacggtggctcatgcctgtaatcacagcactttggcaggccaaggctcccaggatcatgaggtcaggagatcgagaccatcctggctaacatagcaaaaccctggctctaccaaaaatacaaaaaattagccaggcgtggtggtgggcgcctgtagtcccagctactcaggaggctgaggcaggagaatgacgtctacctggaggcagaggttgcagtgagccgagattgcaccactgcactctggcctgggcagcagtgccagacaccgtctca

SEQ ID NO: 218713 - DNA, 519 bp, Homo sapiens
agtactctccatttccacaacacttttcactttagcaataaaaaatttgtgtacataacttttcttcaactttatgtgtaaattcagaagttaatgtatatttaaaatttattattatacctttacttccaagtaaaatttgaggccactatcatactaagacatttttcaaacatcagacaaataagttcatataaagattaaggcaatagttaggcttttaagagaagaaaatcgattactacagaactctaatgttgaggccaggcacagtggctcatgcctgtaatcccagcactttgggaggctgaggcgggctgatcatgaggtcagaagattgagactatcctggccaacatggtgaaaccctgtctctactaaaaatataaaaattagctgggaatggtggtgcgtgcctgtaatcccagcaactcaggaggctgaggcgggagaatcgcttgaaccagggattcagaggttgtggtgagctgagatcacgctactgcatgccagtctggt

SEQ ID NO: 218714 - DNA, 474 bp, Homo sapiens
ttaaagactctcagacagaaacctcagtccatccagtctcttcctccagctgcctttcaagtgcgtgaagttttgaagtctgcacacgttttctcagggtgaggcactgtacacatctgggtcagctttattccagttttctttttttttaaatatataaagtcaatcagtgtgagtaactgctacatgagaccacggagaaaatgaaataaatatgttggaaatgctagaaagtgatctgcagttgtttattcgcctcagtctcacttcctggcttattttaaagcattcaaagggtttgaacaatcttttgagttgtttggcgtgctgcaaaaaatatggtctgttctctaatatgaaagaattttacactgtgcttcctggcctggaagtgtgtgggagagtgaggaaaacagggagaaactagtctcaagggacgggacctcttgtgctgattaacattctcttaacaag

SEQ ID NO: 218715 - DNA, 501 bp, Homo sapiens
ccaggtggctccttctgcatggcctccacctggctcttggcctcctggcagtctctgatcacccttaccccaggaggacccttgacccccagcctggccccccttgtcttccttcctggatgtcccctggcccacgggctgtgctgtgcttggaaggcatactgtctgagggtacgagccctgtggcactgcctgggacttctttcagggctacgatggccctggcttgcttcagtccttctctgcatgctggcagcgccacagcctgtccaggccccatggacgttggcacctccaggtcagctgtggcagagaggccccttgcactaggaggagaggctatcactgtctcctactagggtggcgtggaagaaagctgttgtgtttcgggtgctttcctgtttggtgtgaggcttgttggccagcttgctaggagcaggggtgggtttggggtagacttgatggcattttctcctcctctgcctcctcctctgctgactg

SEQ ID NO: 218716 - DNA, 104 bp, Homo sapiens
aaccaagcctggttaagtcatctgggcacagagaagttaggggaatgagagagcggtgtagtcattacagaggctggtgtccttgtctactgaaatgtaggtgt

SEQ ID NO: 218717 - DNA, 436 bp, Homo sapiens
tttttaaaaaaaaaaaaaactttttcttcttctctcttatttttcctataccctgtcatttaagcatcacataattaattgtgtacatcctgtgccacatgcaattgccacagctttgaagtcccaatagatcattttatagagcagtgggtgccattttaaagaaaaagaaagaaaaagaaaagcaaaggcctggcgccaggacacggctgtgtggatttgaacatatccttctccaggtatgataaagaaactcgtgcaccttctgtttgtttttctgcatttcctttccacactggccttttcaatatataggaaagacctcaggactgagtttgttatttttctctctggagctaattccttttccaaaaccagcacgaactgcctcatttggtgctgaggtgaggtttgctttttttctttcaaatttgga

SEQ ID NO: 218718 - DNA, 450 bp, Homo sapiens
catctacatgactgaacagggggttgggaagatgtgcagagtgtcttaccccagactaggtttaggggtgctagactcctaggctttgatgcagggagagagggtaatctctggtccaggaagaagggatattcttgccacttcactcaacttgagagagccccaacggtcaaacccgaaatactggtaggaggggaagccgctgacaagctttactcaaaacgggctctctgggccgttgatggggtgggtgggccttggaggatctgttgttctgctcttcatctgcccagcaaggagcaagaggtgggtgaggagggagggtttctgttacacaaaatgaaaactcccaagcagggctgagctggcctttttcacggtttgaatgagcagctctgaggcaccctccccaccttcgagcaatgagaccgaagatctttcataattctc

SEQ ID NO: 218719 - DNA, 465 bp, Homo sapiens
atattccagtagtaaatacttgatagtaatggcctacagtatttaactcctgtcagtactgtattacagggagagtaaatgtgttgatatttaccttagacacttttttcattaatatttaatgtgtgtgtgtgttttgctgtccttgtcactggcatgtttcctaaggtttgaagaggaaattgtaagagttctgagttaatgaagccaatttggttttaacatcagttgttaggaaacttcatttggccatgataacaatctagccagttaaagctggcagctctcagagggcacattattttattttaataggatatttgatttttctctgaatttcttgtttggtatctctcttccagcttgagacctaaaattccaggtttgatcctgaacattttttctttataatagattgtagtatgtgtatgtttttattacaaagtacatatgacttcttagaaa

SEQ ID NO: 218720 - DNA, 537 bp, Homo sapiens
gtattttttttatgttcctaatccatttaaataaagctgtaggtatgaccatggaaaccaattagcactttcttagtttgcattatccaaaaggtgttggatttgtcggattgcaaattggtttagagttctcagtcactgaagggacaacacaaaccagagtacacttcaatagttcctcaatttgtatagaaaagcctgaaacctttccttttttaaaatgcaaatcacgtaaagttaatatctgtacacaaagacctacctgcttaagaagtttgagagctaatttagctttgaagataatttgcaggaatgattaggcctgaaaggaattatatttgacctgaaaattttgtattggatttgcccatatttaccaaagtcagtttcattattatcactgtgtttctgcttcactggacacatttatatctgctttttccagtgttgttttgtaaaaccggtatccctttggttattaatacatgttttttgaataaaggaattctgtggccaaataagtttgaaagtcctcta

SEQ ID NO: 218721 - DNA, 391 bp, Homo sapiens
cgtgaacaatgcagggtttaggggtggtgacccctgcaagtcaaaaccccacatacaatttttgactccccaaaaacttgactctaacagctactgttgaccagaagccttactgagagcgtaaaccatcgactaacacgttatgtatgctgtatgtattacatactgtattcttacaataaaataagctagagaaaagaaaatgttattaagaaaattgtgtggaggaggaggaaaagaaggagttggccttgctgtctcaggggtaccagatatggaagagaatgcgcatataagtggacctgcacagtttaaacctgtgttgttgtgttgttcaagggtcagctgtaagagagttcacataaagatgttatccttcccattgcttcca

SEQ ID NO: 218722 - DNA, 473 bp, Homo sapiens
aaatgtttgatcatatgcaaggatatttacttgtttaataaaaagaataaatagtagtaagttaaataaatgaagctctaattataggcatcaactagcaaggtaaggagctcaaactttggccagtgaggacaggaaaagacaaaagcgctgagctctcataagaatgaaaggcgacaggttgggcgtggtggcccacacctgtaatcccaacactttgggaggctgaggagggtggatcacctgaggtcaggagttcgagaccagcctggccaacacggtgaaacccccatctctactaaaaatacaaaaattagccgggcacggtggcagatgcctgtaatcccagctacttaggaggctaaggcaggagaatcgcttgaacccgggaggcagaggctgcagtgagccaagatcgtgtcattgtactccagcctgggcaacaagagcaagactccgtctcagaaaaaaaa

SEQ ID NO: 218723 - DNA, 830 bp, Homo sapiens
tgcaaagtctcagcaggtcacatatgatttatctcccaaactgggacaccattgagaataatgaggtgccgctattagatacactgggacaccaggattaaaccagaacgaacagggctttcagtgacttaatagcatggagtctgatccccatgggtgacctggagcaaattataccacctctctgaacctcagtttccttatctgttagtgggaatatacctctagatttatgagagtagaggtgacctgatgtaaaactggcaagatgcctggcacctgagaggccttcagtaaatgatttgaggtgttactactattaccaagtggcagtaactagaagagatcagtagcaggagttgactggtgaaatcctggcgctggcatggctggagtggatactccagaaacatggcccgtgctgagttgcagcgtcagcatgaagcccagtgaatgtgactgccaggcccttagaagcaaggcaggggcgtgggggaagggtgtggtctggcatgagcctgtttgggttctacaccacccatcttcgtgacttccggcaagtcactttacctcactgagtctcagtttcctcatctgtcaaatggggtgagaactgaatgagattatatctatccgttgaccctccggattcacatttgatagctgatgtcactgtggtccttatcaagtaacgccaggagtttgagggatttctgtcattaaccccccagctggcctgcctgaactctggcttgcctggaaatcgcctctcagtggcaggaactattactttgatgtgctcaaatagaagagcaggcaccctggggcca

SEQ ID NO: 218724 - DNA, 783 bp, Homo sapiens
atagaacagggggagacttgaatcctagagaaaacaaaacaaaacctaacagaacagaaatgacccttgatgaacctcttgctctggactggtgccctgaaaatgaatgaaattgttttaaagattaccaagaagatataaaatatcaaatgcggcattaatgtatctgtgtgatgaaaactctagttcagtcatttgaagacatggggcttcctccctacctcgctctcagtcaagggttacagttttactccaggaacagcatgaacatgtcattccactccagccctgaattgcagaatctctattctgggtagccatgagtgggaacactgatctcctttaccttccccaacacccactccaatggcagaagttatgccccaagcacaacagatcgaggaaactggaatctataacagccctgcccaacttgcttagggtagaggttcaatgtcaacaaggacaagttcaaaagttcaggatctatttccctgcccagagtaccacttgttgagtagaggtgtcaccctaaaagaagtgggccactgccttcaccatcagcccagctaaagtggcacagaagttctatccagaggagaggcagaaaataagaacaaagagctcagatctcttcctaaatgagtttacttaatttggaagaaactgtgagttcatgactgagggcatttttgaacacaatggagatcaccaaatgagcaattaagaagagacttgtagctctctgatacccataaaaaaaagcaaaattgtagatgagat

SEQ ID NO: 218725 - DNA, 536 bp, Homo sapiens
atagaacagggggagacttgaatcctagagaaaacaaaacaaaacctaacagaacagaaatgacccttgatgaacctcttgctctggactggtgccctgaaaatgaatgaaattgttttaaagattaccaagaagatataaaatatcaaatgcggcattaatgtatgtcaaaaagaggaaaaggtgaagatcaggaggcacaacattccaaggatataaaagcaaatgtgaaaatgccataaagtggacatcggcttggcctgttgaaggctgaaaaatccaagcaaagtctatgttgccttcaccagtgttcagatacacctggaagctgctttctgaaaagatggagaccatttttacccaacagcatcagctcagattcttgtgattataacacagcatgattgctgcttcatgccttctgccatgtgaggacacagtgagaagatggacaactataaccaggaagtgagccctcaccagacgctaagtctgacagtgccttgatcttgaactttctggcctccagaaatgta

SEQ ID NO: 218726 - DNA, 742 bp, Homo sapiens
gggtgtacctgaaaaagagaagagaaaggagcagaaaaaaatattttaagaataatgagtgaaaactaaaaattgatgaaaaaatgatctgcacatcaaagaagcccattgaaccccaagtaggatgaatgcaaaaagatctacccaggtatatcagagtaagaatgctgaaatctaaagacagaaaatactgcaagcagcaagtggaaaatgactttgcttggacacaggaaacttagtgagattaagatcttctcatcaggaataatggcgaccaggaaagagtggggtgacatattcaaagtactgaaagaagaaataaaaaacaaaaaaaagctgtcaaccaagaattatacatccagcaaaactatctgtaaaaatgaagatgaaataaatatattctcagataacagaagcactgagaaaatatattcttagcagactcatcttacaaaaatacttagaaatttcgtcaggctgaaaatccaagcaaagtctatgttgccttcaccagtgttcagatacacctggaagctgctttctgaaaagatggagaccatttttacccaacagcatcagctcagattcttgtgattataacacagcatgattgctgcttcatgccttctgccatgtgaggacacagtgagaagatggacaactataaccaggaagtgagccctcaccagacgctaagtctgacagtgccttgatcttgaactttctggcctccagaaatgta

SEQ ID NO: 218727 - DNA, 658 bp, Homo sapiens
agaaatgccacccctcatcctgaactccatgcactgaaacattcatcaccaccctcgccatcttttctatcagcctgttcaaaagttccagatggctcttcaatgactctgtcttcacatttgaccatatgttaattgattcaatatatgcctgtattacagatccaagcaaagtctatgttgccttcaccagtgttcagatacacctggatggagtctcactctgttgccaggctagagtgcagtggcatgatcttggctcactgcagcctcttcctcctgggttcaagcgattaccctgcctcagcctcccgagtagctgggactacaggtgcccgccaccacgcccagctaatttttgtattttttttttagtagagagggggtttcaccatgatggccagatggtctggatctcttgacgtcatgatccaccggcctcggcctcccaaagggctgggattacaggcatgagccaccatgcccggcctctttttactttttaattgtggctaccagtttgaaattacatatgtgacttatagcagcaatacagcgggataaatggaaagtatctagttattctagattaaataatcgatcccttttccactaaatttaatggccatcttttacctatattaaattactttattaa

SEQ ID NO: 218728 - DNA, 511 bp, Homo sapiens
ctttctagcccatgaattttaatgtctggcttagaagaaaattgctacaatttgggatgctgaacttgtggcctgggtgcccttatagtgccctctcctatgctagatagcagaagctctttggtccttgtataagggatccatattagaaaccacttgcctacttggtccatgtggacaagttcctagtatggctgccatcatagagagatcacagtgcgtgaaaattgagacaatttagtattgaaggaagtatttcatttctccttcacttatgaagcttagtttggctgaatatgaaattctgggttgaaaattcttttctgtaagattgttgaatgttggcacccactctcttcttgcttgtagagtttctgccgagagatcagcagttattctgatgggcttccctttgtgggtaacctgacctttctctctggttgcccttaacatttttttcttcatttcaactttggtgaatctcacaattatatgtcttggagttgctgtt

SEQ ID NO: 218729 - DNA, 609 bp, Homo sapiens
tggcatagaattcatctattaacaggatgttttgaggccagacgtggtgactcacacctgtaatcccagcactttgggagacaaggctggaggatcacttaagcccaggagttggcaagaccagcctgggcaatacagcgagacccccagctctgcaaaaaaaataacaaaattagccaggcatgattgttcatgccggtggtcccagctactcaggaggctgaggagggaggacagcatgggcccaggagtttgtggttatactgcactccagcctggcaacagagcaagaccctctctctttaaaaaaaacaaaacaaaacaaaacagaaccgggcgcagtggctcacacctgtaatcccagcactttgggaggccaaggcaggcagatcacgaggtcaggagttcaagaccagccagaccaacatggtgaaaccccgtctctacgaaaaaatacaaaaattagccaggcgtggtggcgcatgcgcttgtaatcccagccgctcatggggctgaggcaggagaatgacttgaacctgggaggcggaggttgcagtgagccgagatcgcaccactgcactccagcctgggcgacagagcgagactctg

SEQ ID NO: 218730 - DNA, 422 bp, Homo sapiens
tagcatgtaactttacctataaaataccataaagtaaaattgaaaaagttgatcctgtcaacgttgttattaaaagctattgcaaatgtaaagaatgaggaacaatagctaatataataatagctaaaatttgttattgagtgctttgtgctgggtagtattctgagtcctttaccatgtaatttttataatatcattcctagttttgcagatgaggaaaccgaggtacaaatgagttaatacatgtgaccaagagtgaccgctcttttttttttttctctttttgaggagagtctctgttgcccaggctggagtgcaatggtatgatctcggctcactgcaacctccgcctcccgagttcaagtgattctcctgcctcagcctccccagtagctgggattacaggcatgcgccaccacacc

SEQ ID NO: 218731 - DNA, 463 bp, Homo sapiens
aatcctatatccagtcaagagaccctcttagctaaggacaaaactaagtcttattctttgatataaagaataatatttgtgaaattcagacatataattgtgtaatgcagacatatttttggcttcctgttaaattgacaattagggaaaagggcttaaattagttgcttttgtgggatagagtatgaattcaaataccatctgtaaatttcccgattctttatccttgttgtggattgtttagtgtttaggagtaatctgtacagacatacttatgaaattgatgtgttagtttgaatactaattttgaataatttcaaactacagatttgcttatgagtagcaaaaggatgggcactcgttgttgactagtatatgtgtaatattttatatgttatttgacaaaaatgtataaaatgttatctttaaactatatcattaaagtggacttcattttaatata

SEQ ID NO: 218732 - DNA, 647 bp, Homo sapiens
ggggcctgaagttattttgcagtggctaatggcactgaggaatttcttttttggtgcatttggtttacactcatttcctctcctaattgttagttcatttgtaacagtgggtgagtgtttggaggaaaggagggagaagaaaggagggatactgtttctcccatgaaatagtctaattggttgggttgatggcagaaggaaacataggggagccttccagctcacagccaagggttgggctcttaaacactatgcctagtgttttctgaatgctgtcttcatggagcccagctcttactctctttgtactttacatctcacccccactcattacagatgctcataacattcttaaaatattttagtacttggcatttttctgttttcagtcagctagaacacactagagtcctttcctcagatggcataatcctttataggctctgagcctgcctagccatctcctatcggtgttattactcctcatctcaggctctgagatgatactcagaccctaaactgattggactttttggaggagggtgccagtagagaggtcaggaagatgtggagatgatgatggagagagatgtttttattttattttattttttcagacagagtgttgctctgtcgcccaggctgga

SEQ ID NO: 218733 - DNA, 575 bp, Homo sapiens
ggggcctgaagttattttgcagtggctaatggcactgaggaatttcttttttggtgcatttggtttacactcatttcctctcctaattgttagttcatttgtaacagtgggtgagtgtttggaggaaaggagggagaagaaaggagggatactgtttctcccatgaaatagtctaattggttgggttgatggcagaaggaaacataggggagccttccactcttactctctttgtactttacatctcacccccactcattacagatgctcataacattcttaaaatattttagtacttggcatttttctgttttcagtcagctagaacacactagagtcctttcctcagatggcataatcctttataggctctgagcctgcctagccatctcctatcggtgttattactcctcatctcaggctctgagatgatactcagaccctaaactgattggactttttggaggagggtgccagtagagaggtcaggaagatgtggagatgatgatggagagagatgtttttattttattttattttttcagacagagtgttgctctgtcgcccaggctgga

SEQ ID NO: 218734 - DNA, 587 bp, Homo sapiens
caggtaatctttctccttccctctgttcttttgtttctgttgttaacattacaatgccagacccaagaagggtgagtggttggctctgtctgtgtgtttaggcctgctgagctttaaccttacctaaattggaaaatcaggctttctgtttttcttctgtattgacttgcaaaataagcaaactattctgacttcccagtaagtggcaattagaatacttgttttagaaatacatttgcaactgaaaaaaagtggaaaatggtaaacattttgcattcctaaagtaagaaatagtttagcacaaatatagtaaacaatgtaaataaagcccccctctaaaatgctaacatttagagagatttagttatagcacagaggatgtaggtgactgaagtgaaggcagcataattaattgcctttgaaagagctatttgaatgtaatgtagctaagaaaacaaatctgcaatgtctacttctttttaaaaagaattatgagaatgtatttccctttccctgcataacttctgttttattgcataaacccctggagcataaaaataaaagtcaaataaacttaacatagcaaa

SEQ ID NO: 218735 - DNA, 410 bp, Homo sapiens
tacacatacacacacacacaccccccacaaaaacatttgtttccctagacaactttcatttaatgctttctagaaaggggaattggtcgcagtgtcctttgttgtgtagaaaaccccagtagatgtgggctgcactcagtggctcatgcctataatcccagcactttgggaggccaaggtgagaggatcacttgagcccaggaattcaagacttgcctgggcaacatggtgaaaccccatctctacaaaaaatacaaaaattagctgggtgtggtggcgtgtgcctgtgggcctagctactcggtaggctgaggtgggaggatcgcttgagcccaggaggttaaagctgcggtgagctgtgattgcaccactgcacaccaggctgggtgacagagtgagaccctgtctca

SEQ ID NO: 218736 - DNA, 439 bp, Homo sapiens
tgggactggggagtgactgataatcagtatgagatttctttttggggggttgttctaaaattagtttgtggtagtacgtcaaaaacaacgaattatactctttaaacaggtaaactgtatgtgaactatctcaataaaaagctgtttaaaaaaaattttgcactgggcacagtggctcacgcctttaatcccagcactcaggaaggctgaggtgggaggatcacttgagcccaggagttcaacaccagcctggacaatatagtgagaccacatctctacaaaaaaattagccggccaggtgtggtggcttacgcctgtaatcccagcactttggaaggctgaggcgggagaatcgcttgaacccgggaggtggaggttgcggtgagcggagatcatgccattgcactccagcctggacgacagagcgagactccgtctc

SEQ ID NO: 218737 - DNA, 422 bp, Homo sapiens
agtgggtcagaggtgcagttcttccctgatgtggctgctgcctgctccgaagaagcagatctttgtcagcctccagagctgcagaaggacactatcttgggcatgaatatcccacagcagcagtgcttttcttctctctccgccggacctggctcattcttgtctggcagaggaacaagcgatttctttttatgagcctgcaaacctccagcctcccagcctcccagctggctgggtgccagggctgggcctgacacacaggctgacgtccccacccagacccatggtcctggctgctccgaattctggagcgtctgagtcaccatgcctgagccggcggcgtctccatgaaagagttcagaagaataaaggaacaggctctcctatgggcctgctgatagcaatctatcagcatgactaca

SEQ ID NO: 218738 - DNA, 458 bp, Homo sapiens
gagtttatcacttctccatagcaacggttataaggaaaggattctaagtaaatggctccctggtagtcatgtatgttcaacataaagtgtcaatactaatttagcatacaagagtcatttgctgctccttatttgggcattccaaagttaataacccttcaaatgagcatcaataagattctagtatctcacaaggctgagtgaaggacatctgaagagcaagattcctccatagtaattaattataaaaccccccatttttttttttttgagacgaagtcttgctcttgttgcccaagctggagtgcaatggcgtgatctcagctcatagcaacctccgcctcccgggttaaaaccattctcctgcctcagcctccctcccaagttgctgggattacaggcgcatgacaccacgtccagctaatttttgtatttttattagagatggggtttcacca

SEQ ID NO: 218739 - DNA, 303 bp, Homo sapiens
gactctgtctcaaaacaaaacaaagaaacaccaatggatggaacaaggtattaaatggatagaacaaggtattaaaatattaacaatggcggccgggcgcagtggctcacacctataatcccagcactttgggaggccgaggcgggtggatcatctgaggtcaggagtttgagaccagcctggccaacatggcaaaatcctgcatctactaaaaatacaaaaattagctgggcgtgctgctgtgtgcctgtaatcccagctatttaggaggctaaggcaggagaatcacttgagccaaggagg

SEQ ID NO: 218740 - DNA, 259 bp, Homo sapiens
gcagagcttccactaagccttttagtgttttattcttaaatatatgagtggatggccaaggtcactaagcataggaagaaaccccctggtaagaaagacacgggtcaggcgcggtgcctcatgtctgtctgcaagcccagcacctgggcaggctgagatgggaggatagcttgaacccagggagctgaggctacggtgagccatgatcgcactgctacacttcagcctgggtgacatagactctgtctcaaagaagaaa

SEQ ID NO: 218741 - DNA, 394 bp, Homo sapiens
ctgttccttgggaacagaatatctttcttcaatgaagtgggttgaaccctggtacaaagcatctaatttaaacgacttttagagtggagctcaagtattctgacaaaaacacaataccaatactcagccagattctgcaaccatcttcctcctgtcagtctttcaagctatagaaggatggtaggactgtgaaactcctagcattccatatgtggctcatagtggtggaaaagcatatgatgttatttatggaagggaaagacttaaatcaggtgcactctttcatgacaaatacagagtcttgtctgaaatgtccaaacacatggaacatggggaaaaatatgccatggcacaacatttatgcaaataattatacaagcttattagatctaaa

SEQ ID NO: 218742 - DNA, 454 bp, Homo sapiens
aaggggctatctccagcctccagcctctcttctctgggggttatctcaggcatctctgtacatcagaaggcatctttcctatgttatggaccttgaagttcttcccacactaaggaggctgtctcaggagtttctgttccctaggggctatcttatgaattttcttgcactagaaatataggaaggatgcatcagagatccctgttggcagcaaggtctgcgagaaaggctctccaactctctttgcaagttgggtgctggctctgggatccccgtgcgtcatgtagtctacctggaggtctgcctcaagggtttcttcacaccagggcagggctctccatgatcaatagtcctgcaatggcagtcctttcttttttgtttgtttgtttgtttgtttttgagatggagtcttgctctgtcgctaggctagagtgcactggcacgatctcggctc

SEQ ID NO: 218743 - DNA, 323 bp, Homo sapiens
gattctcttagcgatgacacaagcgacatcttggaagaggcaaaacttgagacaggtcttcaaggattggtgccatctggacaggttgaagaggagtaggagggctttcggatgtggagaatggcatgcacaaaagcacggagatctgcagcaacactttatgccagttggattatggtccattgggagaaagatcaattaaggtgaaaccccagtagagaaagcactggagaacaacattcattcttccttaataaatcttagttttaaatatttgctttgagttttgttccattaataaagaaaataagaaggaaaaccaa

SEQ ID NO: 218744 - DNA, 271 bp, Homo sapiens
ttccattgccctctataacacatggcacaggccagctaggaaatataaaatcaatcagtggtttaaatcaagttttttactttctctctccatctgcagcaacactttatgccagttggattatggtccattgggagaaagatcaattaaggtgaaaccccagtagagaaagcactggagaacaacattcattcttccttaataaatcttagttttaaatatttgctttgagttttgttccattaataaagaaaataagaaggaaaaccaa

SEQ ID NO: 218745 - DNA, 261 bp, Homo sapiens
tctgagtttcctcgactgacttcaatggacctgtttctagaggggcatgaaggtggctgtgacttcataagcagaatggaaatctgcagcaacactttatgccagttggattatggtccattgggagaaagatcaattaaggtgaaaccccagtagagaaagcactggagaacaacattcattcttccttaataaatcttagttttaaatatttgctttgagttttgttccattaataaagaaaataagaaggaaaaccaa

SEQ ID NO: 218746 - DNA, 332 bp, Homo sapiens
tacaaatctctggaaaatgttaagagcaaaattggcagctattgttttaaaaattcttccctagtttatttgaactatttctagcaagatctttcagaaagcatatagattcctgtgttgtaagttcttagaggtcagggacagtttttttcaactttctctccttaatattatgataggattaactcttatttattcttagggtctctgatgaaatgttatttccttcttgactagatggaatgccctactataaatttgcatatttctctgtaatttcccaatctggtcactcatcacacttccttgtaataaactgattaattatcctt

SEQ ID NO: 218747 - DNA, 511 bp, Homo sapiens
tgtccataggtttctattctcaccatctttctgttacaggcgacaggaatttcagagaacttttctaatcacaagctctccagagtccatctgcaatgccatgtattcactagacccgatccagatcctattaaaactcagcatactgcttagtatgctgagaagaaagcgctcatcagtttgatgcaaacttctcagattgggcagctacaattagagtaaatacaactgttgtatcctagagaccaaggccagctccctatgactttcccttggtgttgccacaactgccaaatagggatgattacaaatcttgttcctttccacaaaagggctcttatgaactgtaatgataaaatattgacaaaacacttttgaatttgtggttaagatattcctggaatatctcaatgaacgcagagttttgggtttaaagatcaaagaatgaggtctaataaatgatgtatttcagtttaaggcttaaattatatctttcagcctccacgattcc

SEQ ID NO: 218748 - DNA, 426 bp, Homo sapiens
tgtttctagcagcattatttatagtagcccaggttgtaaataatccctgcctattaacaacagaataaattgtgggatggtcattgatatggcttggctgttatgccccacccaaatctcatctcgaattggaatccgcacgtgtcaagggagggatgtgtaacccccacgtgttgagggaaggaagtgattggattatgggggcggtttccccaatgctgttctcgtgatagtgagtgaattctcacgagatctgatggttttataaatggtaatttttttctttgctctcccactctctctcttgcctgctccgtgttaagactcgtcttcttccccttctaccatgattttaagtttcctgaggactccacaggcatgcagaactgtgagtcaattaaacctctttcctttgtaaattaccca

SEQ ID NO: 218749 - DNA, 234 bp, Homo sapiens
agtgagtttagctaggggaggagcattctgtgctgaaggaaccgcagctccaaaggctcaggtgggtgcatgcctggcatgttcaggaacaaggagggcattatgagcagagtagatgattgaaggggacggtggtaggacatgaagtgccagtggttgtaatgaataggcagatcatatagggctttctggaccatagtgaggaccttagctaattaccctgagtgtgttgag

SEQ ID NO: 218750 - DNA, 1481 bp, Homo sapiens
  misc_feature (1066)..(1066): n is a, c, g, or t
acctggccggaggagcctttcaagtgggcgtgtctttcggctggggaaaagggaggagttagactctgggcaacatcactcctccctggtcagctgggagagcaatcaaaactgcagcaagtcagaggctccggccagagagcaggagctgcccagaggcttgtggtcctgaaagctcctctccggggagctaaccagggagaggaggtactgaagagcgactaaactggctgcagcggagagatcagcccgaaggcgtccttgaggagcatacggaactccaaggaaggagtagaataaggagcaggcagagaaaccagacccggtggaatctctaagaggtaacaaccgggtttgacatggatcgctgaaagcgtctcttctaccatctggatggtcagggagacttggcttctctgactgtcctctaagacgcagattcacagagttcactccaggaacggccagtgaccgagagtctggaaatgtcaaaaacttttgtaaaatccaaggagatgggagagctagtcaacacaccatcctggatggataaaggtctgggctcccaaaatgaggtgaaggaggaagagagcagaccaggtacttatgggatgctcagcagcttaactgaagagcatgacagtattgaggaagaagaagaagaggaagaagatggggagaaacctaagagaaggggtcccaagaaaaagaagatgaccaaagctcgccttgagagattcagggctcgaagagtcaaggctaatgccagagaacggacccggatgcatggcctgaatgacgccctggataacctgaggcgagtcatgccatgctactctaaaacccaaaaactttccaagatagagactcttagactggccaggaactatatttgggctttatctgaagtcctggagactggccagacacctgaagggaaaggctttgtggagatgctgtgtaaagggctctctcagcccacaagcaacctggtggctggatgtctccaactgggccctcagtctgtcctcctggagaagcacgaggataaatctcctatttgtgnctctgccatctctgtccacaacttcaactatcagtctccggggcttcctagccctccttatggtcatatggaaacacatctccttcatctcaagccccaagtattcaagagtttgggagaatcgtcctttgggagccatctgcctgactgcagtacacccccttatgagggcccactcactccacccctgagcatcagtgggaacttctccttgaagcaagatgggtctcctgacctagaaaaatcctacagcttcatgccacattacccttcttcaagtctaagctcagggcatgtgcattcaactccttttcaggctggtaccccccgttatgatgttcctatagacatgtcctatgattcctacccccatcatggtattgggacccaactcaatacagtcttcactgagtga

SEQ ID NO: 218751 - DNA, 407 bp, Homo sapiens
gtaattgtctgtggctcccatagtagcatttgtccgtgctctcctcttgcttgtctcccataaagaccatgcaaagtccttgcagtcaaggccactgccactcacctttgctatcctcatcacctagcagagcccctggcacatagtgtgttgaatatctgggaatgaggaacttaactgcaactgaactttcaatctaactgacttggtgatgagaaatactagtcaggatgctctcatgggtgagacctgatgtgacgccaaagcttggttttctccagcttatgttttatttggactgcctgtctgaaagggctagacagacatttatgttcagagaggccatataagaagaatataaatgcggaaagtcataaacttcagctctgctctgggctccactctca

SEQ ID NO: 218752 - DNA, 371 bp, Homo sapiens
acattgtttgttgtctgaagctgtgttgtcacagcaatagagggaaagcaactgaccaaagacagcatctggtgtctgaaggcatttgacctcaccattggccctaggcacccccctcagatgccgtccagcaggttacacaagttcaaaaatgatgttttcttcacagaagctttaaaaataaatagagtttgaaaaggaagagtcaagttgtaggttaggatgagtcaatgtgagatttttgaccctttggctcacaatccttccaaggcaacttaataagctgatcattcttgtttgtgcaatgaaaaactaatttcagatgaatgcttagaggatactaattaattatcctttctgacatgctctgc

SEQ ID NO: 218753 - DNA, 340 bp, Homo sapiens
ttgaaaggggtctatggaaaccaaagcacgcataagggaatgaggactcagaagttgagaaacctgaacagagggtgcgggacagttttactttggatctgtattctgcctcttcttttcttccttctttcttagtcttccactttttttccctacaaatatttgttgaattacttgtatgtgtatctgttctttaactgtaagcagaaacccagttcatcatgagatttttcattctctcttcatgcacacagaatagttacatagatatatactgctgtgaatgtctgtttcaaaagctcactttaatgaaagtctgtttttgtcgtaggttttatga

SEQ ID NO: 218754 - DNA, 559 bp, Homo sapiens
aaccaatgcctccttcctgtctgctgctagcaaggattacacacaggcatctccacaaccgcattctctagtccctgcaaaggaaggtgcttagagctagtgagacaaaagcaatctattctcctgccagctctgggtgattccctgccctgaaattttcttgtgtccaggataagcagcattattggttctttcgaccaagttcttatctttaaccagcttgccctctgctgtgctctgcatcccagccccattcccccaacctctccaccccgccgagctccttagaagggctcaattcttctaccttatcatgttattgagagtcaagactttggtggcagcattaatcattatcaccaccatcatcaattcaccacttaggtttacatggcactgtaaaaagtacaaaggtctagggctttgtacacattacctccttgaatccaaaagtgaaacccatgacgcaagtaaaataatttccattttcccagcagcagctgttattgactgaaccatcacaacaagtcaggcgtgatgctaagtcctatatatgaat

SEQ ID NO: 218755 - DNA, 428 bp, Homo sapiens
ccaaaaccaatagcctattaaaaggactatacaccagaccaagaaggatttatttctggaacagaaggatggttgaacataataaaaatcaatcactgtaatataccacattaatataatgaaggagaaaaaatatcatttcaattgatgcagatatagcatttgacaaaattcaacaccctttcatgattgaaaaaaaaaaccaaaacactcaacaaactagagatagaaggaaactaccaaaacgtaataaaagcctgtttgaaaaacccatggatgatatcgtgctcaatgttgaaagactgaaagctttcctcaaagatcaggaacaaggcaaggatgcctgctctcaccaattctattcaatacagtactggaagtcatagccagagtcattaggcaaaaaaaagaaatgaggcatccaaatc

SEQ ID NO: 218756 - DNA, 513 bp, Homo sapiens
gctactcagatatagagtagggcatcctcagaaaacaaacagagaaacgcctcatctttaagtttttcttatataggggttttgtctatgtaaatgctaagctaacctgtgtctatgtgcaggtgggcagacagcatgacaaatttattattctactgatttcaagaaaactgtccttgacattctactgtgtaaatacatcaaagcataactgtaactatcttggaagcatatactgctatgggtattgggacatctggactttctgctgttgtaggagtatatccttatagatatctttaggcttttcctcaactataaacatcttatggctatgggtcatgactggcaaggaatgtgccttgttattctcaagatggagctgaacttaaaatggtattactctggctctccttccctaacaattcctccctatatttgtcagtgtgtatttttttaactatttatctttatcaagtatacagttcaatggtaataaatatatttacatcc

SEQ ID NO: 218757 - DNA, 188 bp, Homo sapiens
ttagggaagaatgataggtacataaaccagacaaggcagaagctatatattcataattagagtccatgaaaaacaaaaccaaagctaatagaacagaacaaatatttgaaaatataatttgagggggaaaatgttaaaaacagaaaagaataaccgtatctattgaaagcatatattacatagcagta

SEQ ID NO: 218758 - DNA, 358 bp, Homo sapiens
tagagaggggatcttactctattgcctgtgctcatccagggcagcctgtccaaagctgctaggctttcctgttctgccaggccaagtttagggttttggggccttcgtgtgtgctagagaagatgcaggaaaataggcttgatctgggtcagttcggtttcaggctgggtgaaactgaaccgtgaatctgcatagagtgtcagaaccagggacagctcctcctgtcacctttgctgcctttcccctggcttgggctagggagcgaatgggcagatttcgtgatggtatacttctctagcttcttttctcagtgcttcttccttccatttttatgcaagaatattactactgatagttc

SEQ ID NO: 218759 - DNA, 646 bp, Homo sapiens
gtattttaaaagatcacactggctgaagcgaggaaagatagtgggtttggaaaaggtacaaaatggttaatgcaagaccagtcaggaggttattccagcagccccagtttaggctatagtggtagtatgacggtgatgaatgtcactgagtgaagtggatagattcaaaaccagttgagaaggtaactgttagtagataataacctctgtaagtaggtgatacatctcagaagaatggaaatggtttatatcaacatttgtggcaaatgtggtaagaagcaaaaataaattttagtagggccaagtagcagtgagactatgtaagaagatgaacagaagagaaaggttagatttgaggaggagacaaatcgtgtagaaggaaagtgaaccaattggatgtaggttgtggagatcaaagcatcaaagaacaacagcatcaatcataatagtattggccacttaatatctgctggatactaatctacgtgctttacatgtattcattcatttaatctccacatctttaatttgagcaaatgcatgaaaatagaaattaagatgacagaggtaggtgtagaaaactggagagaatattagaaaatcatgcaatgtctaatactcacttgcaagcatggccctttcaagt

SEQ ID NO: 218760 - DNA, 587 bp, Homo sapiens
gtagagcattaagtgtgatcctagcacactgttgagccccacagtaaataatatttgcataatcacaatatgaatgtaaatagcatttcttttattagcctgttaaaagatttcatttgtgtatagaaaagaatgaaatcttgctcgccttgacagtgtaaaaagtaaagttacagagtttgggccctgtgaggtgggtcaagggttgggctccctctcatccacattctacatagtagcttttttttttttaaatggagtcttgctctgtcgccaggctggagtgcagtggtatgatctcagctcactgcagcctctgcctcctgggttcaagcaattcttctgcctcagccttccgagtagctgggactacaggtgcccgccactacgcccggctaatttttgtatttttagtagagacagggtttcaccatgttggccaagatggtctcgatctctcgacctcgtgatccacccacctcggcctcccaaagtgctgggattacaggcgtgagccactgcgcccggcctctaacatagtagctcttgaagctcatgttcatctgaacaaatatctgtaattggac

SEQ ID NO: 218761 - DNA, 209 bp, Homo sapiens
aaattatcataatgttggctgacacagatgatgacagagccaagatgatcaaggacagaaaaagaaaaaagcaagacatgctttacttggacatcaaaccattcaatattttatttttgatgtgtgtgtgttgtgggtgtgtgtgtgtataaatctcacctctaccacttcctttgtcatcacattttctaattcaaccctcctctacc

SEQ ID NO: 218762 - DNA, 218 bp, Homo sapiens
gtttgcttatcacctatctccctccactaaaagtaaggtccacgagagcagtcgcttttttgctcactgcagtatcccaagggactcgtacagtgcctgacacatactaggtattcaatagagaatttgctgaatgaatgaataaatcttcgctttccctaatttgcaaggtaggtttctcctctctgactttttttttttttttttttttttttttt

SEQ ID NO: 218763 - DNA, 262 bp, Homo sapiens
tgacagagcgagactctgtctcaaaaacaaacaaaaaaatcagaaaacaatagttctaaattctaaaagctcggatgaaaagctcaaatgatggcttttgagaagaatgaaaaaagctggccagctgtggtgactcaagcctgtaatgccagcactttgggaagccgaggcaggcggatcacctgaggtcaagaatttgagaccagcctggccaacatggcgaaaccccatctctactaaaaatacaaaaattagctaggca

SEQ ID NO: 218764 - DNA, 442 bp, Homo sapiens
accctgtctctacaaaaattttttaaaacattagccaggaatggtggcacatgcctgtagtcccagctactcagaaggctgaagcaggaagattgctggggagtttaaggtgcctgggaaaattgcccaggaggttaaggttacagtgagctatgatcatgccactacactccagactagggaacagagcaagaccctgtctcaaaaaaaaaaaaaaaaaaaaattgaaggtgggttggatgacctactatggtcatctggattttgtgtaaaatatagtcctatttcagttatttgtcttccaaattaagggaaattgaattttgaataaacatcagttgaaatgatcatttataattcagtgaaaagagtagagacaattgatgagtatttatggagtggcatctgggcactgaaagtgggaatttaaaagttaaaaaga

SEQ ID NO: 218765 - DNA, 500 bp, Homo sapiens
accctgtctctacaaaaattttttaaaacattagccaggaatggtggcacatgcctgtagtcccagctactcagaaggctgaagcaggaagattgctggggagtttaaggtgcctgggaaaattgcccaggaggttaaggttacagtgagctatgatcatgccactacactccagactagggaacagagcaagaccctgtctcaaaaaaaaaaaaaaaaaaaaaaaaaaaaagtataatatctcaaagtaaccattgaaaaattaattattcttgaataattttgaaggtgggttggatgacctactatggtcatctggattttgtgtaaaatatagtcctatttcagttatttgtcttccaaattaagggaaattgaattttgaataaacatcagttgaaatgatcatttataattcagtgaaaagagtagagacaattgatgagtatttatggagtggcatctgggcactgaaagtgggaatttaaaagttaaaaaga

SEQ ID NO: 218766 - DNA, 427 bp, Homo sapiens
atgctttctcccccaaggactcatagactcacttcacacccatctcaactggcacttcagccaagtaccttacaggtacctgacactttaaagcatgaagtcctttaaagtgatttaggtttggttttcttttgttttgcgacagagtctcgctctgtcacccaggctggagtgcagtggtgcaatcacagctcactgcggcctcgacctcctgggctcaagccatcttcccagaaagctgggaccacagacgcatgtcacagcgcctggcctttttgactttttgtcattatcatcaccaccatatttaaaccattagaagtaccatgtattaagacaaaaattaaaacccaaactagttgattatagttttctgacatcccccttgtaattatccatctggaaaaaaatgtaaagttatcaaagt

SEQ ID NO: 218767 - DNA, 409 bp, Homo sapiens
agctagaaatagatacttatcttttatttagtttctatttatgagcttttggaaatacaaaggtcattgaaatataatcatttcttataatccaccaccataacgcttagagtccattggagaaatatacatccaatataaatatacatccaatataaaataaccatacaaatattgtggtggggaagggtggcagggagggaggagagtgagagagagaagagggagaaagagagagagaaggagagagagaaaaggaaggacggatggatggaaggaaggaaaaagaaaagaaagagaaaagaaaggaacccccccccccccggctcccttttggtccttcgaagggcggaagaatgggtgtttttttttccaaaaaaaaaaagaaagaacaggagaaagaaaagaa

SEQ ID NO: 218768 - DNA, 189 bp, Homo sapiens
tcagaattctgtccccccacactcgccattaattatcatgcctagaagctttttagtaaaagcagcagttgtcaggctgacggaatctgacaggccagcaaggcccaattacacttgcgctatgtggcactttgatgtccgggaaacgaagaaagataggggcaaattgggtggcacattatgttaatg

SEQ ID NO: 218769 - DNA, 680 bp, Homo sapiens
agtgctgggattacaggcgtgagccaccacgcctggccaggattttatttttaattctcacagcaattctgcagagagaggtagtgagaggtttaatgctttgttcaacataatttgctgttaaatagccattcattggcagaaaatctgaactgttgtgttttccttcctgtgtcattcatggtttcagtcctgaagaggagcccactagagcccaacaggagaggagagtgggagaatccctcacccagaagttcacagtggtatcatttagtgacactcaggatgtctccagttattgttagaatttaaagttaggttcatccctgtgaggtccaagaaaatataaaaataaaataagggtctactagtattaaacatactctgtaatcacttttgaaaggaaaggagttagtggaaaaaatggaagaaccatagcgaaactaaaataaatatatgtagatatattgctggacgtggtggctcacacctgtaatcccaacactatgggaagctgaggcagccagatcacttgaggtcaggagttcaagaccagcctggtcaacatggtgaaaccccgtctctactaaaaatacaaacattaggccaggctcagtggctcacacctgtaatcccagcagtttgggaggctgaggtgggcggatcacctgaggtcagga

SEQ ID NO: 218770 - DNA, 565 bp, Homo sapiens
aacacagagaaacataaaaagggagttctatgcgtgcaagagagtgatgccatagttgaaatatcaccagcctctggaatgggccggggctgtctgtgctcagattttccagcaggtcgcgtgtgggtcgaatgctgagcagtaacctgggagcaatcagccaagccccctggctcctgcactccttcacatccagtatgagcccggtgaaatcatccaggcaatcagtgacaatgccgcccttctgctgaggctgattaaaagtggttggaactaatttaccttatatgactaattagggaactgggaatattacttaaaaagttgtttctgattaggtgtgtgatcgcccttccacccctgccagcattttctacgtggcagtccggcagaggagacacactggctgctgtcagtcctttattccaagtctcggcgtcttaacccattttgtgcctcggattccttcatcaagttgctgaagcccctggatcccatctcagaataatatttctaaatacacaaaataaagttcctaggattttcgaggaaaccaattctattg

SEQ ID NO: 218771 - DNA, 461 bp, Homo sapiens
agttaagtgtttattgagtatctattataaatgaagcagacttatgcttccagatgagatggagtaacaaggatgaggtttatgctactgcctgaaacaaccaaatatttgggcaaaaatatataaaattacggttttcaagacactggatttcagacaacgaaggataaggacagtgatccctgagatgggaacaagtgaggcacgtcccacaccgccccaggctcctgccttgatagatttttaggttgtagtataggcagaaagaacccaggtgggacccaggattcaaactggattagaatttgcaaggcagagttccacaggggagacagctgcacacagagaagaactacagtgatttatttgtagaggtcactcaactattcagcagagtacagatcagcatatttgtgtgagaaaactaccagaggttgggaaaagaaccacctgaaaggatt

SEQ ID NO: 218772 - DNA, 553 bp, Homo sapiens
tgggggaaataaactaacaaaggaattagaatggtactctagaacatatctattcaacctgcagaaggcagtaaaggaggaagagaggaacaaaagtgatatgagacatatagaaaataaataacaacatggtagatataaatccttccatatcaataattatattacatataagtgaattaaaaactcaataaagagcagagattgccagactgccttaaaagcaggatccaaatatatatggtctataagagtcacattctagattcaaagacatagttgaaagtaaaatgatggaaaaagatgacatgcaaacagtaataagaaagctagagtgactgtactaaaatcagacaaaattggctgggtgcagtggctcacacctgtaatcccagcattttgggaggctgaggcagacagatcactcgaggtcaggagttcaagaccagcctggtcaacatggtgaaactctgtctctactaaaaattagctgggtatggtggcaaatgcctgtagtcccagctacttgggatgctgaggcaagagaacggct

SEQ ID NO: 218773 - DNA, 690 bp, Homo sapiens
aggatggtttacaacccaggaatttgaggctgcagtgagctacgatcatgccactgcactctagcctgggtgacacagcgaggccctgtctcaaaaacaaacaaacaaacaaacctccttgtactaatacatatctctaacattacatgaaatcactggtttgacagttagctcttcttctgctaaactcctatatcccttaactgtgtaatcattaactcagcccttgtactgtttgaattttattttagtaaagcagttaccgtctattgagtgcttgctctgtgtcagatcctaggctaagtgacttaatgtatagttactctttgtaacaacccaatgaggcaggaaaggaaacctaggctcacatataagtagcaaaagattaagcagtaaaagagcaaggattctaacctaaagctgtctgacaccagaattcatgctttaaaacacttatgctatgtgtttagccttatttctacaactagattacaaattccttgaaggcagggattatgtctcatacttgcttgttggttccacaatactttgaatgcctgatcttaatatttagaaattgtttcttgattgatacaactgacatttcacacaatttagcgtgctgtaacatgaacacattggaatctctcagtaactgtgtgcatgtcttttgggaagctacctacattt

SEQ ID NO: 218774 - DNA, 884 bp, Homo sapiens
agcttctaagatcccagcttctgcagtggaaatgcctggttcagcagatgtcacaggattaaatgtgcagtttggggctctggaatttgggtcagaaccttctctctctgaatttggatcagctccaagcagtgaaaatagtaatcagattcccatcagcttgtattcgaagtctttaagtgagcctttgaatacatctttatcaatgaccagtgcagtacagaactccacatatacaacttccgtcattacctcctgcagtctgacaagctcatcactgaattctgctagtccagtagcaatgtcttcctcttatgaccagagttctgtgcataacaggatcccataccaaagccctgtgagttcatcagagtcagctccaggaaccatcatgaatggacatggtggtggtcgaagtcagcagacactagacactccaaagacaacaggccctccctctgccctcccgtctgtgagctcctgcccagcaccactcctgcactgcacttctgccgtccacatcccagcacactggcgacctgactagcagccctctctctcagcttagcagttcgctctccagccaccagagcagcctctctgcacatgcagccctctcctcgagcacgtcacacacacatgccagtgtggagagcgcctcttcccaccagtcctcagccaccttctccacggcagcgacctccgtctcaagttccgcatcctcaggcgtcagcctgtccagtagcatgaacaccgcgaacagcctctgtctgggtgggacccccgcgagtgcatccagcagcagtagcagggccgcgcccttggtgacctcaggcaaagcacccccaaacttacctcagggggtgcctcccctgctgcacaac

SEQ ID NO: 218775 - DNA, 254 bp, Homo sapiens
gtaattatttctatgcctttttggtggacatagatagaaaataacagattatgagttcatgccaatatttttgacttatgtttaggactacagagtcttcacatactttattggctttaaatctgtatctcctttctccaacgccgaaaaattgctagttcttaatgtagtagattctattaaagctgtgggtgacctgcccagactctacttacttggctggtgcacacatcccttggagtggtgagtattag

SEQ ID NO: 218776 - DNA, 465 bp, Homo sapiens
tcctacttgaagtctgtgtgtgagatggcagggaagggtgtgaagaccatcacctcggtggccatgaccagtgtgctctgcccatcatccagaagctagagctgcaaattgcagttgccaatatccgtgtctgtaaggggctagacaggattgaggagagactgcctattctgaatcagccatcaactcaggttgttgccaatgccaaaggtgctgtgactggggcaaaagatgctgtgacgactactgtgactggggccaaggattcatcacagggttgatggacaagaccaaaggggtagtgactggcactgtggagaagacccaagtctgtgtcagtggcagcattaacacaagcttaggaagtcagataatgcagctcatgagcagtggcttggaacatgcgctcaccaaatcagagctcttggtaggacagtacctccctctcactggggaagaactaga

SEQ ID NO: 218777 - DNA, 378 bp, Homo sapiens
ctatttttaatcctaaaccgtgtgtgtgtgtgtgtgtgtgtgtgtgtgtgtgtgtgtgtgtgtgtgtgtgtataaaataatacagtaagaggaaacctgggtggtcccttttctggtaccagcagcagattgaaaccattcaaacccctgtccatgggaataaattctcaccctagcatgccacctaccctcaataaaaatccaggcctggctccttttcttgcacattcaagccatgtcagatcaccttgaaaggccttcctacttacctcacaaatgtaatttatgtgagtagtaatttcttaccctcttaaagccacatctttgcaagtgactaacaattggtgccatgagcagactgttcagacattgcccacc

SEQ ID NO: 218778 - DNA, 668 bp, Homo sapiens
tttttgtacgtggtgtgaggtagacaccaaactttattcttttttatgtaaatatccagttggcctagaaacatttgttgaaaaaccatctctcaatcgtcttggaagcccacagacttgaatgatgtggcttgacttctcaagcttcatctcctgcagctgctgcttccccgtgcctcttcacaggtgacaccactctgctttgcagcttcttgaacatacaatgttctttcatgcctcaccaactttctacatactctcctctgccaggaaacactgtcatctctccctttctctgtcttaaatctggaagattcctctaaagtgcctaatgttttacctgaagctttttcctgtaccctcctgtttctattcctaggcagaagcagtgcctttcttcttggttgtgttggtgacatttgcctgtgcttgccgtagcatcattatacttaggtgactgtttccttggtcgcttttctctcagagccttagcacttaaccattatgccggccatgtagtagatgtttgttcaatgaagtgacagacttgaatcattgtcatgtgttcttaataaagctcatttttagtccatgtgtatattctgagaatatgtcctcctagttttttggtgatgaagttgccttttataaagggatataataggtgg

SEQ ID NO: 218779 - DNA, 165 bp, Homo sapiens
tacagtaatgactttccttaggtaccccaccaccaccaacgtcctgccctaacctgttgaacttcctctagctctaattttactctattgtatacaaatattttttgttttttgtcttattttcctgctgtatattgtttctacttcatttgttttgtttctccc

SEQ ID NO: 218780 - DNA, 430 bp, Homo sapiens
tgctagccttcttataggtgcaccctcatcgccatctgtgtctgttgactaccactaatctcttctcaatctctatagttttgtcataagtcaaccccttccttttcataaagggtttatgaatttccctgatgaaaaagtacaaaatgaggccaggcgtggtggctcatgcctgtaatcccagcactttgggaggccaaggcgggtggctcacctgaggtcaggagttcaagaccagcctggccaacatggtgaaaccttgtctctgctaaaaatacaaaaattagccaagcatggtggcacgcacctgtagtcccagctactcaggaggctgaggcaggagaatcacttgaacctgggaggcagaggttgcattgagtcaagatcacgccactgcactgcagcctgggtgatagagcaagtctccatc

SEQ ID NO: 218781 - DNA, 783 bp, Homo sapiens
tcctggaccctctgctgtgtgtccctttgcatcctggtagcaaagcacacagatgctggagttatccagtcaccccggcacgaggtgacagagatgggacaagaagtgactctgagatgtaaaccaatttcaggacacgactaccttttctggtacagacagaccatgatgcggggactggagttgctcatttactttaacaacaacgttccgatagatgattcagggatgcccgaggatcgattctcagctaagatgcctaatgcatcattctccactctgaagatccagccctcagaacccagggactcagctgtgtacttctgtgccagcagtttagccacagcgctgcagaatcacccctttcctgtgcagaaaccctggtgtttctccttctccttctacctcccagcagtcctgggcaaagtctttcctgttcctccctccccatgagaaaaagtggttttgggttgtgacaaagacagaaaatgaggtttcaacataggaaaccttatgttgatttgaggattatgaaatgggttttgaggattccttaaaaaattgtctctgctcaaaacacataggagtaagataaaccttggctactgacactggagatttccctgccctcctgcatttgccatcccatgagaatggtgggggctcttgagaagggctgcattttctgaactgtgaggccctcttcattctctcctaactctaagctgcaaacagaaatttccctcacacgttttctagattgtaaaagaaagttcttcttta

SEQ ID NO: 218782 - DNA, 502 bp, Homo sapiens
aggttaagagcatgttaaatcttaggccttaacccccatgaattcgaggaatctggggaagaatcacagatcagccttcaccactgagtttctagaacaccagagcaagagagtttcacttgggtctcctctgtagaaagagacctgtcctcaatgaactccaaggcggggcctgtttacactggacagctttcctgaagcacggtcttgctattcttattgtagtacaaaaaagactagatggataccgttgttcacgaagaagtaccctttgctcccccaattttagagaaaagatccctgccttcttcttaaatatctctagattaagagattttatcattttccctgaactctgaaaattgtttaaattccttggctctgtcctacatctttttgtctacctttaagtccctgtcatctaagttttattcatttcactggagatgaacaatagctgactttttttttaatataaaagaatcttgaagtcaaattacat

SEQ ID NO: 218783 - DNA, 1138 bp, Homo sapiens
cggtccccttccgggctgtgggagctttgttcttttgctctttgcaataaatcttgctgctgctcgctctttgggtccacattgcctttgtgagctgtaacactcacggcgaaggtctgcagcttcactcctaaagccagagagaccacaaacccaccgggaggaacgaacaactccagacgcgcggccttaagagctgtaacactcaccgcgaaagtctgcagcttcactcctaaagccagcgagaccacgaacccaccaggaggaacgaacaattccagatgcgccgccttaggagctgtaacactcaccgcgaagatctgcagcttcactcctgagccggcgagaccacgaaccccaccagaaggaagaaactccggacacgccgcctttaagaactataacactcacggcgagggtccacggcttcattcttgaagtcagtgaaaccaagaacccaccaattccggacacagcaggatcccacccacagaaccgccaggtgcacagctgcatatcctcaggggaaaactcccctcccctgccaccttactgataggcttcacttcccagagaactttcccaatcctgtgcaatgcctgagtggtacattgtattctatgagaatggcgcccccgcctccagagttgtgcaacaagacttccatgaatcaaagcccatcgctggctgcctcctctagccctgcatagcccaggtacatctgaaaggagtgagaagtgttttgagggctctccctgtctcttcctgcacctctctcttgtgatcccagaagctacaacctcagcccagattagcaggctgaggggtcaggaggctgtcactggagctgttgagctcatgaacacgccgaagttgctgcgctccagaaatgtggaagttggaatgaagagccaccactgctgccaccaacatgaagcttgaccaagcaagccaagaaaagatggccaagagcctctgccttccttctgccttctgcaacgcaatggtgagctgcacatccacaactgaagggagtctgggaaatgcagagttaaactttctagcctctctaagctttcaactgttacagaaaggcaacccaggaggagactggaataaatgctgagtgccaatttcc

SEQ ID NO: 218784 - DNA, 445 bp, Homo sapiens
actgtactgtgtctctgtattcttaaggatagataatagctacacaaagtttaacttcacagaacacctacagagaaggtaggattcaagcaaaatggtcaatgctggatcctgccctgcttaataatttgttcatgtactcatttgtttgacagatattattgagtaccagataccgttgcactacagcaatccttataaattttaataactcactcaaagttctcagtatgtaagaaaccgtattatttatctatgcatccagttttactccatttgaattacttattacttctcaggaaatcagttttaagattcatgatccttcattctgtactggctgacgagatgaaaaaaaagaaaaggattcatgatcttgcataatagcccgtaaccactatcagatgactactagcttactagctcactctctactggatttgtt

SEQ ID NO: 218785 - DNA, 557 bp, Homo sapiens
gtgaaaccccatctctactaaaaatacaaaagattagtcgggtgtggtgtcgggtgcctgtaatcccagctacttgggaggctgaggcagaagaattgcttgaacccaggaggcggaggttgcagtgagccgagatcacgccattgcactccagcctgggtgacagagcaagactctgtctcaaaataaataaataaataggaaagacagaagatctgtgttcttagtttttgtttagttcttaatgccttaactgagatataacttgcatgtatacaattcgcccatttaatgtgtatgatcaatggtttttggtctattcacagatatgtgcaaccatcacttcggtcagttttagaacattttcatcacctccaaacaaaactccaaaccctttagctgtcacctcccatcttcctgcccctgcccccacctcgcaagctgagccctaagttcccactaatcttctttctgtttctatagatttccctattctggactttcatatgaatgaatcacataacaggaggtcttttgtgactggcttctttcactta

SEQ ID NO: 218786 - DNA, 721 bp, Homo sapiens
agacactattctccagtttttgaggatttacttatccatttactcttctggtagacagtttggctgccagaaaaaaatatagtccttattatattgatatgagcattgacctttccataacaggattaatgaggttttctttgcccctgtccctcccaatttttaaaatattgccttgtcagtcaacttaatgagtttgtgcatgtttaatgttaaatggattctagttgtatcccctagaaacattttaacaaaaattgtgttgataggacaagtttctgtttatttctaactagggtctcttaactaaatgtacataacattagcccaagagttgatcttctggttttataaagtagccacttgaacttagctgagttgaattaaatctaatatttataataatttagtaatggttttgttcttagactataagagaaggaaccaggttaggaaggggtaatgaagtaacagcaggaaggtatccacattgaaaacagttgtgatagctagagctatggcctctattcttgtatcttctgcatctaagtgccctgtctgtatcgaagttttaggaggccctaaggaaacctgcttgggcattctgattccatgattacatttgtgctgccagaaaacatttcccattgcattttagtgatggagatttaaagaaagccaattactgtaactcccttaaataaaaacatatttaaaaatt

SEQ ID NO: 218787 - DNA, 509 bp, Homo sapiens
ctttgtgacttgtcttttgactggaacctgccaaaaagggtgattgtgacatattgctggacccagcacctaggtgatgtggctctcctttttttctgggcctcacatattttgggtattgtgatgtatagctgggctcaacacctagcagttggggagctcctttcttgaccattcccacaaatgacatatctctgctatgaccgcctatgacacatgacctaaatatgtgacccttcttttctgcctgtaccctgctaacagagaagattgtgacaaattgctaagtgcattgtatcttgtgctaaccttctatctcagcctgtgaccaagaatgcctaactgccggggaatgcagccctgtaggtctcaacctcaatttgcccagccactattcaaaatagagtcactctggtttaaatgcctctgacattaagatacactgtaaaattatgaaaaaagttgatttgaattttagcaaatgagaaatgaaataattagaatgggct

SEQ ID NO: 218788 - DNA, 219 bp, Homo sapiens
gttcaagtggcaggagatgatatagatgaaaggaagtcttgctaggaccattgaatcgccttatgacctaaccaaaaggtctggccaaaaatccagacagatcctgatctggacagtgccctgcaggccagcacccagcaccatcccagtgccctggacctgggagtatacagcgccaagaccgatctgcagcctggcaatgtgaatggggcgtttatc

SEQ ID NO: 218789 - DNA, 497 bp, Homo sapiens
gctttaagggcaggcaaacagtgtttcaaatggatatctaagacattatagctccaagccccagacctgcaacacctctgtctcctacccttggatgattcagttctacagtttggtttatatggtccccattcacctggagctcttccttaactgatctattatgtataacaggatggctcacccggcagcaattctgcaatctctttctcatgaaatattttgcaagaaagctctccctttgacaccctattcagcataatattgtatcatgtgtagattaatattgcatttgttccatgatcagttatcttgcaaagtcaattattcagaacacagccaagaatcaataggaagatgaaaaaattatctgaacaaccaagtaatactcttacagaatgttactcaaagaagaatctctctggccatttctcaggacttatttgcttctattttagatacaattcttacatgcttaataaaccaacttgttattc

SEQ ID NO: 218790 - DNA, 567 bp, Homo sapiens
tacacgggtatactaacaagtatcatttatagatgtttatttagactacatctccccacattataataaactttgtggttttttattgctttattataataagcactttaatacaaatcatttttctaattttagtcagtatcttaaactccatgcttagtcataaattaagaaatgaaaatatgtacactgaatcaagattttaagttcactcacccccaccattcctcttgttccttaatatcctggacctttttgtatgagatctgggaatctgaggttaggacagttgagaatatgagagaatgtaaccacaaattgctgattagaaccagagttacacagcaaagaagaggtcaaatccactgtttctctccattgttgagaatttctcatataatgagggacacaataaagtctaactttttatgcattcaataaatgtttactgtttgttgtatgataagtactggttccatatgtgagtggaataattatttgttcccatgacacattcagtatagtagaaaagacccagacaaataataaacaaactaacaaacagtt

SEQ ID NO: 218791 - DNA, 649 bp, Homo sapiens
gatactattgacatttggagctagataattctttgttgtgggggcctgttctgtgcattataggatggcatccctggtttccagcgggtagatgcttataatgtctccttaattatgattatcaaaaatgcctctagccagttgtccactggaggggaaaaatagcccctagttgagaaccacagtaagtcagagtcttttttttcttttgtagagttcagtgatgacgaagtttgacttacctggtttaacaaaaaggttgtgtttattccatagatggtatacccaaggaatattaaagaaataattgagtccatgtttagtctaaagttttagagggaatagctgcatttttgttgttcttgtcattctcctccctccccccagcaataaattgaatgtagggaaattgacttctcgggttttaagaaaaatgtttgaaacataagtcatttgggcttttttccccagaatgctgaaaacatgggattctcaaagtggtccctagaccagcaaaatcagcatcacctgggaccttattagaacttagcgggctccaactccagacctaattagcactgtgagggtaaggcccaacaatctgtgctttaccaagtcctctagtttattctgctaatgaaaaccacct

SEQ ID NO: 218792 - DNA, 473 bp, Homo sapiens
ggatgacctcattccaaagatctgcagagcccagataagcatcccagggttctggcagagggcccctccagggacaggaaggggacaggaagccggctttccgtgtctgtaccgccttccttgggaaggataggacacctgtggccatcaagtcatgatgccccatgctgtctcccgccaactccacaagaaaggcaaatgagtgtcacatcgcccccagagtcatgactttgctgatcccacatgggccccctagagggcttttccttttaggtcttccccatagatttctcatattttcatttaaacagatttgtatgtaattcttgaatgtttcctttctttcatattctcaaaaaatacattaagactagtaagaataggtaaaaaaaaaattggtacatctcagaagataatatgtgagactaatagctatagtttgcaataaagaaattaaatgaggtttttaagca

SEQ ID NO: 218793 - DNA, 724 bp, Homo sapiens
ttcaataaaactttttttctctaaaatgttttcctggagattagaaaatatctattgattataatttatgcccctcctctgttcctgctgttctgtcttgttactccccaggtggctcaataaaaaacaatttattgaacagacatgctttctgatgtgataccagaaggacttgtgtccaggtctaattaaaggacataagcaaattatgcatgaatgactggaactaacaattagacacatacttcaagagttcagcctgtggatcactaacgaatttgaaggataacccaagttgtagaatgttattctgattaggttaaattactaggttaacttgtgcagttatattataaagtaataatataactgtaaaataaattatacagttatatataactgtaaagtaaaattgtaatattataatataacttgtgcagttatattataaagtagtcaattaattgactactttagaatctcagggtgtttcagtaataattttttcagtcctttccatttccttcacctgtctccatgccagcttcatgtcaagcaaggcattattgtgtaaggtgtaattattgggtaaagtatttctgctacaggttgagtattcaaaatctgaaacgctctaaaatcatgaacttgttgagcaccaacatgatgctaaaaggaaatgcttattgaagcatttcagaatttcagattagagatgctgaac

SEQ ID NO: 218794 - DNA, 424 bp, Homo sapiens
tgtggtgggtctgtttggtgaaactttgaaagttagttatagacatgacatttcacacctaaatacttcaacatgtaacaactaaaaacaaagacatgctactatgtaaccataatatctaatcacacccaagaaatagagcggatgcaattttttttctcatatgcagtccgtgttaggatttctccatttgtcccaataatgtcctttatagctgttttaaaattcagaattcaattaggtgtcatgtctctttaatctcctttaatctagaatagttgcttggccttgttgtcttttatcggcattgcatttttgaggatcccaggccagttgttttgtaaaacgtcccacagtctaaatttgtctgattgtttactcgttcctggattcatattaaacgtttttggaaagggaactcatg

SEQ ID NO: 218795 - DNA, 282 bp, Homo sapiens
gttccaaatttttcaggagctgctcaagagtctggcttctgtcttgcttttcttttcttttcttttttattattattatactttaagttttagggtacatgtgcacaatgtgcaggttagttacatatgtatacatgtgccatgctggtgcttttctcggagtgctgacagaactgatcacagtctagaagcctgatggtcactgaaaataaatattattttttaaaatttcatttttctttcatttgaatattttattgttaaaaattccatttatattga

SEQ ID NO: 218796 - DNA, 526 bp, Homo sapiens
agatcgcgccactgcactccagcctgggtgacagagtgagactctgtctcaaaaaaaaagagaaaaatttatagtgattacatttaagtctaagtacaacttatagaggtttgtttatattttaaataatattttatatttaagaatagctagctggtaaggaattttgcaactttaagctgttggtttatttatcttttaaattagtgcacctggggactaacccattaatcagtcagatttctcttaaacattttttaggggagagggagaggagcgttgttctttttggcttcataactttcttttagcagcatttcgttcatctggctttaatttgtagaactctagcggtaatgcactgggtgttcttttaagggaaggcccacaccatcagttgggcagaggtgctgattttagccctgttcatcatcagctactaatctgtagtgccttagagaataatctgttcttccccccaatcccggcacaagagacactgttagtcaggaacttagaattgatt

SEQ ID NO: 218797 - DNA, 170 bp, Homo sapiens
gttgagcaaaaaggtgaggatcagaggggcaggttatttgtccaaggctatacacttggtaaatagcaaaacaagtgggaacctcggctgcagtttgctagtgcgtccgtactttactatgagtcacctggggatcttattaaaatataggttctgatttggtaggtctg

SEQ ID NO: 218798 - DNA, 179 bp, Homo sapiens
ccaggagagctaatagagcaggagtgtggagcggctgctaggctgcatcagggaccctctggccagctggtggtttgaagtaacagcagccagcgtgcttaattgtgtatctccagctatttccagctgtgctgctgagttggatttaaccaggtttgtggttttaacaagtgaatacc

SEQ ID NO: 218799 - DNA, 511 bp, Homo sapiens
gcagaaaaattgtagaagagtggcttgcaattccttacgcaacagaacagacaaaatgggtgatctttttattcaagagagactcccacattcacacgagtaagataggtggggtgatttatagcaatactcttgaattactctaacttaataaaaattaatgaggttcaggccgggtacagtggctcacacctgtaaccccagcactttggaggccgagatgggtagatcacttgaggtaaggagctcgagaccaacctggccaacatggcgaaaacccatctctactgaaaatacaaaaattagctgggtgtggaggctcgtgcctataattccagctactcgggaggctgaggcacgagaatcacttgaaactgggagggggaggttgcagtgagatcgtgccactgcactccagcctgggcaacagtgtgaactgtatctcaagtaaacaaacaagaaaataatagtgaggttcaagactttggtttaaaacttgtttttatcatta

SEQ ID NO: 218800 - DNA, 289 bp, Homo sapiens
aactatccatttctcccttcagttctgtccatttttgcctcatgtgttttgatggtctattattaggtgcataagtgtttataagtgttatatcttcttgctctactgaaccttttattagtatataatatccttttatatctcttgttaccctttttgatttaaaatctctattgtatgatattaatgtagccattcttactcttttttgcttgctatttgcatggaatatctttttgtaggctgtcactttcacctcatttacatctttggatctaaagcaaatctc

SEQ ID NO: 218801 - DNA, 691 bp, Homo sapiens
tttaaaatttacaaagaaataatggatttgaaattcccaaatttattgaaaaacattaaactgcacatccaggaagctcaacaaacaccaagcaggataaatgcatagagatccaaacatagatgcatcattataaaagcattgaaatccaaagaaagaaatggagaaaatcttgaaagcagtaaaaggaaactgcaggctagaagtgaaactaatacaaaagtattaactgctgatttctcatcagaaaaaaatgaaggccagaaggcagtgggatgatatatacaaagtactcacacacacaaaatccttcaacccagaatcctaaatccatcaacacataaaaaaatgaagtgaccccctacctcacaccacttacaaaaattaactcaaaatggattaaagtcttaaatataaggcctgaaactataaaaatcctagaagaaaacatagtaaagctcttgacattggtcttgcaatgattttttaaaatataacaccaaaagcaccggaaacaaaagcaaaaacaaagaaatgggaccaaataaaattaaaaagcttctacgaaagaaaggaaacaatttaaaaagtgaaatgacattctacagcatgggagaaaatatgtgcaaattatatatctgacaaggggttaatatctaaatatataagaaattcattcaactcaatagca

SEQ ID NO: 218802 - DNA, 210 bp, Homo sapiens
caaccaggccactaaccctacccactgctcagaaatcttcccacagcctcagcctggccccctcttatccatcccctccatacacacttgcctcagctcctcaaaacagtccacagccatcctccttccccacctttgcccctttcttcccttcctaaggaaatattggcccccttctctccaccaggctgaacccactcatcctgcaaa

SEQ ID NO: 218803 - DNA, 458 bp, Homo sapiens
ctcgggggatttcaggtgtcagtcttccttgcacacctcagtttccttctggaaacagtcggatgcggtgccgagatccatcctccacgcgctgtagctcctctctctgccaggaactcggcttgtcccaccgtccctcgaatctgcccttcaggccgttccccacggggacagatgaatcgagcatccggagagacccctcgatctgggactttgggattgtgggacgttctttcacagtctgcagaggaatgcagctcagtcagtgccttcttctgagaaactccctgtgcgcccttcctagtctaactccagacccccgccctctctcctgagcttttttttttttttttttttttgccacttcccgcatccctctctcccctcttgttctcaactccagcctttgctctgctcacattcatcccttttctggctcccagatgtgatggggcagc

SEQ ID NO: 218804 - DNA, 725 bp, Homo sapiens
ccatttaaatgctatagccatttattgatggttatagcatctggcttccaccattggtaaactcaccacttcatacagcaccaattacacatgcttacaagcaagagactcaaaacaaaacaataaataaaagaaacatgggggaggcaacttcttaactgaactttcatttttctgtaacattatattatataaaccttctgtagcacctacagaaatctaaaaatagagattagaatctattgtggcagaaaataagtttgtcactacatcaaccagccacatgggagttaatctcattaacttttatattgcaggatgatgcataccttggagagatgagttcagtggtaaatgacatgaatcttggaatttctttacattaatatctacttcttctgaaacttcagtttttgaatggaattaaaccaacaagttctagttgtgtatagaagaaaatttgcataagtctatagaagtctatataagaaaacttcttaaacatagttcatgagcagcatggattagttatccttcagctggaaggtttcttggagaacttaaaagcaagggacttcctgcagaaatgactgcaaacatttctccttttatgggctagcatcctctatggtggttttgtaccactgtcttagatctgatggaaactcattcccagaattccctttcctaaatcgttcttcattccagttggctacaaaggaaat

SEQ ID NO: 218805 - DNA, 671 bp, Homo sapiens
ccatttaaatgctatagccatttattgatggttatagcatctggcttccaccattggtaaactcaccacttcatacagcaccaattacacatgcttacaagcaagagactcaaaacaaaacaataaataaaagaaacatgggggaggcaacttcttaactgaactttcatttttctgtaacattatattatataaaccttctgtagcacctacagaaatctaaaaatagagattagaatctattgtggcagaaaataagtttgtcactacatcaaccagccacatgggagttaatctcattaacttttatattgcaggatgatgcataccttggagagatgagttcagtggtaaatgacatgaatggaattaaaccaacaagttctagttgtgtatagaagaaaatttgcataagtctatagaagtctatataagaaaacttcttaaacatagttcatgagcagcatggattagttatccttcagctggaaggtttcttggagaacttaaaagcaagggacttcctgcagaaatgactgcaaacatttctccttttatgggctagcatcctctatggtggttttgtaccactgtcttagatctgatggaaactcattcccagaattccctttcctaaatcgttcttcattccagttggctacaaaggaaat

SEQ ID NO: 218806 - DNA, 757 bp, Homo sapiens
tatggaaactgtcatataggaattgtattttatttccacgtagaagtcaatttacaagcaaattgttaggatcacatgaatttgacattaattttacaattttaataacaaatttatttttagaagccatctcgttatgatttctctgattattaacttgattccataattgactttgcaatctttggttagccaatacacaccctctaccatcattaataacatttttgctccagcttattaagaaatgatgctcatctcatttcatgctctggaagcttgatgtcaggaaaggcagctttaattataagctttaagaacagaagcttaatcccaacttggatttagcaaatttgaaagcactgttaaggctaccttcattcacagttacctggatattgggtctcctttttcttaaattaattgttggtatacctacaccaataggctgaagcaacagaaaaatggtaattcatcatagtacatgtcaacataggtacgggttctatcctataatcaattttcgtcagatatttccttgattgcaaaaaggtctaaatgatagaattcaaaatatttggtaggtatggagttcatgagtcaataaaataagaatgtaaaaatatcttcaatgaatacaaactgttacatttttaagaaaaatgactattatttttctttttctagaaaagtacgtatttgggaagtgggaaaaatggttgtttgtcccagattacttttccattgatttgacaaa

SEQ ID NO: 218807 - DNA, 326 bp, Homo sapiens
tgcttctacctaaggcagagcctttactttaaaattagagctgtcacgctaattcaaatggtaatcaggtatctagaaccatcaactccatagcaaagaatacgtctctatactcctaaaataattacaaatgtccatgatattatcattcctactttccttctctagctttcatagggtcaagcttggatgcattttgcttcacccaattcaacagctttcccaagtaccctcaggtggtaatgccctcactcaggccaccaagagaatagcgtctgaagctgagcagtttacctaccaccaaggtagaatgcttcacccactgc

SEQ ID NO: 218808 - DNA, 404 bp, Homo sapiens
ggtactgtggggcttacataaaacatcttatagttgtaacaaatataaagttgatattttaagctgataacaactttaacttcaattggatataaaactctattctttcacctcccttgccctttttattattgtcatatagttatagtgttttttatacttttgccttttaacttgagtatcagaattaaaggtgatttatacacagccactaaaatattacagtattatctatttttctgtatatttacctttaccagtgagctttatggtctcataataatttctgctgctgcctagggtgttttcatttcaacttgaaggactccttttagcatttcttgtaaaggcgatatagtggtaataaactccctcagtatttgcttatataggtctttatttct

SEQ ID NO: 218809 - DNA, 442 bp, Homo sapiens
taaaatctttgagataattttaggaatttggaattagaccatatttgttcctggggaagtggattaattattataagcttactctgaaccattacaggtgtctttgacttaccttggaccataggatttctctggagtatctgcataaagtccatctataatacaatgacctggcctcaccttacccagcctcttagtatccttcagatatgcagagctaggccgagctcagtgtcttctttattagcagctgcagattagggagtgcatctgctgtgttatagtcacttttggaagcataatgcaatggatttatgtattgtcctgtttaaggacatttatattgtttcattttaaaatttttctcatagaaaatcattctgcaatgcacaatcttgtacatgtcttcttgtgcaaagtgtgagaacagcttctggatgta

SEQ ID NO: 218810 - DNA, 599 bp, Homo sapiens
agagacagggtttcatcatattggtcaggctggtcttgaatttctgacctcaggtgatccgcctgcctcggcctcccaaagtgctgggattacaggcatgagccactgtgcctggccttgcataccagattttatgagtaaacatttctcttattattgttttccagtttcatattagtgtatttcttcagtgtaggtttcttaacatcagtttattgtgttttttggttttacctatgtattataatttcagacaattttcaattctgtatgctttaattaagagataattaaatcccatattgggctttaattggccgggcacggtggctcacgcctgcaatcccagcactttgagaggctgaggcagatggatcacaaggtcaggagatgagaccatcctggctaacacggtgaaaccccgtctctactaaaaatacaaaaaattagccgggcatagtggtacgcacctgtagtcccagctactcaggaggctgaagcaggagaatcgctcaaacccgggaagtggagattgcagtgagccagatcgtgccgttgcactccagcctgggcgacagagcaagactccatctcagaaa

SEQ ID NO: 218811 - DNA, 535 bp, Homo sapiens
ttgctcacagaattgaatttttttgtgtattatctgtcacttccttccaaatatcagtttattaggagttaaactggaattgcagaacaagattgcttctttgggcattattaagaatacaaaatcaatgccgtgtgaagtatttgagtgctgcaggccactgatgagcttttaaatgagttatggggcatagaaatcaggttaatggggttaacgctctaatttacacagtgtcccaaggtaactgacttcttaatatatttaatgagatgtaaaaaaaagtccaccaccaaagcaaacttatatgtttctaaatgcacacataatgtacaggtaaatttacagacaactttctggatggatagatccaaaattgataaatgcagttagctctggggaagagtgagattgagtgctggtcaacagagatgtcagttccatgtttgttatttacagtttctagagtaaaagtgtatgcgtgcattatcatttaaatgaaaaataattaattaataaaaaattgtattaacaactc

SEQ ID NO: 218812 - DNA, 240 bp, Homo sapiens
aacacagttacagccacacacagagaataacagtcacacacagtcacacacacagaataacacagtcatcgacaccgaggcacacacggcttcagttgcttgcctggagtcacccatgcgatttgcaataccagacacacaaattggtagcacggggaagcatctgccatagacgacagattccacaaacatgaacatcagaaaccatgcctttactactttccattcacacctcttccg

SEQ ID NO: 218813 - DNA, 460 bp, Homo sapiens
tttgatttagaagcataatgcgacaattcttgcacctgagtgccgtgggacccattcactccttcctggccccaagcagctgacgcaggaggcctaagttttaattgatatagacttgaaatattcaaagagctaagctatcaaatccatcttgttctctgcatttttcttataacacagagtatgccccagtgttgaataaccatgccggggacagcaggaaagggactcacgggttgtgaatttacatgtgacgtcagaaaggctctgtagacaggaggcgggatgtgcgcctggccagcaccccccaccccgcctccatgcgcagtgattacaggctggatggcacgtagtgagccaggcgaggtcacctttgcacaagcggagtgacttttcccccaatctcataccagtctggcagcatgtatgaaaagaacggtgagagaagctgttttatgca

SEQ ID NO: 218814 - DNA, 472 bp, Homo sapiens
cattggcttggtaaaagttgaaaccttaagaaagcagggtggctcaacttcattagccagcaggaaatgcaaatgaaatctacagtaccacatcaataccatctgacatccatcaggatggctaaaataaaaaagactgacaatgctgtgtgttgtgagacggtggggcagctggtatgctcctagactgctggtgagagtgtaaatgggtagattcagtatctatgaaaaccattttcagtatctacgaaggctgaacctatgtaatatcctatagcctagcaattccgtttttatagtccagtggaaatgtgtacatttctgtactgaaagacatatgcatatagtagcattatttataatggtgaaaaatgcaaacaactcactaatgtttggtgtactgacaaaatgaaacacgcagtagcaataaagaagaatgagcttcaatacatacaatatggatgaatctaaa

SEQ ID NO: 218815 - DNA, 557 bp, Homo sapiens
tgtgtggcttggttcagctgaaggcagttttctgcattcacctagagcttctgcaaacaaaattataccagcaaatgtgaaatccacgttatgctcaaattgtcccctaatatgtcaatcatgttgaaacaaatacgggttttacaaacaagtgttatacagaactgagtgtataaggtgatgattgccgtgaaaaacagcagcaggataaggaaacagaatagggattcttgttttatttttaaatatgttattctataccactgtattcattctatgccactgttagtaaaaaacccacgtatcagttgcatttatgtaagagcctgcaatcatttctctttcttgttctcatgtcattcttcttccaccttcagaagtgtgtactgttgacacatggtgcttcgacactatgctcactgcacacagcccctctatggagcctccaggtacttctactattgttcactataataaggcaaggtggctcgatgcattgaaatggcagcagaggttttccaatgcagaccccctccgcagcatccaccttctttcta

SEQ ID NO: 218816 - DNA, 696 bp, Homo sapiens
aatagagtaggactgcaggcagcagtgaggtcccacttgaggttgctgagcataaatttaaggtagccccaatctgtgtgacagggtgatttttttcctacagtgcccaacagcctaggtaaaggaatggccaagacagacagctggattcagggtatacactctaaaatttgtcaggcagataaaccagaagaataatgaagtaatggagttgagaacaccggtcagaggccaatgttatgagtcatggagtccttcctcagtagataaggaataggggacagcaagcttattatagataaagagaaaggagaaagcagaaagactgcagatcttaataagtttggaagataaacgtagtgaaaataaccaaatgaaaagaattggaggacttaaaagtcaagggttcagaggtgctgtggtttgttgaagacatggcctaggggtggccatgggattgagtgattgaagcacaatggagaaggtaattggagatggaatcaagaaactgagaagtcaggtatgtttcacagaaatacctagatagctaaagagggggagggatagcattaggagaaatacctaatgtaaatgacgaattattgggtgcagcacaccaacatggcacatgtatacgtatgtaacaaacctgcacgttgtgcacatgtaccctagaacttaaagtataataataat

SEQ ID NO: 218817 - DNA, 139 bp, Homo sapiens
cttctctctttctctttcttcttgcttgctttcctctctttctcctaccccccacctcagtctttctttctgtctccctctcacttacatgaagggacacatctagcttaggaatgtggcacagagctaattagccagg

SEQ ID NO: 218818 - DNA, 448 bp, Homo sapiens
tgagcaagggatattgaaagctctgcctgtgattgtggaccgggccatttttctaaacagtgctatcagtttttattttgtatagtttgaggctgtgtttttaggcgtgtaaatgttccaggctgttaggccctccttgagcctcttcttatgaaatgatctttttatcctttgtaatgttttgctccaaaatctactttaatattaataaagctattccagctttcttttgattaatattaatgtggtgcatttttccatccttatactcttattgaccttgtttgtctttatatttgaagtgtattttttgtaggcagcatgtaattgggtcttgcgttttcctttggattgggaagaccatgtacactgaatgaggttatggatatggttgtcactgaatctgtcatcttgatatttgtttgctatttgtccagtctgttccttg

SEQ ID NO: 218819 - DNA, 385 bp, Homo sapiens
aaggggagaagagaaagctctttgttaaaaatgccaggtaacaaacttagaaggaatgacagaggaataacatccattttgagtcaccagtgccataactgatagagaagattatcagggggctaaaatcactggatgaaagaaaactatatgaagctttttaacgtagcacaatagataaaagtatgaaaacataaattagaaaaaactaaaaatcataccataagggatggataagttagaatacaggaataacaggccaggcatagtggctcacatatgtaatcccaggattttgggaggccaagtcgggaggattgcttgagcccaggagttcgagaccagcctaggcaacatagtgagaactcgtccctagaacagaaca

SEQ ID NO: 218820 - DNA, 529 bp, Homo sapiens
tctgccagtcgagtttgtcttctccaccgtccttgctatcagtctctagctttcattttccccttcttggtggtattttcgtctgggcagagttcattgcaacctctttagaagctctcttcactatcaatctgcaggaccactgtctcttcctgggctatcctgggtcactccaggtcctccactaacatgtctgtaggatccactgggattctggtttgggacctcattcgtagtacccactgaaagtgccagtatacagccaaaagtgtccatagtaggtataatcatctaagtggctgtattaaggtaatgttcatggacgttcatttgacccattacacggatatagaaatagacttagatgggctgaataatgaacaaaagggcacatggcatcttgagtcaatacaagcgtctcactgtctctagggtcctgtgtaacatatccccatctccaccaagggcccggctatgtgttcactagatacatgaatgaatagttttcttttctatcctcctgcattct

SEQ ID NO: 218821 - DNA, 214 bp, Homo sapiens
ataatcagttgactttaagtaacagatgttactctatataatgtgggtgggcctcatccaatcaagtagaggcattaagtgcaaaaacaggttttctgggaaggaattctgtatcaagactgtaacatagaaatcctgcctggactttcagcctgcttatctacccctatagattttgtttattttttttgtgacagggtctcactctgtcact

SEQ ID NO: 218822 - DNA, 909 bp, Homo sapiens
ccacaccagctctatttcaggggtgagagtcagagagcactgcaatatgtgcttcatgggatttcgattcgaagatcctagaccagggagacactgtgagccagggatacaacaaaatactaggtaagtcactgcagaccgacctccctgcagtttgggaaagaagctgggtttgtggagaatcagagcatcttgacatgactgctgacctaaagatccctggcattggccagggatcctgtggaacctcttctagttcaggggtgtgagcattagactgccagttgtctagtgacatctgatgcttgctgtgaacttttaagatccccgaatcctgagcacctcaatctttaattgccctgtattccgaagggtaatataatttatctggatggaaattttaaagatgaatcccccttttttcttttcttctctcttttctttccttctccctttcttctttgccttctaaatatactgaaatgatttagatatgtgtcaacaattaatgatcttttattcaatctaagaaatggtttagtttttctctttagctctatggcatttcactcaagtggacaggggaaaaagtaattgccatgggctccaaagaatttgctttatgtttttagctatttaaaaataaatccatcaaaaataaagtatgcaaatgtatcttttaaagttaaaaaacaaaaaacaaacaacacaaaaaaaaaactttgggtggggcggctcggggccctcggaaaagtttttctaaaacacttcgtgttggggggcgggggccacgtatggtagtgtgaattgggccaaggtggtcccaaagggagaccgggcaggatggggttgtgttttccccattaaaaaaggccggggaaccggcgttttgacacaccgaggggttgg

SEQ ID NO: 218823 - DNA, 296 bp, Homo sapiens
tgcccgcatatgaatatcccatcaacaccacaaatttgacaaaatgtgtcttccctcaaactcttagtgaaaagcatcacatttaccggccacaaacttggaaaccatcctccataactcctactccttcctcagatttcatctcatcttagttcctcaaaatctctctaattaaacctccctctccaaccctcgttagtggggtcctctttgtcccttcccagtccctcctcttggacactctaatccatcctctacattcttgctgggctgaacttcttcttcttctttttttt

SEQ ID NO: 218824 - DNA, 484 bp, Homo sapiens
attgtcattcagttgatttgaactggggctctcacatttatattttttaaaagctccccacatgattctaatgtgtagctgggttaaaatataagtgaataccagtggtttcagtcacttttaaagttctttcccagaatgcttccagctgtgcagcttttaactttatacttcaaagtctttaccttagcagattcaaaaaaaaaaccttgtacttcctgcagatgactcatccaggagagtcattatatgaactatgagctggtttgcaaaaggaagaaaacattttgtggcagtaattaaatttctgtagacaatatgaaataacagaattcaggattattctctcaaagatttaaaaaaaaattctctattcatttttttaaaaggtggttgcaggaacagtacagagcttatagcatcctatataatccattgatactgtagacttttgttgaattaatagtcttaatctcacttcaag

SEQ ID NO: 218825 - DNA, 504 bp, Homo sapiens
gggtccacacttggtttgatgctgtgcagtcaccatcttgaaaatcttaattctttttgaactggggaccttacattttcattttgcactgggtttcacaaattacgtagctggtcctgctgaaagacattgtgtctagtgctttacaaatattatgccatttaacccttgtgatgacccagtgaaatgagccatttttattacttttattttacatataagaaaaatgaggcttcctgagtttaagccacttggctcagttcccacagctatttagtgatagaaccaggattcaaacccatgtttgcctgcctgcaagtacttgcctatcaggctgtctgagtgaagaatcctgacttaaagagaaggaactgaataagaggttgggagagagtgattggaatataggaactgctgagcctgaaagcagctaatgtttaaatgaggctgacagtggcagccaccaaaccttcctagtgagatcacttttgttgctcttactag

SEQ ID NO: 218826 - DNA, 196 bp, Homo sapiens
agtggggagagtggcttgagcaggtcaacgggctaggggaggtgtggcaccacgtagcagcttgtagcagccacccccttacaaacagggcacatcagactctgagccgagtgccttccaaatagtattttgtttttgacattccaacgttcctgggaggaaggtttcatcatcccattttataggataaaaaaaa

SEQ ID NO: 218827 - DNA, 273 bp, Homo sapiens
atatactattgaagcatggaggcatgggggcatagaaattatgaagttttgtggttcttctacttgattaccagaatcgcctaggggagcctaagtagacacccctaaaaccactgcagatcagtgtgaacatgaccagggttgaattagagactaagaatcctgaaagtaatccatattccttctgcattgacaaatgaatttctcattggactgtaaagaaatattaattgttagtcttatagttttgtatatcaccatagcaggctataa

SEQ ID NO: 218828 - DNA, 603 bp, Homo sapiens
aactgcaactatttgttggtctcaatttgaatgggactgatagtcctgttacagtaggtagttagacaaaagcagggcaggagagcgttccccacacaccaggaatgtcaggcagccatcagataatggtcaggtggttgctaactgtcgcgctaaagtaataattggtcacagctggtgccagggaaaggcagactctcaatagatagaaaacctgaaactgatgatcagcagcttcctgataagatttcaggagtcgggcaagcaggctcaagcatccacactaagatgcaaaatggcggagtttaactggtatatgacctttctctaggaacactcgactggtaaggggaaaacgcctcaagtgagcatacgtacaacttaaacacactgcatatgcagcccctcccaagtgctagcaggccactgcaggtgtggaatgccaacatatcaaatcccaagtcaacagtcaaaccaggtacttgaatctcttaagcagctcacttcgccctcttccaattgtactttacttcctttcattcctgacctaaaacttttcaataaactttcattcctgctgtaaaacttggctcagtttctcac

SEQ ID NO: 218829 - DNA, 230 bp, Homo sapiens
agggggcggagggggtggggcgctcggtctaacggcctggaggcgtccccaaatgaacctgaccttcccggcgttcctctgcgttccctgggcgatttgtgcagctgtattcgttctgttggtcgcatatgtggccgccggagaaataaatgcattgtcttcgctggcgagtaggggctcctagggcgagtcccgtgttagggacttgggaaatctctgtcaccgactgt

SEQ ID NO: 218830 - DNA, 948 bp, Homo sapiens
agcggagtggtgatgtcatgcaggcaagatggcggaaggggaggacgtgggatggtggcggagctggctgcagcagagctaccaagcagtcaaagagaagtcctctgaagccttggagtttatgaagcgggacctgacggagtttacccaggtggtgcagcatgacacggcctgtaccatcgcagccacggccagcgtggtcaaggagaagctggctattgcagcctgttcccggggcgcttgcttcctctgcccgttctctatacagacggaaggctcctcaggagcaacagagaagatgaacgaaagggttatctgacttcctaggggtgatctcagacacctttgccccttcgccagacaaaaccatcgactgcgatgtcatcaccctgatgggcacaccgtcttggcacagctgagccctatgatggcaccaagggctcgcctctatagcctgcagtcggacccagcaacctactgtaatgaaccagatgggcccccggaattgtttgacgcctggctttcccagttctgcttggaggagaagaagggggagatctcagagctccttgtaggcagcccctccatccgggccctctacaccaagatggttccagcagctgtttcccattcagaattctggcatcggtatttctataaagtccatcagttagagcaggagcaggcccggagggacgccctgaagcagcgggctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattat

SEQ ID NO: 218831 - DNA, 261 bp, Homo sapiens
tattcagcagacatttagtgagacttgagaatgtcctgtgggggtggaagtgggtagaggagtggtaggcctataaggattgatgagacataatgtctgactttaaggaacataaatctggcactaaatataaatttttgaaactccttaattcttagattagccaatgcagacagtaagtaacttactgacctaaaccagaatttttttgtaacatagattttaataaatttctttgttttttgttttttggtttttttt

SEQ ID NO: 218832 - DNA, 445 bp, Homo sapiens
cgagccccaagaattcggaacagggtgaaatcactaagactcttgttccagggaagagaagaaacaaaaaactgaaggaataaaaagtttaagccacaaagcattaataggaacacttggacctgtacaagagatatgctgaggggcatggggaaggaattccttccttctcaagctgtaggtgtcaggctttggccgtgaaaatgacagtggattttctactccttcagcaaactttctggaaaccccatcacctgccacgtgtgtgtggaggtgctgtgtgggtatacaaaggcgaattaagatgtgatcctgggtcagggacagtggctgccacctgtaatcccagcactttggaagaccaaggtggaaggctcacttgagcccagaagtttgagaccaacctgagaaacagagtgagatccccatctttacaaaaaaaaaa

SEQ ID NO: 218833 - DNA, 293 bp, Homo sapiens
atgtgtatattaaccacaattttaaaaaaattaatatgaatacaccatattccgggtttttcataatttaaaaatcttataaaaaaatgtaaagaggccgggcacagcgagcgactcacacctataatcccagtactttgggaggctgcggcagaaggactgcttgtgcccaggagtttaagacccgcccgggcaacatggcgagaccccatgtgcattaaaaaaatgaaatgtcaattgaaaaattataatagaactcatttaaatttggtagagactaaagcaagatctct

SEQ ID NO: 218834 - DNA, 493 bp, Homo sapiens
gccggaggcctggataggtctggaggcttgagaagacctagagtaaaaattgattcctagtgagatagtcatactgacagttttacaaccactcagcctgggttaaataatttagggacggagaaagaggtggtaatatgatttatccagaaagacaagggtgcctgggaacctgaacctagggtgttctcctactgatatagagtattacagtgttgaatccagaaaagagagggcaggggaagtcctggaacccttaatgtgtgcaagagggactgaaggtctctagagcagctgttttcttcatgggctttgtatcacaaataccttggagcttcataaaagctctatagatgagtctacaacaactctgggctgaatgaggaggagcagaaaatgaggagaagtaggatagtgggaggtgatctcacaggaaactctttgggacttcagagtattgtgaaatagaacactttcatgctggggctctttt

SEQ ID NO: 218835 - DNA, 133 bp, Homo sapiens
cagtggaaaataacttatattgagaccccacgagctgcacaatgtgttcctggcattaagctcattcttcttttgcagttcgatctttcttgagtggttccatgaacgctttcttctcttctatggtctggaa

SEQ ID NO: 218836 - DNA, 780 bp, Homo sapiens
gaaatagacacctgggaattttactaatggccaataaggaggaactgttagaatataaattcctggtaaaggaaacaaaaaataagttatttccttaagggactacagagggtacagaagtaactttttgtccttttgtttgcatattttcatacaaagggttctcatctattaattccattctgaaagataaacagcacaccagctatccttagcattctatatataagaaacttcagactaagctgagtgtggtggctcatacctataatcccagcactttggaaggctgaggtaagcagataacttgagcccaagagtttgataccagcctgggaaacatggagaaaacccatctctacaaagaatacaaaaattagctggatgtgggtggtgtgcacctgtagtcccagctgctcaggagcctgaggtgggaggatcacttgagcctgggaagtggagcctgcagtgagctgtgatcataccgctgcacgccaggatcaattacagaatgagaccatgtctcaaaaaaaaaaaaataaataaataaggtaaggtttagcaggttaggtaaaatatattttatgtgagaaagttaaataatctaccccaaatcataaaactacagaatggcaaatacgaaatgtagaactaaattattaactccaaacccagagccttccctcaaaattctggctagaaatggcaatgcttagatgaataacttctgtttcctcttcaaacattaatattccagtatgcctggagtgggaggaacat

SEQ ID NO: 218837 - DNA, 611 bp, Homo sapiens
cgtttaacacacagagagtccccagctcctaccggtccgtgcgctgctgagaacgtggccacgctgccggcgtgccagcattactgcctgagctccacctcctgtcacatcagtggcagcatcagactctcacaggagtgagagccctattgtgaactgcacacacaagggattgaggctgcacgctctgtaagctgcatgctccgtaagagaatccaatgcctgatgatctgaggtggaagagtttcgtcccaaaaccatcccccttcaccccacaatccgtggaacaactgtcttccacaaaaccagtcactggtgccaaaaaggctggggaccactgctttaacagagaccttcacatgactttattagcaggcaacagtgacacaattctaaaggaccttgaaaaaattacccacaaaattaaaaacttcacacgtaaaaagttttaattccacagagaggtcactcatctgatttatccacattatattttaaaataatgtccaaaaacacacagtagtaggtttgtttcctgacctcttaaaataactcaagttagtgacacccacactgtgtttgactctattctggaaaggcgtgttcttgca

SEQ ID NO: 218838 - DNA, 450 bp, Homo sapiens
taaaaccttattttagaagtgagcaagtgggccaggtgtagtggctcatgactataatcccagccctttgggaagccaaggcaagaggatcgcttgagcccaggagttcaagaccagcctgggcaacacagtgagactgccatctctacaaaaaaatttaaaatatcttaaaattagccgggcatggtggtgtgtgcctgtggtcccagctattcctcaaccatgcttggagcccaggaggtcaaggctcagtgagctatgactgtactgctggattccagcctgggctacagagcaacactttgtctctaaaaaagttaaaaaaaaaaaaagtttgcaaaataagtcattatttctcctttgcttttctgaaaacaaccaaaaagcagtgggcaactgcataaaatgatagtccttcttaatgttaaagacagctttatcaaggacatc

SEQ ID NO: 218839 - DNA, 233 bp, Homo sapiens
ctcctcagaggaccatggagactgcagagaggtggagctgtgggtccaaacccagcatttgctgccaatttctgcaaaggatatactctagagactcacgcgtcctcctaccttgtacagctggacgtcgtagcatttaaagagctggcacacgtcaggcaatgacatcagcatgactgtgtcttgctgcagagacttccagaaggaagtaagcaagtcctccacctggggta

SEQ ID NO: 218840 - DNA, 558 bp, Homo sapiens
aaatctctgatccatgggatttgccattttccacagcgtcaataactcccgccatggccaggttcaagcttgtgatgatgtcttggaaaagtaagactattaaattaggacaccagtgagaaatctcttgaaaaaagaccagataaaaatggggtattgctaaatgtggatggaattgggaagggatgtacacagtctgctctcacaagcgagcatggtgctgactgagcacatcactgcctaggaatatgctgagtaagaagcagtgaagctgaacattggtgagcatggccgtttccatgccacttactcagtggaagacattgtgtaagatggggtgagatggacacaagtatgagcctatgctgattgcatttaaggagctcactgtacttgggaggattagcataattataaaaatagctaatatctaatgcatggtcactgttttccaggcaccctctcaagagatctataacttaacaactctataatgtaggtattctttttattcttatattataatctaatggagaccccgagagacttagtagtttg

SEQ ID NO: 218841 - DNA, 167 bp, Homo sapiens
tgtaacttcatgtttccaggattggattttcttttcaatttaacctacttggaatatattgatttctctgtctgtgaagattcctgcttttattggatctcaaaaattgtgacatatgtctttaaattatgcctcttcacccttctgtcgtcttctcctattctaga

SEQ ID NO: 218842 - DNA, 954 bp, Homo sapiens
ggaggatgacagagagggagccgtcatcctggagcccaaagatttcaggcagtcactggttcttaactctggcacctgccaagtggagccgggcactcatcaccagatcttgctcctaaagtaatttaagatccttgagtgacagctgcaacattagcaggaagtattatttataccacattacattgaaggtgatgggagacaaccccagagcacagataacaaacacgggttctttgtggcaataatattaggttgaaaaaatatatattaacattcaagataaaggaaactacaaaatttacacttaattcaagccctcatttcctccccaacctacctgcttttcattcttccaattccttctcaaaccttcataatcattccagtcaacaactcctgagtactcaccaggtaggacattgggcatgagggatatatagatcaagaatgtcccaaccctcaaagagctacgtggccatacagctggccatgatatgttaagatatgtgttttacattatgatcctccaaacctgtgtttttcaacttttgtatgttacattgccatctagtacatatgcatacactcttaactgaagtaaatgtttcaaaaagtaattgtcaccatcactatgtgtgatgtcctctgatatttcctatttctttttctgccagtgacccacccgacggatttcatgacccactaataagtttcagcctgagtttaaaaaacgttgactctgggggagcccgtaagaaagagtagtcagttcttactggggtgatcagagaaagcttcattaggagttgaatttgcactttgccttgaaaaataaaaaatgtttgagtggataaagtggccccaggagggcataattagagtgaagcattctcccaaatagatttagattataaataggcaaaataggcaagcccaaatatttaccatttg

SEQ ID NO: 218843 - DNA, 485 bp, Homo sapiens
tttcggagttgtcctgaaggatatctgcaggcactttgtaagactgtgctcctacctcttggagctgtgttttctaccaaggaagacaccctagaacgtttccataataactaccaggggaaggaatgacacaatattcaccacagtttgtgacacagcaaagaaaaggaaatggaagaactaaggcttgaacatttaaaggtgattttgaagggagcttgtaattgattcaatattagacataattataagccggcaggatggtgcctggcctgccaaaataccttccgggttccccaggacctctcgtcacagggatgtttaaggagctgagcttcatgccatcacggcacataacaatctcaaggaagacgcctctgaaatacctgccccagaaagcccttggcagggactcatccttttatgtgccccaaaataccacctccagggtctaacctcctgggatccagctctcctcttacaaa

SEQ ID NO: 218844 - DNA, 765 bp, Homo sapiens
aacaaatgatattgagctacttaatcttactatcactgtaccaggttccataaagatgatgccttggtcagctcaggctgctgtaacaaacaaaggcacgtttcttataaacaatagaaacttgtttttcacagtctggaagctgaaactctgggatccaggtggcagctagttggttgttagtgaggctctcttttgggtttgcagatggctaacttctcaccatagcctcacatggttgaggatggctggagaactctctagggtctctctctctcttgctctctctctctctcttttttttaaaagcagcatctcactttgtcacccaggctagaatgcaatggtatgatctcagctcactgcaacctccaccttccgggctcaggtgatcctcccatctcagtctccgtgcccatcctctagggtctgttttataaaggcatcaatcctacttatgagggctctaccctcattacctaattacctcccacaggctccaccttctaataccagcacattggggatttcgacacacgcattcagtccataacagatgaggagccaacattgttgaatcataagtgatccatttttttttctttttatttctgattgatcaaggcttgcaaaagatttaactttcctgggttgggtagagtggctcatacctataatcccagcactttgggaggcttaggtaggaggatcacctgaggtcaggagtttgagaccagcctggtcaacataacaagaccccatctc

SEQ ID NO: 218845 - DNA, 164 bp, Homo sapiens
ggaatgttgaatgccaaggcaacgacgggagcagggcaaggtgtgtgggcaaagtggagctctctatgctgggagccggtggtgtctctgcaggtcatgtgccaggggcaggtgggtgcagaggagatgtcactggcacagtgctgccctggaactggcgctca

SEQ ID NO: 218846 - DNA, 1026 bp, Homo sapiens
agagataaagaaatgattaagatacaagactttgcctcaagttgctcacggtctatattgtgtgtacaaaaacaaccaatcaaccaatgttggtattatttgacagtgttggtacatcaatgagttctttgtaatcttgatatttatatccatggatgctgcttgaagcctgaactcctaagccactaattagtggtgggaagaaagagggggtaaatgctttaagagctagcatataacaaaaatgaattgggtttattctgtatcatatagagggcctaagaggcaaacatttcatagagtattcagaagaacataaggaatgacttttttcacagttaacagctgtccaagagtgtagtggctgcctcgtatgataaagcatctggaactcattgaaaaatgcatgtagaaaataccaatcagagcctgattgatgggatttttaattactgctttaatattgggactgaatcattttgtagctcattagaaacatggaaagtatttgttaaataaataagtcatggaatttcaattctaaggccatgaaaattaaaacaccctaccattatttatcaataaaacacagtgcagttttgctcatcagaattttgcctatgtgatagcctcctgagagtaggcagaaaagaaagacatagaacgcagtgcgtgacttacaagggaataaaactgacagaggttagtgtaaggtatataggcatgagtggggcttaaagaggatatgggagaacactgaagacaaatattagtacaattcctataaggtaaataccaatatgtctttctagaagaagcaattgttttggaattgaggaaacctagaatggatttatctatatgacttggacaggttacttatactctttggacatttatttcttctcagcaaaacaagggtaataatatttaacttgcaagattcgtggagataaaagcttaaataaacggcagagtacagtaatgcttatatacgggatgctaaataaataactctcactgtta

SEQ ID NO: 218847 - DNA, 476 bp, Homo sapiens
agcctgtgctgtaggggctgctgacctgattgggtgacccagccctcatcccagaaagcactgagcctccggtccccaagcccatctcaggcaatggcctgtccctgcacttgtcaatttgctgtcaaaatcgggcaggggagtcccaggaggtgcccagtgactctggcgggtacccactgtgatacagtggtgacttctctcttgcctgccagtctcttggcctgaggaggtggcttaaagtttatcgggccttgtttcatgtcccctggtagaaatgctcccactctgggaaccttctagaccaggtgtcagcaaactttttcttaaagggccaggtaaaaaatattttagaaggccaggcacagtggcttatgcctgtaagcctagcactttgggaggctgaagtgggtggatcacctaaggtcaggagatcgagaccatcctggctaacatggtgaaaccccgtctctact

SEQ ID NO: 218848 - DNA, 231 bp, Homo sapiens
tagaaaaggcagaattatagtgacagcatatctagtggccatcagaggccagagtttagggagggtttgacaatagaagggcatgagggaactttttggggtgatggaaatattctacatcttgattgtaatgatggttatagaatgtatatatttgtgcacattactgaattgaatgcttcaaattggtgagttttattatttgtaaatcatagtttaataaagctgata

SEQ ID NO: 218849 - DNA, 497 bp, Homo sapiens
catggattaggagtttaggccacctcttaatctcatgcagagaacttgtcattgaggatgtttcctaacttcacacctaggtacacctcagtgctgcccactaaattctccttcagaagaggttcttgtgtcggccactgggggacctgtaggcagatctgcctagtctggccccactccttgtggccacaaaccccctggggctgagcaggaagctaagacctctgtatattccctaaataagctcaatgcccaaggcaacagagagcatctgccagtaaacaaagatcaagtatacagcccgccatgtaggccacagctagctcttacccatgagtgccatctactggctcgtaggttaaactgcacagcctaaaataaagtgcataggactatagagacaaagccaaaagactacccagtattctctacggtcgcacctgctagagacaggtagaaaggggaaaggaaagaaaaaaataaaattataggaaagg

SEQ ID NO: 218850 - DNA, 443 bp, Homo sapiens
acatcaacaatacatcctgaattccagatggatgtaagatccaaacatatatatttaagcccaggcgcagtggctcacgcttataatcccagcacgttgtgtttctcttactacaattctcattcccaccttttatgtcgtaattatttatgtttatctttcaattcacttgctagatgtgcacttccagaagccaacagaaagatccttactgtatcactgtagaaactagttctgggccacatgtaggctttgaacaaaaatatttgtttaatgaaacaaatagtcttcaaataataagtcttctttcaagcctgttgagctttctgacaattcaaaatggcttatgctaattatgaatccttaatccaacattttccagggctataaatgtgaaatgttttttacttcattatgtttttatttttatttacttatttctt

SEQ ID NO: 218851 - DNA, 657 bp, Homo sapiens
ggggaaatacttgaactcactgagcagcggtggggtcacagtctgggcttgtatgccctcatttccaggccgcattcctcagaggggccctgagtactttgggagctgatagagtttggctgtcatttgaaaatgttttcctgctaaatgttttcatttagaagctaatttatactctgctttcaagtaagcttaactccatttcacatccctgacatgtagcacacactgcagtgactgggatggaagtagacaattcaatcaaaggatgatttctccgtggaggaaatgaatattatttgttcatcttgcaattcagaattctgagaaaattatgatgtttggcaaaggcactggcaagacagaaagacaaataaattgcatggtgtgagaacagccttcttaatatgaaggtttccttaaaacagtgggtattggctgcaggcaaaatattaagctgcaaatcactggtttgcaacttcttgatcatcggttgtaatcccaagaacatatttaatttcatatttagtcctaatttctttttgttccgtaatgatatttctgtcactcaaaataagccatctgttggcagcagcccacaggaaacagatactgcacactcagtaatcttggagtgagtctgttgcattgtgagaa

SEQ ID NO: 218852 - DNA, 479 bp, Homo sapiens
ctgaggagaaagtaagggaaaagaataacagtctttgtctggtaatcaagagaattctcccagatctttttcaagacctccaagatggtaggtataactctacaaatctgaaaaaaacacagtgttattgggcttggggcccaagtctctttgaatacctggaaagccttcccaagaaggacaggcacaaacaagcccagactgtgaagactacaataaatacctaactcttcaatgcccagacactgaggaacatctacgataattagcaccatccaggaaaacatgacctcaccaaatgaaccaggcaccagggactaatcctagagaaacagagatatataacctttcagacaaagaattcaaagtagctatgttgaggaaactcacgcctgtaatcccagcaccttgggaagccaaggcgggcagatcccttgaggtcaggagtttgagaccagcctggccaacatggtgaaact

SEQ ID NO: 218853 - DNA, 703 bp, Homo sapiens
ggtatggtggctcacacctgtaatcccagcactttgggaggctgaggcaggcagatcatgaggtcaggagatcgagaaacatggtgaaaccccgtctctactaaaaatacaaaaattagctgggcgtggtggtgcgtgcctgtaaccccagctacttgggaggctgaggcaggagaatcacttgaaccagggagttggaggttgcggtgagcagaaattgtgccactgcactccagcctgtgagactccatctcaaaataaataaataaataaataataaaaaaagtttgttagtgtcaaacacagcactgcttatatttctcacatatttctaaaactgagggcttatatttctcatgtacttccaaaactgagggttagagggaaatttctacttctctagatttatctggctctagctgaagtcattagatataaatgaactgtttttttccaaagagtttttggctaaattatggtaacactgcagttgatggtttcctggacagaaattttgcattggtcaagtgctggattagttaaaacatgttccaatgcctaagtgaaggaattctggaggggcatacagcacctacagtttacatagatgtggctttgcccaggccatttcatttacctgccttggccttcaataacccgacagtcctaccactaagcaggcgatattttaggaccttgtcct

SEQ ID NO: 218854 - DNA, 698 bp, Homo sapiens
ggtatggtggctcacacctgtaatcccagcactttgggaggctgaggcaggcagatcatgaggtcaggagatcgagaaacatggtgaaaccccgtctctactaaaaatacaaaaattagctgggcgtggtggtgcgtgcctgtaaccccagctacttgggaggctgaggcaggagaatcacttgaaccagggagttggaggttgcggtgagcagaaattgtgccactgcactccagcctgtgagactccatctcaaaataaataaataaataaataataaaaaaagtttgttagtgtcaaacacagcactgcttatatttctcacatatttctaaaactgagggcttatatttctcatgtacttccaaaactgagggttagagggaaatttctacttctctagatttatctggctctagctgaagtcattagatataaatgaactgtttttttccaaagagtttttggctaaattatggtaacactgcagttgatggtttcctggacagaaattttgcattggtcaagtgctggattagttaaaacatgttccaatgcctaagtgaaggaattctggaggggcatacagcacctacagtttacatagatgtggctttgcccaggccatttcatttaccaaatgggttgtgcctcaattaaccagaacagcattaccacctaagcatgagattatatta

SEQ ID NO: 218855 - DNA, 391 bp, Homo sapiens
tcaattaataaagatgaagttttgggttgtgtcattcataaaggagaaaaataagggacatcttatttagaattattatcttagaaattctgcaaattgctgctttgggttattgagtaggaaaatataaacagaatagctgacactttcaacagaatttcctatattttaatacatttcatattttgatatgtagtcattgtgagtaaattttaaaaatatgaacttaaaaataagcatactttcagaatctatagatatacactgttgtcatattgttataaatatgcatttatatattagataaaatatttaaatgggatattgatataatttaatttgaccttatctctactgaataaattactaattcatgtcaatgctactacct

SEQ ID NO: 218856 - DNA, 83 bp, Homo sapiens
tcagttctgccttgccggtgatctaaatggactccccgcagggaacagcactcatactgcagaaggtcttttcttttgccttt

SEQ ID NO: 218857 - DNA, 383 bp, Homo sapiens
gagtggctcatgcctataatcccagcacttttggaggccgagatgggcagatcacttgaggtcaggagttcaagaccagcctggccaacatggtgaaacctcgtttctaccaaaaatacaaaaattagccaggcatgatggtgcatgcctatgatcccagctacttgagaggctgaggaacaagaatcacctgaacgctgtaggcagaggttgcaatgggccaagatcaacgccactgcactccagcctgggcaacagagggaggctctgtctcaaaaaaaaagcggaaacagaagagatatagtactatcatgaaaacatatatttaataagtttttttgagaactaccaccttatccttggaaataactagctattataag

SEQ ID NO: 218858 - DNA, 356 bp, Homo sapiens
tgcttgccaagttagatgctacacagagaagacagctggtgcaggagccccggtagtcatggctattctgcctcccactctcccatccagacagggtgaattctcaggatgccaggcttctggccaaggcttctcaatgcacagaatagtcctgtttcaccctaagtacccctcccaaagtgctgaaattacagacatgtaccaccacacccagcccacactctaccttcttttggttcacagttcatcagggtttttcttaccacttctatgaacacatagcctctgttatgaagtagatcaattcaaatcagttctttatgtgaatttcctcattaaattctataaccatccta

SEQ ID NO: 218859 - DNA, 750 bp, Homo sapiens
gtcctggaaaggatactgtaccaagttttgagacatgtagcatacagaaatgtaatagattggtttactctgtgatttagagggaaaactacatttatgtttcaggcttaatatcttgatacaaggataccagaattccaaagagtagaagccaagtgatttagctttatcactcacccatttctccttccttcccctctcctgaataaactttcaatctcatcccttaaacaggctcctccattctgtcaatcagtgcttctcaggtctccactacccacagtctttcccagactgtgctgttccttcatgcttgctcctccctttccctcacccacagtttctaccctgctgcctctgcttcctcactgtccaatgctaccctgaaacctggcttccttactattgatgaaactgcctacaacggtcatcaaggacccagatggacaaagccaatggtccatctttacttctttatctttctgcagggaggaatgaaaaatctgcactttaaagaagttctacttaaaaaaaaacaaaacgtcctttgtgcccacatatataacaactcctggctattagaaactttaacaaagccctcttgttttatgaatatagacactaaaaacaaaaaacaccatccataccaaaaactgtactagatttatctaaaaccatatggtttttggtatggagcatgtatgttcaagcagaaacaaaggacatctaagacaaagggaaacacgtggg

SEQ ID NO: 218860 - DNA, 387 bp, Homo sapiens
ctcactcctcctccagggcccagctcgaatgcaccacctctaacttctcatggagctttcccacacaactttattccacaactaattacactgcattaaattgtgtgcatatctttcccagcaggctacaggctgctcaaaagatgcagaagtcttggcagtgcttacagcctgcatcattagaggcacccaaaacaaagggcaagtcagccaagaatgagtcaacgagcaggtgaaaccagtaggtgggatgatggggcagtggagagggtgggactgtggctaattctgatcaacaaatgggctcaactggagccacacaatctcaatcctcatcacaggctccaagggctgaaaacttttagctagtgaagtttcccttaaatt

SEQ ID NO: 218861 - DNA, 558 bp, Homo sapiens
cttttattaaacatagtttgataattaagacaaaaaaattagtagggtgctaattaataattttagatctaagaataggctcacacctataatcctagcaccttgggaggctgagggaagaggattgcttgagtccaggaatttgagaccagcctggacaacatgagactccatctctacaaaaaataaaatattagctgagtgaggtggcacctgcctactatagtcccagctacttgggaggctgaggccagaagatctcttgggcccaggaggtagaggctgcagtgagctgtgatcataccactgcattcccacctaggcagcagcaagaccctgtctcagaaaagaaaaaggacaaaaaaatggctcacaaaagaggaaacaaaggcataaaaaatattcggtaatcaggagtaattaaaatatatcaaacaaggccgggtgcggtggctcatgcctataatcccagcactttggaaggcagagactgggggataacgaggtcaggagatcgagacctcggtgaaaccccgtctctactaaaaatacgaaaaa

SEQ ID NO: 218862 - DNA, 337 bp, Homo sapiens
gcttaattctgaatatttcaaactgatgatgtctatctcaaagtaaaaacagtctttaaaggcactgtaataaaaatgggtgagaataataatcattggaaaaagagactcttaaggaagaacagacatctcattttccattttcttctcattatgtctgcagagtaacactcccagggctcagggatatcaaatttgatataaattcacaaatgaaagtgacaataaatcaatgcctagagctcttatttcattgcttcatgctagtactttccccaccaatcatttgctgactatgctactgataaagtactcatcatttttgcctctgattcta

SEQ ID NO: 218863 - DNA, 604 bp, Homo sapiens
ttctgaagactatgagaatatttctgttctaaaatggcagagatattactgacgcttctaccaccattctccttaagctccacattgcttctccttaagctatcttccttttccagccatattccattacttttaataagatttgtcctcttaataagcaggctggtaaacacttgacttgttccaattcctgaatccctccccaaacacacacacaccccaggccatcatcaagccttgctgtttcaactcactgcttcatcatcttctcataatctcctctccctcaagccactgtttgactattccccacacacaacttaagtctgatctttattgttacaacctcctaacggcccccaccccctttcttttcatgccctggcctcatttcctccatccttcaaaactctggtttaagccacctctagatatttccattttagaggaagaatcttaagaaatcatagagtaaacccccctgccctagcttgtaggtaaggcataactctgcaattttacctagatgagactgaaggagagccaactgattttactcaaggtcacaatgctacttcttccctaaaactccaccccttagttc

SEQ ID NO: 218864 - DNA, 399 bp, Homo sapiens
ggagtctttcattgagctaattgagtggtaaaattatgaatttattattaaggaatcagaatgatcagcaatttgaagacattaccttcagtgaaataatccaggcacagaaagacaaaactgcaagatctcacttatgtgtgaaatctaaaaagacaaactcttaggagcagagagtggactggtggtttccaggggcccagaaggtcagggaaggtgttagggagatgttggccacagaacaagaaattccagttagacaaaggaataagttaaagagatccattgtatgacatggtgactataactactaacaatgtactatgtgcttgaaaattgctaacagagtagatttcaagtgttctcaacaccaaaataaataaataaataaataaagta

SEQ ID NO: 218865 - DNA, 204 bp, Homo sapiens
cgctcctccaactgacctgcacccggcatttccactcgagtccctcgtggtgccccccccgactcacaatggcacaaaggtcctcagttccccaccaggggcgcagatggaccaccatgggtcaggggcagagggtccccttcttccctgacacaccctcagcaagtccttcccggagacccccaccgtgtcctggcctcctct

SEQ ID NO: 218866 - DNA, 461 bp, Homo sapiens
gaagaagaaataggtttgatgaatagctaagctagtctctgctataacctgctatcatatagcctagaaagataaatatcttccacgtctcttgctttttcttcacaatcttatcttttcatcatttttccctgtgtgtttgccttctaatttactaattcagtttttagctttgtcattgctgctatttagaactttgttattatttttagtctgacaatcacagtattggctttaaagaatttgttcttcacatggacacaggaaggggaacatcacactctggggactgttgtggggtggggggacgggggagggatagctttaggagatatacctaatgctaaatgacgagttaatgggtgcagcacaccagcatggcacatgtatacatatgtaactaacctgcacattgtgcacgtgtaccctaaaacttaaagtataataataataaaagaaaa

SEQ ID NO: 218867 - DNA, 424 bp, Homo sapiens
taatctgtgtgatgaaatggaatatatgcataaagtttgctgcaaaatgaagactgatgattgtcttgaggaaaaacacttatgcaatggcttgtgtgccaaattagccacttattcatattactctttttttgcttgaaagaatgactgatagacaagccgtgattattcagatttgcatatttgcagaccttttctcaaaaatgaacaaggctatcttgtcgcttaaaggaagctggtagtatttgttgcaaatgataacatgacttgttggcaagtgaaaattagaaatttggaaaatttgctggtgcagtagctcacacctgtaatcccatcactttgggaggccaaggcaggaggattgcttgagcccatgagttcaagactagcctgggcaacatagcgagaccctgtctctatatta

SEQ ID NO: 218868 - DNA, 355 bp, Homo sapiens
ttatttcttttaaaatactttaacctttgtaaaaaaacaataataaatgtttagtatgcatttggatcctacaaagtttttaagtgcattatttcacttaatattcataatgaaccctatgaagtttgttctgttgttatatgcattttacaaatgaagctgaggcttttttttattattttaaagaaaatggcaaatcctagcaaatggtggtataatcagcatttggacttaggtttttatgactcctgagcctttcatattaactgtcacaccctactttctatgctgtgtgataaattttcctatattctcaccatgcttcatatcccagtttgatgacattggtaatcct

SEQ ID NO: 218869 - DNA, 210 bp, Homo sapiens
ttaattatccttttctctatcatactatggtttgctgagaaatcacattttctcaatttagctcattattttaaacctctctgctataatatctatctcatcatttggctattagaaaatatgtgacaaatttcatgattcaaaatctcagaatatcagtttgggttaactctcaaaactgctgaagaaactaaaatgacatcaaggcag

SEQ ID NO: 218870 - DNA, 356 bp, Homo sapiens
gccgtatgactacctgtttttaagattaaaaaagaatcaataggcagtttatatgtcatgggagcaagttaaaaacaacacagatgtgatgaaggcgaggtgaaactggtccgcatctaattcaggccttctcctgaaagccagtgtgtgcaagataaataagtttttttgacgaaagcagaataactagtttgtcctttgtgatgaagatagttattcagaaatcatttttattggctacctctgaattaataaatgaaaagagaaatttttttttctgtaggggatgtctgatgagttcttaaaaagtggatgaacctgaaattatcatgaacaagcaatcataatgaacttaa

SEQ ID NO: 218871 - DNA, 188 bp, Homo sapiens
acataaactcactcagggaatcttctaatttaagagacacagctctgtaatgaatgaaaactacagccttcgaagtgatctctctgtatccactttttcctggctttaaattcccatctccattataatcagagttatctctgtaaagaatagttctaaagtcacagcttgatttaaaacccattgat

SEQ ID NO: 218872 - DNA, 247 bp, Homo sapiens
ttacaaggtcaaggctctagaaagaacctttccaatattagcagagtctttggtctgcacgtgtttacaaatgcaaataaaagcagagaacacagctaattttgtactccttaaatagcataagcttatatttgtatagaccatttcttaggtagtaaacttatttccttctgtagattctgctttcatgttttgtcagtccaatcccagtgtgaagatggttgaataaaactatcatttatccaca

SEQ ID NO: 218873 - DNA, 608 bp, Homo sapiens
gggcgtctttactgtaacacacccgagcacagcccagctcgcctgcccgccaccgccatccagccccagggagccccacacactcctggagcttcagctgccccctctctagtgtttacttgagatccagcttagtcctagaaaaaggagctgaagccttagagagcctgtaacaggaatgtggaaacttctctcatcctagatctctccagccctagaaactactggctacccgtccaggcgtggtggctcacgcctgtaatcgcaacactttgggaggccaaggcgggtggatcacgagccgagatcaccacaccacactgcagcctgggcaacaaagtgagactccgtctcaaaaaaataaaaaataaaaacacacacttgattataatccttccattttaaattcctccaatgaaatgtcttcgaatcaatggattgatttaaaggaaatcaagccttctggcatagaataaaaacgtccttgccatttggcatctacatcctttgttgggatttcaagcatgagccaccgcgctcgggtagacctgacaggttttaaaaggaatactgggtgctgtgttaaaacaaactgcaggacataaagg

SEQ ID NO: 218874 - DNA, 522 bp, Homo sapiens
gggcgtctttactgtaacacacccgagcacagcccagctcgcctgcccgccaccgccatccagccccagggagccccacacactcctggagcttcagctgccccctctctagtgtttacttgagatccagcttagtcctagaaaaaggagctgaagccttagagagcctgtaacaggaatgtggaaacttctctcatcctagatctctccagccctagaaactactggctacccgtccaggcgtggtggctcacgcctgtaatcgcaacactttgggaggccaaggcgggtggatcacgaggtcaagagatcgagaccatcctggccaacatggtgaaacccgtctctactaaaaatacaaaaaagccgagtgtggtggtgggcgcctgtagtcccaactactccggaggctgaggcaggagaatcacttgaacccgggaagcggagtttgcagtgagccaagatgacaccgctgcactccagccaggccaacagagcaagactacgtctccaaaaaaaaaa

SEQ ID NO: 218875 - DNA, 842 bp, Homo sapiens
gtggtgtgtcacataacacactttacataacggttcactgactcctcatgtacaaagcaggtaactggctattctgtaaataccaaagcattacattcccacctgggaggatgtgtgcccaattttttggagaaaggtaagaattagatgattgttatctaaggtcatgatcaaatatcagttttaattgcccagtttgattctttaaaatagataaatgagtatacttttactgaatattttatttcatatggagaagctgtaaacataaccatcaaaaatattacgtgttctagttcaaagctttgaacccagtaagtcatagtgtgcctattttctaacctcttgatactggagagaacataactgctttgatcatctttctgcagatgtttaaacaaaacacaaaatcccctgccctcctgaagcatccattcaagttgatatcagtgttcctagttttatttaattaaaaagtaaacgccttcttttagtggtgttttgagtatttaactttattgccgcagcgagaactccgtatgttaatctgtttcaaagtcataccttggttagttgggtctgactttgtgggcatttttttcttaagttgggttatttcactccccactgggaaatgtggcagctgtttttgatcagtgacctcagatactaggtggctttaaactttgaatgtgaatgttggcttttttcctattctgcactcattctctaaatttaggcctatcgaagatttggcatagtataaggaatagcaaggagtttggtagtttttcccaatgagaaaattatggttacctcaagaacaaatttaatgaaatgag

SEQ ID NO: 218876 - DNA, 738 bp, Homo sapiens
ctgcactctagcttgagtgacagagtgactctgtctcaaaaaagaaaaaaattattacaatagtggtacttaagactttctcctattaagaaatatgatgctctttcctaagtggcctgaggtaatctgaaaatggttcgctattcacttgacccggagaaccccacaaaatcatgcaaatcaagaggttccaatcttcgtgttcactttaagaacactcgtgaaactgctcaggccatcaagggtatgtatatacaaaaaggcacgaagtatctgaaagatgtcactttacagaaacagtgcataccattccgacattacaatggtggagttggcaggtgtgcgcaggcaaagcagtggggctggatcacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatctttacggaaaaggaacagattgttcctaaaccagaagaggaggttgcccagaagaaaaagatatcccagaagaaactgaagaaacaaaaacttatggcacgggaataaattcagcattaaaataaatgtaattaaaaggaaaaaaaaagaaatatggt

SEQ ID NO: 218877 - DNA, 745 bp, Homo sapiens
  misc_feature (499)..(500): n is a, c, g, or t
ctgcactctagcttgagtgacagagtgactctgtctcaaaaaagaaaaaaattattacaatagtggtacttaagactttctcctattaagaaatatgatgctctttcctaagtggcctgaggtaatctgaaaatggttcgctattcacttgacccggagaaccccacaaaatcatgcaaatcaagaggttccaatcttcgtgttcactttaagaacactcgtgaaactgctcaggccatcaagggtatgtatatacaaaaaggcacgaagtatctgaaagatgtcactttacagaaacagtgcataccattccgacattacaatggtggagttggcaggtgtgcgcaggcaaagcagtggggctggatcttctaagttgatttttttcctcccaagtcctttttaaagaaagtatactgtattttaccaaccccctcttttctcttagctcttctgtggtgaattaaacctacttgagttaaaaaaaaaaaaaaaaaannaaaaaaaaaaaaaaacctccagggtcgacggtatcgataagcttgatatctcgccaaaatgacgaacacaaagggaaagaggagaggcacccgatatatgttctctaggccttttagcatggagttgttcctttggcccatatatgcgaatctatagaaaggtgatattgtagacatcaagggaatgggtactgttcaccagcatgctgtggcattggtgtaaccaagttagggccagttcttgc

SEQ ID NO: 218878 - DNA, 390 bp, Homo sapiens
ccccacaaacaaacacactgaacaaatgtttgtggattggtagaactaggcatggtctccaacggcagacagacaaggtcctgaggggaaaatcagggagcatctctaaccagaccgtcctggtcagctgggtctggaggagactttcaactactctttggtcatcattacgtctgactcagtggttcaaggcagaagtggaagttataggcaccaaattgatgctgcaggagagagatgaaggaggcagaatggattcatctgctctgccctgggtgtcagaaatgaagatttttaggataagtgccaactaaaaatcattaagttgtacacttcaaattgatgagttatatggtacatggattatagcacagtaaaactgttatttaa

SEQ ID NO: 218879 - DNA, 498 bp, Homo sapiens
aaaaacctcaaacaacctgagaaaggaggggaaagactagtgctccatctatcaaaaaaatccctgatgtttaaccatttaacctataacttgttttaagttgcatacctaagtacataccataaattgatacataatacatacctaaagaagggggaaattaaggaaacaaacctatcacgacaaaaccttaattaactggaatgcaaagagagtgaatatttcagttagttgaaagttacgtagaaaactttttgcttccaatgctgacaatcattctaaaacgcacaaacctaagtacttaagcttcagtatttatctgatgtttcaaaactcctacaacttcagaattcttacttaccactgtaaagtcatagaaacagagaaagtgctgaagcaattgggctgagtatatatactttgactctagcctgtacttaggaagttgtttaaataaaatgtatcaaatcatttgcatcttgaggtaagaaaaaaaga

SEQ ID NO: 218880 - DNA, 856 bp, Homo sapiens
atcatgatcaaccaggaaataggagtacggggaccacgtatctgatggggtcatcacgttcttctgccggatagaagctgtgagaggagatatgagccatcaagcggagaggagtcacccagaaattccaatcccaagagcttaccacctagaattccttctacatgtacacataaatgtgaataagggtagagttttttccattattacgtataagtgaaaaattggaaacaaagtttccaggtgggaaaatgatgatacatctgtaccttccaatcttatgaagccttaaaaagaatgaattagaggtcaaccatggtggctcacacctgtaatcccagtactttgggaggccaaggcgggtggattgtttgaggtcaggagttcaagaccagcctgaccaacatggtgaaaccccgtctctactaaaaatacaaaaattagccggatgtggtggctgacgcctgtaactcggaaggttgaggcaggaggatcacttgaactcgggagacggaggttgcagtgagccaagaatgggctgctgcgctccagcctgggcgacagagcgagactccgtctcaaaaaaaaaaaaaaaaaaaagaaaagaaaagaaataaatctaaatgtgctgagatggaatagtattcatagtatcttaagtgaaagatacaatttgtatgacattacatgtgtataatccatgtttcttttaaaaatagtcccaaactaggccaggcacggtggctcacgcctgtaatcccagcactttgggaggccgaggcggctggatcacgaggtcaggagatcaagaccatcctagctaacacggtgaaaccccgtctctactaaaaataca

SEQ ID NO: 218881 - DNA, 830 bp, Homo sapiens
gtaattctgtcaggcccagggttcagaaagctgaaacagaggctttggctaaaggtgttttattcctgacaagcctagaagggagtcttggcctgaggccctggggcctcgctcacaaggcagtttttatctgtggctttctgtaatttgaaggaataaatctaaaagaaatagcagattttggctgtggtctcatctgttcctgggtaactgtgatcgtaggcacctctctaggtgtcagtttctgtatcagtcacattctagcaagagataacacttacctagtgcttactaagtgccaggcactattttgaggactttggatatctacttatttaatcccacaaccatatgagaatagatcctgttaattttcccataaaagtaatttgcccaaagtctcacacagtggtcgggggtggggccagaatctgaattccgatctgcctattgccaagctcacaccatttctttttccatgatttattttcacatattctattttaaatcaaattattaattctattactacggtgatgcaggaataacttgtccattttttttttttacaacagaaaaatttctaatgtggcattgagcagaactgtggtgttctccaaggccagtctttgtccaataaatactgaaatactgaaaaaggatgatagaacgcatattccacaacagcttcaaatgcagaggtgtatgaattttaatattattaagaactgctttagaaattccagttgctagcattttcctggtatattcttcccacctctaaagcacgtgagtttaacataattctattgtgtctttttatttttgag

SEQ ID NO: 218882 - DNA, 355 bp, Homo sapiens
ggctgccctcgaactcctgagcttaagcgatcctcccaccttgtcttcccaaagcattgggattacaggtgtgagctctcatgcttggccagcagcaagtgatctttctcaaactctgatttgctgctttactcctctgctgtggatgcttgactatcccacccttccttaacaaatcatttaggaccttttatactttggcccctactaacttctcagcctcatctcctgcttcacccaatttataatctgtgcttggttgcactaaaccatcttcagtttccaagacatggcatactaccatgcttttgaaagttcttaccactctgtacagaatgtacttcttcacctagcc

SEQ ID NO: 218883 - DNA, 246 bp, Homo sapiens
cgctggacgggcccgtattaatagagcctgctgtggatgcttgactatcccacccttccttaacaaatcatttaggaccttttatactttggcccctactaacttctcagcctcatctcctgcttcacccaatttataatctgtgcttggttgcactaaaccatcttcagtttccaagacatggcatactaccatgcttttgaaagttcttaccactctgtacagaatgtacttcttcacctagcc

SEQ ID NO: 218884 - DNA, 467 bp, Homo sapiens
gcttttattaatataaatttgtagatttgaaattttttcaaaattctctttgtgctactgtctaaactaaacaatataggaaaattataatagagcagaaacatcgcatataagcctaattttgacattggatatagaaatagaaggaagagaattgtgagtcattttattggccttatattaatattcagtgagccagatgcaatagaaacatggagaaaatatataaaaaagagaattccagccaggtgtgagccaccatacccggccacaaatttatattttaaaagtttgtataacataaaatgtgtaaaaccgttaaataaaggaaatattaaaatcttttttgaagaaaacaaaattaatttttatacgtggaatatgtgtcccttcacgaagaatggtattttatataagtttaaggtaactttcaatgcaattttgttacaaagttacagaaagatgca

SEQ ID NO: 218885 - DNA, 562 bp, Homo sapiens
tacggagttttatggtatctacttgccccaacatttctacttgtatgtgacaaaagataccataaagaaacttaaaaataagtctgttaactgggaaaaatatttgcaacttttatataaagagaaagaattacgagatgtataggttatataaagatttatttctgtaaataagagacctaacagaaggaaaccggtctgtgaaagatggccttgtaaacatgaaattattccaaactttgtgcataatgagggaaatgttaaagcagtgaggttcgctttttgtcagccgctagactgacaaccattttaaaatgttcataacaggcactctcatgtactgcccctgggaatgtaaatggtacaaatactctggaggacattctggcattttttcccttttttctttctggtttgactctgggatttttttccttccttttttccccccttatttctctgtacttcaatgaatataaattggcactatctcttgactttaagtgaatatagcttgtgatccttcaagaaatacatgtgtagaaatacacgtaaagaatgg

SEQ ID NO: 218886 - DNA, 1208 bp, Homo sapiens
cctcacgattacctcaacacactcaagtatgcattctggaaaaacacagacattcttcttacataacaattaatgattatgaaacagctaaaataattgataccggccaggagcagtggctcacacttgtaatcccagcactctgggaggccgaagcgggcggatcacgaggttaggagatcgagaccatcctggctaacacagtgaaaccccatctctactaaaaatacaaaaaattagccgggcgtggtagcgggcacctgtagtcccagctactcgggaggctgaggcaggagaatggcgtgaacccgggaggcagagtttgcagtgagcagagattgcaccactgcatcccagcctgggcaacagagcgagactccgtctcaaaaaaatatatatgtatcttctcttagccactgcaattcttagaaaatcaccatcaccatctcaacatccacccttcttttaatatcactacagttggacttttacccactccgttaccctcaatcaccaagaaacttgcattgaggtctgatgatttaattgtaagtggcacatttttggtcttcgtcctactgcccttgttcatggcacatttcctactttaggacgattgtttcccctttcgggatacgtttactatactaagccctttgtcttgatcattccttctcaatacctaatgttcattctccctcatctacctgcctattaaatgtttgaattcctcagaattcatttgctggtcttctcactttgtattcctaaggtggtctgagtccctcttaagatttccactacccttaatatgatgaccatactcaagtaaatatttttaaccctgacctcttttccagggctcccaacattacccaagtcaaggatctgatctgattttgttcttccacatttaaaaaaaaatcctcagggtctcagtagaaaatgtttttttttcgctcaagtgatctgtagatcaaataccattccagtgaaatcaccattgagttttttatggaattaggccattgtttttaatgtttatgtggaagaaccaaagatccaaaagtaacccagaccatccggaaaaaaaaatggaggatactagccctaccaaatataaagacttattaaaaagctctagtctgttattgctcgggatgagttaaatagactaacagaatagacaaaggaaacaccggtccgag

SEQ ID NO: 218887 - DNA, 838 bp, Homo sapiens
cctcacgattacctcaacacactcaagtatgcattctggaaaaacacagacattcttcttacataacaattaatgattatgaaacagctaaaataattgataccggccaggagcagtggctcacacttgtaatcccagcactctgggaggccgaagcgggcggatcacgaggttaggagatcgagaccatcctggctaacacagtgaaaccccatctctactaaaaatacaaaaaattagccgggcgtggtagcgggcacctgtagtcccagctactcgggaggctgaggcaggagaatggcgtgaacccgggaggcagagtttgcagtgagcagagattgcaccactgcatcccagcctgggcaacagagcgagactccgtctcaaaaaaatatatatgtatcttctcttagccactgcaattcttagaaaatcaccatcaccatctcaacatccacccttcttttaatatcactacagttggacttttacccactccgttaccctcaatcaccaagaaacttgcattgaggtctgatgatttaattgtaagtggcacatttttggtcttcgtcctactgcccttgttcatggcacatttcctactttaggacgattgtttcccctttcgggatacgtttactatactaagccctttgtcttgatcattccttctcaatacctaatgttcattctccctcatctacctgcctattaaatgtttgaattcctcagaattcatttgctggtcttctcactttgtattcctaaggtggtctgagtccctcttaagatttccacatttaaaaaaaaatcccagtctctccagtgatcttat

SEQ ID NO: 218888 - DNA, 830 bp, Homo sapiens
ttaggccccatttatcaacacaaactgaaatatggcaagggaatacacttgcaatgaatttgaaaaaaacatgacccttcttgcctggatcatttgttttctcatatgtgtgccttctaatagaattgaggaactttaagggctcagaatataaagccagggagatttaaataatgtgtttaaccgaagccatttagccaatctagaagagccaggactagaatgacatctagtacagctgacacctactggtcaccgtgtactaaacactgcttacatcatttatcgtcctcatacagccctatgggatgaggatgatgattatacccaacaacaggtcttagaggctgaaagaggttaaatgaatagctcttgttacccaggtagcaaactgctgagccaggatttgagatgaagcacgctggcacagtccactgtctgagccccattgcagccctctctggaattccacttgagacaggtcatgttgcttttgattaaaaaaaaaaaaaagtacccagctgaaaggggccatcccaccttcttacagccaaggggatgaggagaaaataggaaagatttaaggctttttatatgtttttaaaattcttaatctcttcggcttctccatttcaatgtgctttacttatgtttacttgattaagactttaacatgatttgcataatcttgtctcattgtaacttgtaggtcaggactgactggcctgaggatgaaccccaaaatgtttctgaaagtaacaattatgtaaactttacattctgcaattattcttaacatacaagcaataaaaatttgttaagattactga

SEQ ID NO: 218889 - DNA, 377 bp, Homo sapiens
tatatatatatatatatatatatatatatatacacacacacacacacacacacacacacacacatacatatattgtatatatactgtatatacattgtgtatatatctacctatttgtctatatatgtatatatctccacattttctttgtccattcatctgtcaaggaacatttaacaacacgggaggcagtatcagtaatccaaaatcctctaagaaagaaaagtccaagacaagatggcttcattatactaaacatttaataaagaattaatatcaatacttaaaaaaattccaaaaaatggaagaggtcaaaactcacttaatgaggtcagcatcactctaataccaaagcaaggacaaagacactacaatta

SEQ ID NO: 218890 - DNA, 537 bp, Homo sapiens
ctcagttttctcatctgcaaatgggaatgataattgcatccatgggatgtaattatatccacatcaaggttttgtgaagattaaattaaatgtgttgatagtttctgttcagggttttaacgtggtgcctggcatagagcaagttctcataagtatgtaatgttatgattcctattttattcccttgagtagaatgtgagccagacaaaggtaaggtcattgcggggtggaggagggcttgaaattggtcagtcagggcttgttgactgagggggtcctgacaaaatggattgggcgacaggtaaggctggggcagggccaggaggaggaggccatcaggtcagggcttggaggcccaggccccgctgggagctaagagtcctggattcctgcctacagtttgagctccggtgaagcactccttcttgatggctctggtttcccagcataatgtaaattgaagagatcgaaccagatgaatggcaaggtccctggcagcccagatgttttgtgagttctgagcttctaagttaattt

SEQ ID NO: 218891 - DNA, 359 bp, Homo sapiens
agatcaaagagccccatcaattcattcagagagtcaaaaatccagctgaggctcagagccctgtctgcataataagaaaggttgactaaaacatacggattaaacagatgagctgtctcctgcagaggcatgggagggaagccccactgcgacacttgtaaagacactttggaagctcgcacctgctcctccacagccaaacctacaggagaccaggatggccaaagacgttccactattgtactaaattgttagctttaagagaaagaaatagatatgtctgatggatatctttttatttgtcaagacactgtcagtccagacaaacaataaattaataaatcacctccatttttcca

SEQ ID NO: 218892 - DNA, 384 bp, Homo sapiens
tgtgatggagtctcactctgtcgcccaggctggagtgcagtggtgtgatcttagctcactgcaacctccatctcccgggttctcctgcctttagctcccagagtagctgtgactacaggtgtatgccaccatgctaatttttgtatttttagtagagactggttttcaccattttggccaggctgctctcgaactcctgacctcagggaattcaccttacttggcctgccaaagtgctgggattacaggcgtgagtcaccacgcccggccgccgttccactttaagttattcccatgctattgtcacccgtgtcctacaggggttaaatataccactcactatcactgaggaatcttgtgttttccgggtatcaaaacatcaat

SEQ ID NO: 218893 - DNA, 458 bp, Homo sapiens
aatatttacaacatttgtgtggggtagtggaacaagggattaacttcttttctccatttctgtggtttctgtgttacttctagagaaaacaacattttagaatatgcatgtaggcaccgtgcaagagacggtgtcccaccactactgggctggaagggtctggctgcgcatcccacacactgctcctgaatgcagcgattctggcctagcaggatccctgcagcatcccttcactgcagggccaaggctcctcctctcatccaagaaactccccttcttcatttaagcgctccttcaagcctgacgcaggctgagaaaccagattagttaggtcactgagaacaggaggggaaaacagattgtgcccctaacaacttcacttcactgtaatagcaagctataccatgtgtgaaaagtgagggatttttttgttaggtccataacttcaggaagatgag

SEQ ID NO: 218894 - DNA, 316 bp, Homo sapiens
tcagcttaaatatgcttgtataattacgctgttaatgatgatagcagtgatgatgccggtggaaaaagcctgtctttagctcaagaaaagtaagggagacaaatgtagcaagcagaaagcaaacacagatttgggcaagattttgccagaatggaagtctaacacttaaataagcattctcttggccaagtaagaaactacagttgttgtgggtattaccctacaattaccatatgtatatacatattaaattaaactcagcattaaatatgcttgtataattacgctgttatatgatgatagcagtgatgatgct

SEQ ID NO: 218895 - DNA, 548 bp, Homo sapiens
acgtgcaagtttttccttaacctagatataaccagtgtttctgtgtaggtatgtgcgtgtgtgtgtgtgtatatttatatatgatttatatttttcccccaaattttcactcttggaatggaaatccttgtgtgtatacatcttgattcatttatccaattatttcctcagaataatttcctggaagtagaatcaaagaatctgtacattttctatgctgatacatagtatataattttgatacaaaaaaaggtatattacttttcattcccatcaagagtgtgtgtaacggagcaagattttttcttccataccaccactaccaattcctcgcagtctgatgttttaaaatatatgcttttttaaattatatgactaaacaatttcatattagccatttttgttctctctgataagttgctttctgtatttttggcccctcagttatagcttaggttctagagcagactgcgtgcatttgaatttctacactgtcacttgctatttttaactttgagcaagtgacttaagctcttcaggtctgggat

SEQ ID NO: 218896 - DNA, 564 bp, Homo sapiens
aggccttagattttaggttatttaatgtcatttaattttgtattcaaccaatacttactgattgcctgttatgtcttaagcgctgccgcagaggctgcaaatgcagtagtgtcttgaacaaactagtgtaagatgaacaataagcatggcagaagcatagtagcaactaaattcatgaagtgatatcatagtgataagcactatgaagaaagcaacaggataaagagacagagtctggctctggagagggggctgctgaaatagtgtggtgatgcaggccatctgaggatagtaatgaaatttgggggatgtctatgggagtagatgctgttggatgaatctttggagtactcccaaatgattgttcattcatttacttactaaaatatttactgagctccttctctgtgccccaggcattgttctggaaactgagggtgatgctttgaacaagacaaagaaccatgccctattgaagcttttgttcagccctcaaatcactccatttcaagggaccaaaagccctattaacttaattcccttattttatagctgacggaattt

SEQ ID NO: 218897 - DNA, 514 bp, Homo sapiens
cagtaacacgaatgagtcttacatgcattattctaagtgaacaaaatctaaacttgaaagactacatactgtgtgcttccatttagatgatgttctggtaaaggcaaaattacaggaacagaaagcagattgttggttgcctaagggcaagtggcctaaaaaaattttggaagggtaatgaaaaagttctagagtttaatggtgtttatggttatagggtgtatgtgtttgtccaaattcatagaagtctacatttttaaaaaatgaaatagttgtgtaattataccacagtttttaaaagtattaaatgaaaatagttcgccttgaatcttgatttgttaattcatgctgtttggttgttacttaggaaggaacttaaaccatcttgctatggcaacaaagttggtgtattttgtacccatgacaccgttgttcattgagtattaaataatgctcatttttaaacgcattattaaattataaaaggaagcaatgcattttgtaatctaaaaga

SEQ ID NO: 218898 - DNA, 339 bp, Homo sapiens
tccctgagcttggggcttttgttgggttccttttctgccaatagcagttgcagaagtaacagccccgaaggctgtctcactgccactgcggtgcctctgagtgttttgaagtgaatctgtgtccgttttttttttttttttttttgccaggaaaaagtagctgtgcttttgcaaaagagaaaagccattgttttaagagaatacattactttttagaaaaagtttgtacaggtctgtaattttatagtgaacaaaaatttcttacgttcttgcagtttgagaggtactgtgtaccaggcaatgtttttcaaatacttgctcccttctgtcgtcttctcg

SEQ ID NO: 218899 - DNA, 428 bp, Homo sapiens
aaaaaaaaagcaaattgccaaatcttatgcttatattgattctatttatgtaaagaaaaaactattctatacataaacatgcttacacacatgcacgcacactcccattgataaaaagccctggaagaatatacacaaaagtcatgcttcttaagtgttgaatatagaaaggaaagaagctttcacttttcactttacacactttttaaattttaagatactgggtctcactcttcatccaggctgaagtgcagtggcatgatcatagctcgctacagccttgaactcctgggttcaagggatgctcctgccttagcttctggagaggctgaggcacaagaatcgcttaaacccaggagttgaaggttgcagtgagctgagattgtgccactgcactccagcctgggcaacagagcaagactctgtca

SEQ ID NO: 218900 - DNA, 276 bp, Homo sapiens
ctagggggaggggaaaaggcctctgcaaagttgctgtgtcattgccctccatgctgcagccacccaaacggggccgcttgtacttttgggggccagggcctgatccctggctgggggaaggggactctgctctcctgacgctcattttcccccgccctcccggggtttgccctactcggggggtcagaagacaggagattggcggccattttagacgcagtaaccgaggttggagttgaagggctactgcagaggagggagggtggcgtggttgca

SEQ ID NO: 218901 - DNA, 1422 bp, Homo sapiens
actaaggtaggaggattacatgagcccaggagttagtggctgcagtgagctgtgattgtgccactgtattccagcctgggcagcagagtgagacaccaacattaaaaaaattaatttaaaaaagaaacagccgagtgacttttattttaaaaatgtgtatgcagaatggtttttacctttgttcttgtttctccccaccccccatctttttgaatggtagatttgtacttttgattttttgttctttagttgctttttgtcagtagaaagcttttggggataaagaccttaaagtatttaaaaatttatgttagaaaagaagattccattatgtctttgtttcacagatcacttaatataacttagccaggtaaattttgcatttcacactgattacttgtttggccattgtgtttggataaggttagcctctgcagttttaatgtattgggtctagattagaaacagactttttggattctgtattctttgccttctttagtccgtgatccccttgctcttggtattttacttgtttctgttagtagtaaaaaggaaagcttttatgccatacatagcagcttggtagcagacaaaatacaaataaccttctaaggaatttgaagaatatttttacattcttttagagtgggatatgccgtcagagaaagtaaatggaatatcttgactgtaaagacttagttaaagtgttttagtctccacagtcagggtgagtgagctgtatagaggaagtcatagtggttggccaagctgagatacttgcttatacattccaaagtgcccttttctttcagaactcctataatcttgtcatcccaagtagaatcttgtgtacctctttcacaaatggatctgaaaacagtgatcctccaaagcatatctttccttttttagagttaaaataccaataccacccagaccttagattctaaatactattattcactaaagtgaaccggggcttcttggagaaatgactgattctggggctgggccagggaaaaaagggccccttcaatattttggggacatttcagaagatccagaagccagcttggaggggtttccactggccaagtctgggataaatttgagtgtcaaaataaataagaacaataaggccgggcacggtggctcaggcctataatcccagcactttgggaggccgaggcgggcagatcacctaaggtcgggagtttgagaccagcctggccaaaatggcacaatcgcgtctctaccaaaaataccaaattagtcaggtgtggaggtgcgtgcccgtaatcccagctacttgggaggcggagtcaggagaatggcttgaacccaggaggcggagattgcggcgatctgagatcatcccattgcactccaccttgggcaacaagagcgagactccatgtc

SEQ ID NO: 218902 - DNA, 375 bp, Homo sapiens
gaacccaggaggcagaagttgcagtgagccaaggtcgtatcactacactccagcctgggtgacagagtgagactttgtctcccccaccaaaaaaaattggaaaaaaaaaaaaatcaaatgatatttgttcacaattgatatttttggtatatcaggtgtaaagatttttaacaaagaggaaaaacagaatttcaactctcaaaaacaaaaatgtaagatttgattcattttaatatgaaaatatgtattcatattttgttaaaaagccagactctacaatagtaaaacctgttttctgatggtgttcattaaaatgctaagctataagaaatgcgttaattattagaagtgaagatcaagtctcttcctgtacta

SEQ ID NO: 218903 - DNA, 197 bp, Homo sapiens
tggtttgggtcacaagtgagatgggtttggcagcctcggtctggggcccatagaagatcctgtggtcacgagctctatcggggttggtgtgtttggccacacgtaagttgtcaggcatcctcagcagggcaggatcaagatcaggaccagacttggcaagggacaggcagctggggtagaaaagtctctgtgccaca

SEQ ID NO: 218904 - DNA, 553 bp, Homo sapiens
acatgtcgaggctgtacctccatcacagaggtcctggaagagtcaaggagatgaaggtttagacaagctgcacttttggaggccaaggcggggagattatttgaggttaggagttcagagatgagcctgagcaacatggtgaaaccctgtctctacaaaaattagctgggcatggtggtgtgcacctgtaatcccagctgctcaggaggcaggagaatccttgaacccgggaggtggaggttgcagtgagccatgatcttgccactacactccagcctgggtgacggagcgagactccatctcaaaaagaaaaaaaagggtacttgacaaccttggtcctcggggaaatcaaattaaatccaacgaataccaccatatacccaacaaaatgactaaaattaaaaatactgataatttgcagtatcagtaaagatatggaccaacagtgttaggaggattatgaattggtatagccactttgggaaactgatggtatctactacttaatgaaataaactgacccgagcagttctactgctttgttctatacata

SEQ ID NO: 218905 - DNA, 563 bp, Homo sapiens
tgctggcaggagagtgattatctatcacagaaatgcttttagcagaatgtacttggtcgtttagaattgcttatggttaacaaagtagaaggttgtggatttatggggctccctggaaaatgtcacatataccacatatgtaactatctgcataaaaattaagatatttgataattgagacaggtatctccatgtaaataaattgtctgcatacctctctagaagtctcatctatctgcctgggcaagggagtatctaatgacagaaccaaggatctaaagaatcagattaagagatctaaataattctctgatttgcctatgcctaatgattacctgagttcgtgaaattactagtaaagctttatattttgtaagatcttagattctgataagtctaatgtcacaatccaatcagtttttcctatctcaaggaatcatgtccatataatggaattaatcctgaaactctgaaaagttttaatattctggggtcagggtagagagaaagaaaaggagaaagagagaaagaaagagaaagaaagaaagaaaaagaaagaaaga

SEQ ID NO: 218906 - DNA, 502 bp, Homo sapiens
tggagacagggtcttactctgttacccaggctggagtgcagtggtgtgatcatggctcactgtagccttgaactcctgggctcaagcattcatcctgcctcagcctcccaaatagctgggaccacaggcacacaccaccacccccagctaatttttaaattttttgtaaatagaaggtcttgctgtgttgcccaggctagtctctgactcctgggctcaagcactcctcctgcctcggcctcccaaagtgcttgggattacaggcgtgaaccaccctactcgacccattctggggctttaattcaggaatcatagaaaatctcagctttggtggggctgggtctcagtgtcttctgctgtctgtagcttcagggcctccatctttcaatcagaggttccttctctacttgctgtgtcactcgaccagatgacgggctctcgtctgacaccagccccaggctgccaggaagagcatattgcagattaaggagcttcatctgtt

SEQ ID NO: 218907 - DNA, 256 bp, Homo sapiens
tgcaatatgatgcacacgttgtgcggccactgtggctctaaggcctgtcaccttccgaagtctacctgtggcaaatgtggctaccccgccaagcgcaagaggaagtatgactggtgtgccaaggctaaaagactaaaggccacagggactgggcgaatgaagcggcgtggatttccataaaggaacaacacctaaacccaaaagggcagctgttgcagcatccagttcatctcaagaatttatttgcttttttttt

SEQ ID NO: 218908 - DNA, 355 bp, Homo sapiens
tgatctgtgtggcattggtaaatcaaactgatgagaattgctttttaattaggcatcctttttgatttttattcttgtgaatttatttgatagatgaaccctcgtaaagatgagggacaaatcaatgactaggcatagtaatagtatcggtgcattcctttggcacatgtcctatctgaccagtttattttactttaatttttgttatattttccctctgcaaccagagttgttcaataccacttcacactcactaggatgtctacacaaaacttgtatatgaatgttctggaatctataacctgtggaccaaatccttctgcctgttttataaataaaggttttttggaataca

SEQ ID NO: 218909 - DNA, 427 bp, Homo sapiens
ctctagcctgggcaacaacagtgaaataccgtctcaaaaaaaaagaaaagacaaacaaggcctctgctcctctggaacttaccttgtaatgggatgagataaacataaataaacaataaattaaaatatcagatactggtaaatgttatgcaggaaattaaaacagtgttatggagtagagagtaactgactcagtgctttagatttagggataagggaaggcgtctccgaagaggtgatacttaagctcatacctgaagagcaagaaagagctagctatgtgagggttttggagggagaatattccaggtggagggagaatattccaggtagagggaataggtagtgcaaaggtcctaaggcaagaacaagcttgatgggattaaaatgtagaaggaaaccaacatggttggagcataatgattgc

SEQ ID NO: 218910 - DNA, 428 bp, Homo sapiens
agtatctgtgcttcacctcctggcttcaccacatagtataggtcaaggtcatagtctcaatggctggttagcactacatagggcataaccactggaaaaatgactccataagacacaatttggtgactgttgattagtagcaccatcctcatatacaaaacaaaacataaataatatattcacttttatagtacaaggctttcatcttacttaactctcagatatgtaacctaaacaaacaaaacaaaacaaaacatacaaaacaaaaaaaaaacaaacaaaacacaacatttttgcccagatagaaaaagaagacagccgagtaaggatctagaggaagtctggccgcggggggtccacctgtaattcctagcacggaggtaggccaaggaaggaggatcacttgagcccaggagaacgcgtccaaa

SEQ ID NO: 218911 - DNA, 292 bp, Homo sapiens
gaaaaatattctcagggtatctatctccaggttcctgtttggtcgcctgtggtcccttgagggcagccctgacccaggccaggacctgcacaggcatttgggaggtgcagatgggggcttgtgatgcccagccctggctggggcatgggagttggagaaggatctgttcatgaggaactggctgcttgctggggcaggagaattgcttgaacccgggaggcgggggttgcagtgagccgaggtcatgccactgcactccagcccggttgacagtgcgagactctgtctcaaa

SEQ ID NO: 218912 - DNA, 741 bp, Homo sapiens
cctgacctcaggtgatccacctgcctcggcctcccaaaagaatattaattgactttaaaccaaacaccgtaaatgtgttcttcctgactctgagatgtatctgaggatattgtgagatctttattgaaatcatccaaaatgggatgccaagttttggtgtgcatattaattttttttaatccttgaaaaaactatcaactgaacatcttgcttatggatataatttacatgtcttagtatgaagcccttaggatctgagtacagcacaagtgtaatttaaagatgtagctgagacagaccaaaaactgatcagcatcccatagagtgaaataaccatgtgccgcgttaggttggggtgatggtgtcaggactatcacacattgagttggttataaacctgatggtgatttagttgtttggaggagcattttcatcagaagtccaagtaatcttgcattggaaagtgaattagaaaatgcaaatccagtggcatgagccttaggatacaataccttattagagttgggatacccagtggtgcagtgtagtcagtttctatttggagctcggtcagatgagttttagttgatatttaggtaaggactcaaaactcctgaagtattatattctttgatttgtttttcaacttgcttcttaaaattaacaagcaatgccaagacagtattgtatttctatcttttctttgtcataactgtcagaacaaatagcccatagaaaagc

SEQ ID NO: 218913 - DNA, 1028 bp, Homo sapiens
tcgactttctaaagccaaattatttgacattggttttcatatagcttggtaaaagctgttattttctcccatgttctttattctttgactgttataagtatgatttgtacagagaaatggcaatttcaaaacagagggctttgatggattaattgctttgaattgatccctcatctacagtatcttgtcaggtacttgagaaaataatgtacttaaagtttcctcttttgactttcttttggtattctatactgtaagttggggaaaaaagtattttctcttcctgctaattgggctacttgaaaattcccaccaactttgccaataccagtgttctgtataacccagaattcagaattagctgcaattaagggaattcacagcttttctgtagtcagagagcaaattgaaattaaagaaaaaagaaatagtgggaggacaaatgaggttttacctttacacttgaaaacagatttaagaacaagccttatacctagatttattaatactttgaggtatgagagggaagagaagcttagaaatacggcagaatgggctttctttgttcttctcccagctatgctgtttttatttattattgtatttttaagagagaagggaagtgtctctcctgggtcacattaattaggaaatacagagtgttttcataatgcgtaaagtctagtccatttaagtcttgtttcaaaatgctatttatattatttgagcaggaaggcagagaccttaaactgctccacccaattcattttacacaaaagattaaaaagaaaaaaacagtgtcaaaaggtcaagtgcccagtgttgcacaactaatgataggcaaaacaagagaggaggggaaaaaaaagaatcctgactcccgactcctagttcagtgtgttcttcactgttagaaggtgctgctgaacatagttataccatatgaagatcacactatctatttgagattgtagaaatttgattactgcagagctctggctgggctagattcacttcttattctttat

SEQ ID NO: 218914 - DNA, 899 bp, Homo sapiens
atacttctccacagggacgtgagaaacatgaaataaggaagtaggacaccatcaaaggaacgtaattccctagtaacacactccaatgggaaaaaacttaatgaattgccagaaaaggaattcaaaattatgatcgtatggaaactcagagagatacaagaaaacgtgtagacaatcaatagagttggggaaacagttcacaatataaacaggaaattgaataaaagagaagtaagaatcaaatcctgcagctgaagaattcaatgaatgaaaaaacatacagtggagaatttcagcagcaaacttgatcatatgtaagaaagaatctctcaacttgaagataggttatttgaaattaacaagtcagagacaaaaaaaaagaaataagaatgaaaaataatgaagaacgcctacaaaacttatggaacattaggcaaacaaatatttgtattatgggtgttccagaaggagagaaggggaaaggcattaaaaaatctatgtgataaaatctgaaaacttcccaagtctacggagatatatggacaacagatccaggtagcccagtggttcctaaataagagtaaatctgaaaacatcctccccgtgtcacattacagtcaaattgtcgagagtgaaagagttcacaaaacagcaagagaacagcatcaagtcacataagagaatccctattagactaaaaacagatttttccagagaaatcttacagcctaggagagaatggaatgatagaattaaagtgcttaaagcagaaaattgccagccaagaaagaatactgtgtccatcaaagccatccttcagaaatgggggtgaaatagtctttcctagacaaaaattgagaaagttatacatcttgagagagttttacattttgaaaaga

SEQ ID NO: 218915 - DNA, 528 bp, Homo sapiens
aggtttaattgacccatggttctgtatggcagggaacgcctcaagacacttacaatcatggtggatggtgaaaggaaagaaaggcacatcttacgtggtggcaggagagagagagagagagagaaagtgcaaagggggtagtgccacacagttttcaaccatcagatcttgtgagaactcactatcaagagaacaacaagggggaagtccacccccatgattcaatcacctcccatcaggcccctcctctgacacgtggggattacacttcaagatgagatttgggtggagacacagagccagaccatgtctgcaattaacttgatatgtatagcattttaattataatttgactagttttctagttaaacaattatatgtggataaatttttaagtttaaaataaaggtatactattgttacaaaattaagcagaaatacagaaacgagcactacaactggaacagtttttgttttaaagaaaactgcattgtaattttacaaataaaataacaaaatgaaaagata

SEQ ID NO: 218916 - DNA, 497 bp, Homo sapiens
atggctaggaaaaacagcctcctccaaagaagtgtctcatgcagctgtccaacagaagtaatgtgagccacatatatacttaaaattttctagtagccttatttaaaaattaaaaataaatagttgaaatttttagtgctatatttaactcagtatatccaaatactattattcctgtatgtcatcaaaataaaattattattgagatattccttctttttctgtactaagtcatggaaatccagtgtgtatttacacatacagcacatcacagttcagactagcacttttcaaatgctcctagctacatgttatccaggttgctgtattggacagcagggtccatcaatggcttgactgcagcttcagataggagaaagaaagggatcatgtgaaatgtctgttcctttgcagaaaactaaatgtcagatcttgaaaaggaaaatgttgacagaactgtctggaaaatataaccttctgatgtttatttgcacaga

SEQ ID NO: 218917 - DNA, 212 bp, Homo sapiens
agcggctccagtgcacaatgcaagtgctactgcctaaattctaaaatacccctatcttcatattcttatcattgtctattaatttttttaaagtggactgtaaaaagccaaagtagaatgaaaactaaggtcttaatccagatagtaagcccaggccatctggctgctgcttttgtgccttgttagagatcttctgaagagggtatggggcc

SEQ ID NO: 218918 - DNA, 419 bp, Homo sapiens
aaagaaagaaaaagaagaaagaaagagaaacagtgtccaaatggagttctgctctaatcacaagacctcagtacattagaaagaccacagggctagttactgctgggttgttttcaggtctgctgcctccattgtcctgaaggaaaccacacttcccaactggtctgggccaataggaagcattggtggaagacaagaaaacaagagggaagagggagaagcaagggtatccacccaacacatgcacttcaggtggcatctctagccccctctagagtcttggctcccatcagacacagtcttccactaccatcttggtcctagctccctccaaggttgctccagtctctgggatccagaaacaccacctgctcccatcatttctccaaccctacggatgatgcagttgcttcctgctg

SEQ ID NO: 218919 - DNA, 479 bp, Homo sapiens
caaggctacaaaagaatccagtcagtgctctattcactacaccaggtggtttctccaattatagactgttcagcattgtactccagccaaagggtctagcagtctgaagcagtggcacctcgtgtcacttaggccctctgaggggctgtgtttctggcttaagtgagattgagtaacagctttatctttagcgtgttgagggagtgctgggtgctcaggaataatcaagtgccactttgaatgccatcattgctggagtgacagttgtggtccagcacattttgtgttttccttacgttcttttcccattttcagtccccaccgccccagcctcccttggcaagcacaaaacgtcatgagtttgtatcaagcacatgactgcaggcatttgcattagaccaccagtgtgactgtcacattggagattagataagctgcaattgcattcatgtttttttccaggcaaaagctacacaagg

SEQ ID NO: 218920 - DNA, 417 bp, Homo sapiens
aactggatacccacatgcaaaaaaaaaaaagaagaagaagaagaatcttgatacagaccttccaagcttcacaaaaattaactcaaaatggatcacaactgtcaaacacaaaacccataaaagataatatagaagaaagtctaggtgagcttgggtttggctatgactttttagatgtgacaccgaaagcacaattcgtgaaagacataactgataagatggacttcattaaaattaaaaacttttgctctgtgaaagactatgtcaagggatgagaaaggaagccacagagtgggagaaaatatttacagaagacatattaattgctattaaaaatatacaaagaactcttaaaacttaataagaacacaacccaatgagccaaagacctgaacagacatatcaccaaagaagaca

SEQ ID NO: 218921 - DNA, 294 bp, Homo sapiens
cacaacttccaccacaaggaaagtctattatcatcttcaagtaaaagaatgcctggtggtaaaggttagctcatgtattttaagaagagtgatgccaatccaaggggaaacgtacctagccctggatatgataccctttgtgtcgtttggaaagtgatgctgttaatacctcagttgaaatcttcacatctcatagtacattacctatttttatatgaaatcagctgcttcataattaaatttgatgcatgacatttttgaatgtaaaattttactagtaaataaattgaacaa

SEQ ID NO: 218922 - DNA, 486 bp, Homo sapiens
tacctctctgcttggatatctgattggcatctcaagcctagcatgtccaaagcttaacttcatttccttctacacactttctcacccctgccatacccaatctgccccatcttggtaaatgtcagtgccatttttaaaattgcaaaatcctagtgctgctattgacctctgtctttagcttctacttcacatcagcaaatcatgtctgctcttcttttaaaatatatctgaaatctgaccacttataatctccactgctaccacctagttcaggcagctgtcatgtcttatctggaggtgatcagttgggtgccctgttccactcttgcctttcgaatcaccctggaaagattcttagatctctcccaatctactcatgtgggtttccatttctctcggagtaaagaccatagcccttgtaaagacaatggcctagaaagtcctatgtgatctgctctcccatctctaccaaacccagtcagtctc

SEQ ID NO: 218923 - DNA, 1077 bp, Homo sapiens
ctgcagaagttactgctagccaggaggcccgggggctccggctgagtgacctggaagacctggaggaagaggaggaggaggaggaggaagctgaagacgaggaggtagtggccacagctggggacaggctgacggagttccgaaagggcgcgcagtcactgcctgggccgtgcgctgcagctcgagagggccgattggagcgcagggagtgcggcctggctgcgccccgcttctccttcaatgacccttccggatcggaagaagctgacttcctctcggcggagacaggcagccctaggttgaccatgcactacccatgcttggagaaaccgcgcatctggtctctggcgcacaccgcgacagccagcgctgttgaaggtgcacccccagcccgcctaggccacgaagtcctgagtgccgtatgattcctggacagcctcctgcctctgcccggcgactctcagtccccagagactccgcgtgcgacgagtcttcctgcatacccaaagcctttggaaaccccaagtttgccctgcagggactaccgctgaactgtgcgccgtgcccgcggaggagcgagcctgtagtgcagtgccagtacccgtctggagcagaaggttagcgcaatggctgcgatttgcgaaagaatcttggaaatgggccccacgtttcgaattcatctccaggttaagaagctgccagaccttgccagggaccaggagctctcactttgcctaagagacagacacacagaaaccctcctagcagctgtccttgcacgcagagctggggtggtgggccgacttgaaccttagcagtccccacgggagatggcagggcaccttggggaaggccaagtgggaggctgggaggctgccccacccaccgactctaccaagtctctcttcctcctgtggattcagcaaggcttcctctcctgctcacccctgtctctcacctccaccaaccccactcactttgtaacttcatcactgacccggccaataaggaccctgtgcgtcttctccccctcctaagcccttgtgtccttaaaaataatcagtccgaacccatgta

SEQ ID NO: 218924 - DNA, 429 bp, Homo sapiens
ttttatttctttagttgtagttgctaagtagagctgttgctgatgatgagatgtttcatgctgagataatgaaaaatttactgtattggatcatctcagcagtcctattgagggttatttcacttatttccatgatgtttcaattaagctttttgtagtaaatattgataagagctattattgtacttgcagatctggaattaataagagaccatgttgggggaaaactacttgttacatttaatcacaggctcatctgaaagtctttggtgttgtatgtgaagttgtatgttcaattatatagtatacataaaaattataatgtatacataaaaagccactgagatgttttgaaatttattaagtttacgtataataactctcattaaaattattttctataatctttcttgtgaggtctagttgtta

SEQ ID NO: 218925 - DNA, 326 bp, Homo sapiens
atatggaaaatccaactgatttgtcaaccaatagcaagttacccaggaagtggtaattgattaataatgaattaccattaacggagatgaacatttttctgtatacttactgttctgccacaaaggagtttatttatttttttttggtatcaaaagtcatgtttcttttaggaaatcagattcagaatattttagtaatacatagtggttaggagcatagatttggagagaagtaaacttggccttgaatcctggctctggtaccacctggctgtgtgaccttggctaagttacttaaatatctctgaacttctctaataataact

SEQ ID NO: 218926 - DNA, 471 bp, Homo sapiens
gaatatacatagataacgtgtatttagaaactttggtgaagccagtatttgtttttagtaacctttttatgtatttccttctttgattagcattgtcttcagtgttaagaaatgtggactcctgtgaggtgctggaggtttgaatcatcttgaaaactttccaatcttgtctagttaccactgcagagacactaaggaatttaccagaaaaagatatttgatacaagtgatttaagaaatctcaacatttcctgaggccgtatcactgggcaaccagtgatgaaaactatgaatgaattgcacacctggaagattttttaagctaatgacagtttcttcaaagatgtcaattatttgccttggaaattttataaattgcatttctatgcacatcggcctctagtgcttaccactcggtttattattcataatctgcaattcaataaaggctttgtgttttcatttatcttc

SEQ ID NO: 218927 - DNA, 290 bp, Homo sapiens
cagagtagcgggtgagctgggttatgggagagagagaagaagaaaagaggacgtaaaccataagggagataagataaaacagaaaatcaatagaagtgcctaaagttgattcatcaagagacagcgccacgagcgcatgatttagagatgcaggagaaccaccaggagttctaaggacagaaagaacgagactgcctctggggaaggggctgtggcttttcatttttaacctgccttcctatatgactttgggcttgaatatatgtatgtattcctctgatagaaataaa

SEQ ID NO: 218928 - DNA, 523 bp, Homo sapiens
tgtgtgtgtgaggatatacaaatgtgtaagacatacttcccacaggcaaagagtttgcaatctagaggaaataagggacacaaaagattataacaaaaggaagcatgtggcatgggccataagacagctctagcaagagtgagccattcaggagcgggagactactgcttggggagatgggagaagacttcaggaggcggcttaaattgtgcagtcgagtttcccacatttggggaaatcgcaggggtcagcacatccagagggcaatggataagcctcgccctgggaaaaccacctttgtgatcatggtatctcccctgccagttaagcatatattattataatttcttaatcgcagggaaggctttcttgtcatcacttcccttaacatagtttgcccccatccttatccctgacaaaaacctccccagcaaagtacagcatagatttacatgcattcattcaaatctggtcacatttacagaaagcaaccaacttttgtttttcttttttttccttttct

SEQ ID NO: 218929 - DNA, 395 bp, Homo sapiens
ccccctccaacgattagcttttgcaacatggtccagtttctagagggcactagaactttgtgccagcgctggcgagataccatggtgccatcctcctttctatagttccagtttagcccttccctgcctttaaggagaagagatcttcatggtgacatttgagatgatggaaactagatcgtctctaatgttaggtcaagctatttctctggatctatgattttaagatagaacaggctggttctgagttctggtgagacggagaccccggtggcagtggaaaaatcagaagcacaaaggaaaactcttggcctctgctttctcctgtagcacaaagagggagttggctggatcttttggtggagtcaggaaagacaggctgagctttctagcct

SEQ ID NO: 218930 - DNA, 380 bp, Homo sapiens
ctccaaattgatcagttaattaagttgatctctacaagactgttaaagaaccaggtctttttcctttcatgttatgcagttccaagtaaactccctttactctggtatccttatcagaggcagacatcacaggaagtggagcattccttatgaatatcttaatctacacacaaatagatttttttcaatgtgaatttggatttctaaaagcacgcttactgcaagtacattttgcagcctcttgtttccagatcagaattgagtgattttctattatttatttatttattatttgtcactttaaaatatgcaattcttgggatcatgcagaattgctgtatatttgctttgaagattagaataaaactggtagataatgt

SEQ ID NO: 218931 - DNA, 589 bp, Homo sapiens
ctattactattattaaaagtagaaaagttgattcagaatctctggggctgaggccagagcatttagcaagtttctccaggtgatcctgatccagtagtttgagttcttgttcccatgtttattcccatacaaggccagtcttgaataaacagcattgccattccagatcaaggactctaaatactttttcataccatgaaattcactaggctataattaaaatagactaaatttactaagacataattaaaatggattctaatgttcaagctgaatgatcacagtattcacttttatataatagtctatattcagttcattacttctcattatcctgaatgtaaaatgtgctatggaaagtcaaattccatatattttaggaattagacaaaatctttatggagcacatagctcatcttagagttgtaagaaatatttgtatccgatttttttttgtaaaaaaaaaaaacaagattcacaggacagccttctttgcttcccatcaattttcttccaataggtttgtgccaaatgtgttgtgaacttaatgatttgtttatgacaataaaatttgataaatatatactaa

SEQ ID NO: 218932 - DNA, 321 bp, Homo sapiens
agatcagaattttattgccttttgccgtagactgctgcaagatttccagagcaaagagaaggtatagtgttccttaatgtgagttatgaagatcaaaatacagcaaagagaagatttcagagatttaaaagtgataatttttactgaaatttggaaatatgtctccatattttaactttattttataaaaaagaattactctgttttttgaaatggccaagcattaagtaatatatgaccgtgaatttcttgagggtgggaaatgtgactggattttatatttcgattgtatcacatgcagcctcacacattgcgctcaac

SEQ ID NO: 218933 - DNA, 488 bp, Homo sapiens
cccaggagagttgagtacagacggttgcacaagaagcataaggccaatgccctatggtctctgtgggtttattcttttctgccacatgtgaggcttcggtttccatgtaccaatgtccatctactcagaaatcatgattgcaggccaatcaacaacagatagtccaaactccgtgatggcttggggtttaggggttcagtaggaagctctctggcctgaagcctgaaaagtcacaggttcatattctgcttagggaaggagctggttaggtatatccaaaatcatatagggctagtgaaatctcatctattcattcagtagttactctggatctcatggtctaagaagtcaactgggctgggctagggggtagaggaagattcaaaacatcaaaagccacaaaatcaaaacaagaaaaagtgttgaaaatcataggccttggaaagcaaatagtaaatgtaatagtcattaagtagcaaccaatgacc

SEQ ID NO: 218934 - DNA, 357 bp, Homo sapiens
gcacaggctctgctagcccctgggtgaagatggcgaaggcataactggctttatgcagcatatgtgtttctgctaaagtgtcagttttgctttgtggggagtggagggtgtgttttcgggatggggagacgtggtaacctgacatgtaacaacctgtccggagactagcttctacgtgtggatatgaatgggtgagaggatttctccatatccttctggggcgattcctcaactgggagaaggaaaccctgcagagttctcatgggagtctgcttcaggtttgaaatttaagagctagtttggattcatgtttagtaatcgaactgaaatctaagtctagctgtctctctattcttg

SEQ ID NO: 218935 - DNA, 319 bp, Homo sapiens
agctctccacttcagaaaagtacctctgtccttccaggtgcccctcagactggacatggtgaattgggatcatttagtctaggaagatttcaatgaagaccccagtgtcaactgggagtctttccccccatccccaatccagagcttttatgccatagttggtccaacgttctgtggaccactaaagagcaaggatggactgccccaaccagtagttgtaatttcctaaaatcataaagtcattttactaaaggaacagcttcccctaactgtcagctaaaccagtgcaatccaatacaggttattatcccaaaccctc

SEQ ID NO: 218936 - DNA, 594 bp, Homo sapiens
aacaaataccacagaaatacaaaagattattaaaggctactatgaacacctttacatgcataaactagaaaacctagaggagaggaataaatttctggaaatatacaaccctcctacattaaaccagggagaaatagaaactctgaacagaccaataacaagcagtgagattgaaatggtaataaaaaagttgccaagaaaaaagtccgggatcagacagattcacagctgaattccaacagacgttcaaagaaaaattattaccaatcctattgatactattctacaagacaaagagggaatcctccctaaatcaatctgtgaaaccagtatcatcctaataccaaaaccaggaaaggatataaagaaaaagaaaactatagaccaatatccctgatgaacatagtgaaaaaatcatcaaagaaatcctaaaatcctaactaactgaatccaacagcatatcaagaagataatccaccatgatgaagtaggtttcataccagggatgcagggatggtttaacatatgcaagtttaacatatgatacaccacataaacagaattaaaaacaaaaatcacatgatcatctcaata

SEQ ID NO: 218937 - DNA, 136 bp, Homo sapiens
acaaagcaatacctaatcaatactgggtgggaggtgcttacagaactgaaaggctgtacattttgtaggccctctgaatttgctttttttccctcttaaatggggattaatgacatcattacctgatcttcagtca

SEQ ID NO: 218938 - DNA, 529 bp, Homo sapiens
gtggtccgcctgcctctgcctcccagagggctgggattacaggcatgagccattgcacccggcctttttttgtatatttagtagagacagggttttgtgatgttggccaggctggtctggagcttctggcctcaggtgatctgcctatctcagcctccttaagtactgggattacaagtgtgagccaccacgcccggccccgaagtatgtgcttttaaagtgaattcttctcatagaactactgagcgttttcacttactgcctctgagtattaattttggtttatgtgataattctctgaaatattattcagatttgattatatgtaaaactttttcgttaaatgaaatgttgaacaaccctctgagtatagtttttttttgttttgagacggagtcttgctctgttgcccacgctggtgtgcaatggcacgatcttggttcactgcaacctccgcctcccgggttcaagtgattctcctgcctcagcctcctgagtagccggattacaggcatgtgtcaccacaccc

SEQ ID NO: 218939 - DNA, 97 bp, Homo sapiens
cttgacctatctgcctgtacgtaagtagctaaaactcatcaatcacctgaactaaggcagtaagtgggggagaaaatctttgaaaaatccaaattag

SEQ ID NO: 218940 - DNA, 338 bp, Homo sapiens
tctgatttggaatgctgagctttttaaatggaaatatagaaggacggctgaatcagcaaaaatcctttatgtagtttcattctttgcaagcttgaccagtcattctgaaacaggctaactgaactgatacagtggcaagtgaaaaagacatgcctttacaggatgagtcaaaggagttttagaagaaaaatccaccagagaaagccaagcaaatacagttcagagttacatttcttttccattttttcctgaactgaatctttggcatgcatatcctgaattgggttattgaatataaatctagccttgtacaatggatgccagatgactacatattt

SEQ ID NO: 218941 - DNA, 460 bp, Homo sapiens
ctccaaactcctatttcagatcaatacataaggttcagctgagttcggcctccaggcccaagaaagcaaaagccagcaacccgggggctggtcggcggctccctcgccagggacgccccacagcgagaccatgcctctcccacctctacccccgaaaaccaaaacaaaacagaaccaagcccaagcggtgcttgctcgtttcttttgtcttgctcaacgctgaccactttttttccggagaaggttaacgttaagggagcccgggggagctctctgcgaccccgccaggtgctccccgaacccccggccccatcagaggaatgaggcgaccaccgagcggcgttgggcggccaggtcctccccggcacccccgccccggctcctggaggagggcagggactgccggcctggggcagccagggaccgacgggacccccgcagagccaggcccgaggccccg

SEQ ID NO: 218942 - DNA, 449 bp, Homo sapiens
gcccgcaccttgccaaggccgccatctcttgagtctcctgctgtatctttcacctttatctgtgagcccctgtgggcttgtgtgactgcattggaaccacctggataattgccctcttttaaggtcagctgattggtaaccttaatgaaatccgtgaagtcccttctcacagtatctagatcagtgcctgaaggaataaccagatgggctcttgggagcacaggtttcgaattctgcctctcacaggaggtgagggacgatgaactgctgcaaacgaagtgggagccgaggagctgaaagaccacactgctggcttcagttgcgtctttgcagtaggcgtcaagatcatgtgataaataagacatcctgctaagtgcacattttcagctgcttatactgaaaactatataaagttaaaaagtttatttccataagggagtggtccattc

SEQ ID NO: 218943 - DNA, 693 bp, Homo sapiens
attgttgtttcgttgtggtgaatatgagtagattttttgggaaaaatgtcttcaagaagttcttgaagctttcctgaaaccaggtttgtgaggaaggtctttgttcttaacctgcgtgtattaagtttaaggcttgaggtgatctgtcttgtcacataagtagttcccttcagtacggcatgtctgcctgccctccttccttcctagtggcagcttttctttagttctggaatcagaaaatttcctagaaacccaggggacgctgtgggtcatggctctggctcggccgaggcaagtgccttttagcctttctgggtttcagtttccttactgagggtataggcaactcattttacagtactggaaatgacaattgtgggaagagaatatctaaagcaggcttgacatcttgtggagttatataccaagaaatattaaccatttggggaaaaccagtttctaaaaaagggctcaggccacagacccctaggttttgcctcctccagcccttcaagtcccttgtctcattgatagcacccctggtcaccctcagagggagggatactgggcacagttgtctattcctctgacaagcctcctgattttgttcctccaaaccctctgacttctctggcttcttcctcctgaataactgacacacttgcataagtgtctggatgaactttgttttct

SEQ ID NO: 218944 - DNA, 447 bp, Homo sapiens
tgccactgcattccagcctgggcaacagagcaagaccctgtctcagagaagaaacaaaaattactattaccccacctacttctgaaaaaaggatatgagtctatggcttaccaatacaaaacttaaagaggaagaaaccaaaatctgagtataaggataaaagagccaagcagaaggatagtgaactcagggacatcagggtagggaaagctgcagcagtgatggagcacaaggctttgctatgagcttcctggaagccaatgtaaagaagaaactgagctcatttgcttgctaaaaaacaccagatcatcagggagacatcctttccccggtcttgagctagaagaggatatttgctggatgggtctttctaaaagggtcaaagtactggctggtgggaggggtcaccagcagcaggtttgcccaacacacggaaacgctcctccc

SEQ ID NO: 218945 - DNA, 502 bp, Homo sapiens
ccatctacatctcttctcttaggaattgtgattgtaacaatgtggtggcatttgttatttcatatgacttttatctatacagtattctcacttacttacaaactattaccaacagcatgcattttagtatggcagatacaagaaatttgtgtgatgttcccttagaaaccaaatgatattaaattggggaaatggttttaacccactctgcaagggatactttaaaatataatttggcacctatagctcttgcattttaatattcttttaagctgctgtttggaagaaggcaccttataactagccattagcaccaaagcatcacgttggtatcaggattattttgatggagagaatgtcatcatttgcaaataaatcagttatctaacaaaatcagaatcccccaatatgtactcagaatgtactaccctgtatcttctttgtggaccttaatcattaggtaacattggccataataaaaaataataatatgcttcagaaa

SEQ ID NO: 218946 - DNA, 201 bp, Homo sapiens
tccagatatgataaggtgagaaaagcggaactctcggccccaggtgatttccatgaagacaccctacatacggcgggcctcactatctgtaccatgcatccgcctaactctaataatcctggtccaggagagaaacacatctaaaaatgcaaatgaatgaaaaaaataaaactgggttgcatagtaacatcttaagcagat

SEQ ID NO: 218947 - DNA, 497 bp, Homo sapiens
gatatataaggtttagttttcagtattgagctgctatctgtaaactaattatattttgaagtgaaattagtggagaatggacattttctacattgcgtgagcgtctacagctagagagtatctctaggcagtgaggtagctttctgttggctcttagatgggatcacattctttgggcttgacagtggatgttatgtcaaaagtcataactcctctgatttagagatgacatttagagtactgtaggtttatgagaacctgctcttaaccttaaataacagagctgctgccagggctgctgccttccttcctggtttttgggtgcttgagactcttggaaagtgggccagatgcagtggctcctatctgtaatcccagcacttctggaggcttaggcgggcatatagcttcagtccaggagttgtgagattcttggaaatgtaaagcatagttgatgagagggggaattaaatagcagaccggatggttctcaaaat

SEQ ID NO: 218948 - DNA, 283 bp, Homo sapiens
gacgtcaggagttcaagaccagcctgggcaacatggtgaaaccccatctctactaaaaatacaaaaattagccgggcatggtgccaggcacctataatcccagctactcaggaggctgaggcacaagaatcgctggaacctgggaggcggaggctgcagtgagccaagaaagcaccactgcagtccagcctgggtgacagagcgagactctgcctccaaaaaaaaaaaattagatatgcagaaaatgtaaaatgcacaccagattttgaagatttagtaccca

SEQ ID NO: 218949 - DNA, 339 bp, Homo sapiens
cgttgtcttagaaattgacacaaccactcccccttttgctcagcgcctacaccctggagccatcctggattggtcactttcttccttccccacatccaacccaccagtgactctggatgcaggttctacctccatctccaccacactggtccaagccaccaacctctctcagctgggttattgcaatggcctcctacccaggccccagcgttggccttgctcccttacattttaaaaaaataatctgttaaggccgggcgcggtggctcatgcctgtaatcccagcactttgggaggcccaggcaggcagatcatgaggtcaggagattgagaccatcc

SEQ ID NO: 218950 - DNA, 296 bp, Homo sapiens
tccctcccattcccccatcgcccccatccccattccccccctggaggggcctgcgggtggggggtgcggtcctcacgccctttgcgtcccagtctcttggtctctctccccggagtcggggagtcggcaggtccggggcgagggctcagtgaggccggcggagggccgagtcccagcccgggagcgggagccggggacccggcgcgcagggcggaagctcccgcacaaaaggccggagtcccgcacatggatcgaattaaagctccggcggcgcccagcggtgaccccggcggccg

SEQ ID NO: 218951 - DNA, 664 bp, Homo sapiens
gcaaaaggccccgggtggccaggccagcagatgtctttatcagtggctcgacattggcagaggaactctgtggactcctgagggcacagggcggaagcagggagaaagggctgtggatggggatcagggaccctggattctagtctcagctctgccacaggctggctgtgtggcttctcccctctgggccttgacacagaaagctgacattagagttagatcacctctgggtccctgtggtgctagcagcctgcgttctttctggattataagggaccacagggaaaagctgttgcccagtgagagactcattgggtgggcagctgccccaaggaacatctttagggagccctgcagtctggccccatggcaccccagaaactaggagggctgccggctaatcccctggtgataattatcagtctctgtgaaccactgaggcatttcctatcagggtggcatctccagtgaccttgctgagttggtgactttgacggtgaacaggctgggtgagactgggctcactgtggccatcagaacccaagctggcttcatctcccggccaggagagagcctcaccacgtgggctcctaacatccccctcagcagctccgcgtcccttcttcacagaggccattcaacagccagtgattctcaacatgtg

SEQ ID NO: 218952 - DNA, 350 bp, Homo sapiens
tcttatatagaattgctcataagttatgcattttgtttctgcttgtttgcttccactgttggtgaggtcatcacctaatgatgccactcattctctcttttttttctgagacaggctctggctttattgcccaggctggagtgcagtggtgctggggcactggagtgcaacctccgcctcctgggctcaatcgatcctcccacctcagcctccttggtagctgggactactgaggcgtgcaccaccacgtccagctaatccgttctctttttatgcccctgggtggatgttaaatgcattctttacctggagctgtggtctgcttccttgcacccattgttcagagatct

SEQ ID NO: 218953 - DNA, 649 bp, Homo sapiens
ctcagcggcttacacctgtaatccaaacactctgggaggctcaggcacgaggtgtacttgatgccaggagggtaagaccagcctggggaagaaagtgaggccttgtctctacaggggaaaaaaaaaaaaaaaatttgttttttaattagctgagtaaggtgggacaggcctgtagtccctgctactaactgagccactgcattctaacctgggtgacaagcgagtctgtcttgaaaaaaatactaaaaataaaaataaataataaaagtgacaattcttatctaaacaagaatgcactatatgtctaaaactaactaaaaaaaagtagtatgagcattttattcagaaacttggaattaaaagcagatggggggctgggcgtggtggctcacgcctgtaatcccagcacttcaggaggccgagacagacagatcactggaggtcgggagttcgagaccagcctcaccaacatggagaaaccccgtctgtactaaaaatataaaactagttgggcgtggtggcacatgtgtgtaatcccagctactcaggaggctgaggcaggagaatcgcttgaacctaggaggcggaggatgcagtgagccaagagagtgccactgcactccagcctgggcaacaagagcgaaactcc

SEQ ID NO: 218954 - DNA, 628 bp, Homo sapiens
aaggttaacatcagtgatgtcatatggatatgtaaactctcatagatatgatgagcaaggcacttcatctctgtgatattcttcccttaaatccataactttggtctaatcatgagaaaaacagcagacaaattcagattgtgaaacattctacaagacacctacaatatccctccagactttcaaggccatgaaaaacacagaaagactaagaaaatatcacaaagcaaaggaaactgggaagacatcatatctaaatgcatggtggcaccctgcattggaccctggaacagaaggaggaccttaatggaaaaactggtgaaatccaaataaagtctggaatttagttggtggcaatgtatgaatattggttccatagtgttgacaaatatgctgcagaaatgtaaaatgttaaccatggggaaaattagctgaggagtgtaaagtcttattatctttgcaacttttctgtgaaactaaaattatttctaaataattttacatacaaagtttgaaatgcaataagtgattcaaatacttatttgaatggctctgtgattttaaaatattttaaagtatacaaatagatacatataaatccattaaacaatttgaagttcttgctaaa

SEQ ID NO: 218955 - DNA, 486 bp, Homo sapiens
ttttgagatggaatttcgctcttgttaccccaggctggagtgcagtggcacaatcttgagtcaccacaacctccacctcccaggttcaagcaattcttcctcctcgaggagcctcccaagtagctgggattacaggcatgcgccaccacgcgcggctgattttgtatttttagtagagacggggtttctccgtattggtcaggctcatctcgaacccccgacctcaggtgatccacccacctcggcctcccaaagtgatgggattacaggcgtgagccaccgtgcgtggcctgtctgctctcctttatctaaaagaccttccatctaaatacaaagatctttttagaagcttgagatggaaaagaactaaagcttgttcattaggactaagaggattagtattgttttacggatgtgtataaagcctcattgtctaatattatttgacatgctttcctgccaatatcacgcaccagttaatttttt

SEQ ID NO: 218956 - DNA, 704 bp, Homo sapiens
tcctaatatccccttgtcatattccctgccaccctctttagggtcatcaacattcacactggtggctcttacaacataataatctaaattgtcctctatgtcttcaagtcccaaactctccgtctccattctacctacccagaaaaccatacttagagcaggggtcaaaaactcatgtctataggagactgataggtagcaaaagtaagtaaaatggccaagtgggggctgcagtaacctagagagtacctagaaaaggggcagctgttattcagctctagccaactgttgccatgggtagattaaggcagattctctgatttttttttaagacactggaaataaggatttttaagtagaatctcccaatttctaaatgctaggaacaaattcacaattgacaaacacatggtacagcaatcatcattgctgattgtattttgctgggaatgcaaaatacaaaaacctctttgggggaatctgaccagatctagaaaaattgtagatgcacttgccctttgacctaggaatcccacttctaggaatatgtcccaaaattacagcagcaaaatgtgaaatactctgtgcacaaggttattcatcacggcaacattattttaaatggctaaatactggaaacaacgtaaatattcatcacagagactgactaaaaagctatagatactgcagtagtcctgcatagc

SEQ ID NO: 218957 - DNA, 649 bp, Homo sapiens
ctgaggcaggagaatcgcttgaaccgggaggcggaggttgcagtgagccaagatcgtgccactgcactccagcctgggtgacagagcgagaccctgtttaaaaaaaaaaatttttaaagaacgtgcgccctggaacaagtgtttttgcttgaatcctggctctcccatttctcagcggtgctgcctcatctgtaacatggagacctatcagtatccacaccacagtggctgtaagcatcacctggactgagacacggagagaactgggaacagcatcagtcaccaggagccagtgcatgctcgttcagtgttagctgatattattattcaggaaaaggggaacgagacctctgggaatggtgatcatggtgaaaataagttgctgcttttgttcggccttttcccatcttgaggagacagctgtgttaaccacgcctttttattttctgtatttctgatgctttgacatcttggagcattcctgatcctgagggactgcccctcccagggttagctaattcctagagatggtaaatggcttgagcatgcctttcgtgtgcaaaccaccctctccactgggctctcacaccctgggccattctgcacctgtcctcattgccccagggccaagtaccagatgactaaggac

SEQ ID NO: 218958 - DNA, 211 bp, Homo sapiens
atggatatcagggattaatcagatatataattataaatattttcccccattctatgggttgtcttttcactgtcttgatagagtctttccatgcttttaattttgaagaagcccaatttattatttttcttttgtcacttatccttttggtgtcatatctaagaatccataagaatccactgccaaatccaagctcatgaagatttattgg

SEQ ID NO: 218959 - DNA, 231 bp, Homo sapiens
tgtcatgatctggattagttattttaaaaatctacttcgttgaagcatttttttaatgtacaataaatacaccaagtttaattgtactacagttgcataacagttttagaatacgcacagcttgtcaacaccaccacaatcaggatactgaatgtttgcatcaccttaagaaagttctaaatgctgttaggaagtcagtcgcccactcctgcctcctgtctcatgtaacgc

SEQ ID NO: 218960 - DNA, 836 bp, Homo sapiens
catcttcccagaaatatcgtcttttgtctgcaacaactggctggagaaatatttcagaaagatatgtgtctggaacacccaaaggcatacttttcctttctccttggcataggccttgcagcactgaagaaagaccaggtttgcaatggagccttcaacagtcttcatccctatggaactcagggtctcatagggtgacaggagaggagacaaagctaacttgggaagagtctctgtccttcagcttctcccctactgaaacactatatattgggcccacagttcatcacaaaacacacatgctctctttctttctctcacacccacatcttgggaacccaaaaacttgatggcaggtagctctgggtatccttggtctggcattcacccactgggaatctaagctgtcctaaagctcttttcaatcacttctcactgtttccaggcccatgtgggtaggtgttccaggcttcattctttcaggctgatcataaaggcacagtgtgggaaaatcccctactgtgatggccattgctgggaagcaggaaaggctaagggcccactgctgcccaaggctagtatagatgccctctgctccactcatgtcctcaaagactgatatcaggtgcagcagctgctgtctggaatgttatcaaaccaggactgcacaggcactgcattctctgtgtggaagacgtaagaagcaggcgagttgtccaggatgagagttttcctcaggtccctccccagatggctgaggtcattgacatagcagccctggtggaacaaacgtgactcatgggctaggcaaccccagaacacctcacactggtcca

SEQ ID NO: 218961 - DNA, 389 bp, Homo sapiens
agccactatttcctagtgctcttaggcaaatcatttagactctctgagcctgtctcctaatctaaaaattgaagataataaaacctacctcattggatttagtgggcatgtaagtttctgggtgaatttataaagttgtagcacattatacaaataatacttttttaaaaaggacatatggccccatgttcccactctgaaactagtagcccaggatgggctctgctacaaatcagctacagtaaagcttcagggatgggttttctcagttatgaatgccaagcaagcagaggggaaaaactcaggtgaccttgacacttcctcttagaaattcattttgtggctcccagagaagaaaagattttgacagggaacagtctatccttaaa

SEQ ID NO: 218962 - DNA, 416 bp, Homo sapiens
agtgcccagggttttactgggggctggtgaaatgcatacccaaatccagattcccagaaggaaagcagatattctgcatagactgtgtcgtctgtacaaacagtttaggcacagtgagccattctttctttttctgttggtttgtatctttttatttcataaattgtttttacaactccctatggttatgaccacctaatgccaaagtaaaaattttgaattgccagatttttatgaactgtcagaacagtatgtaaaactatactttaaaataaaactataaaataaaaaaattaaaaatattaaaaaaattaaaaataactataaaaggttgagggtcaccaatcattctaaagaatagagacaaaaggagaagcatattgttgtttatttaatataatcataaaagttctgta

SEQ ID NO: 218963 - DNA, 444 bp, Homo sapiens
gcggccgcgtctgcacctcctccctgcgcgccgcctgacagcctgggagagaagcgccctcagagagacatgttgggccgcggttctcttcatccacccatccctccgttcatgacatattgctccattatcttcttgggctggctgctagggaaaccccaggacattacaatccataggcagaagaggcccatagatgactgtcctctggaatcttccaaaagagtctgggaagcttctccagagactagggacaccaaaggattggaagacacgagtgaagacagatccaaggtgaccctctttacgggtgagaaagcagaggcatggagaggatccacactttgcccaaggtcacaggttggatacagcagagctggataggagtctcggttacctggcaaggagaacaagggcttcatagatccatcaccgtctagagca

SEQ ID NO: 218964 - DNA, 366 bp, Homo sapiens
gtatgcatgtttgtgtgcatgtgcatgcatgtttgtagagatggtatgttttcttctttaaaaaagatgacttggcctggcacaatggctcacacatgtaatcccagcactttgggaggctgagacaggtggatcacctgaggtcaggagtttgagaccagtctggctaacatggtgaaactccatctttactaaaaatacaaaaaattagccaggcatagtcgcacgtgcctgtagtccaagctactcagaagactgaggcaggagaattggttgaacccgggaggcagaggttgtggtgagccaagattgcaccattgcactccagcctggagacagagtgagactccgtctcaaaaaaaaaaa

SEQ ID NO: 218965 - DNA, 462 bp, Homo sapiens
acaaagcaacatgcagccaacctgaaagagctcccagtggccaaagctggaaaactttgaacaacaaaattaataaaaatactactgagttataacccaaagaaaaaagtaaatatcagtgagtttatactgataaaaataaatggttacatacataaataattgaaggagaagtgaaaaaaatcttccttgtggaagatttccaaatagtaaacataaaagaaatgagggaaatggaagacaccacttgatgtggtttggctgtgtccccactcaaatcttgtcttgaattgtagctcccataatccccacctgacctgggaggtacccagtgggaggtaattgaataatggctctgattttttcccatgctgttctggtgatggtgaatagatctcatgagatctgatggtttataaagggcagttcccctccacatgctctcttgcttaccaccataca

SEQ ID NO: 218966 - DNA, 269 bp, Homo sapiens
tgaattggtttgaagttttccttcttttcactatcttatagcttaattggtaatgagcagcaaattttaaaagattaaaaattacgggggggaagggaagaggaaagttagtgccctagatagagtgaaaaaaattacaaaagaacaaagtaattattcacaagatgggaaaaagatataaatgaattgaattatgagtcagacagaaaagaccacacacatatatacccacatgcatgaacatacacaaacacaaatacacatgcaca

SEQ ID NO: 218967 - DNA, 224 bp, Homo sapiens
ggattgcttgggcccaagaattcgaggctacagtgacccatgatcgcaccactgcactcctgtctgggcgacagagtgagaccctgtctcaaaaaaataaccaacttggccaacatagtgaaacccgtctctactaaaaatacaaaaattagctgggcatggtgttgggcgcttgtaatcccagctactccggaggctgaggtaggagaatcacttgaaccccg

SEQ ID NO: 218968 - DNA, 782 bp, Homo sapiens
aatagtaaagaaaaagatatataaaatcttacagaaactggaactcagtcctaatgcaacttcatttctatttgataaaggcaatagctgtccaatctggaacttatttcttacaggtaaggggggctactgtatagaattcaaaagcagggaaaatatgttgtcagagttaagatagagattgtatttggggtaatgagcgttgcaggacatgagtagggcacatagcgtgttggtattgttttacgtggttttaagatatacttcatctaggcacttgttacatgttatatttttaatgaatgtgtttagttgtatgcttatgatttgtgcacattactataaattatattttagtaaaaggtgcccttactggcatttatatacaagaaatcaacacatctgacaagaagctcttgctgctaaagagcctctgtgctcctggatcatgccagagggagcacagaagctgcacaccgttcaagcccatttttgaaaagttgttgtagcagccatagcagcaaattcccaaaatatcttgaagaaattgaaaacaagatattttttgaatgagcgtaaactcttgggaatgaattttaatttgagattaaaattgctgttgtctttacttacctaacattcatttcctctgagagccaactccttcctttcaataaattcttattttctatcataatattgctttgtaccgcacaaaatacaattataatttttaatagtcaaagaaattttaagttatcaaacattagtttctttcgtaa

SEQ ID NO: 218969 - DNA, 564 bp, Homo sapiens
gtgcggtccaggctcaccctgtgcctttgctggctgttaactcagagggaagcccgttggctgcttttgctgttgggtttggatggtctgtatcactttaggcagtagcaagttcatcaccttccacctcattgtctgcagtgaggtttacacagtcatttaaatctgacaggaagggaattgctttgcctcagtttacctccctggacacagaggtttgactgaactttcccattcatgagctcgtgtcctcacctatttctgaggctgctctttcatggctggattactttttttttttggttaagacggagtttcactacattgcccaggctggactcgaactcctgtgctcaagggatcctcctgccttggcctcgcgaagtgctaggtttacaggtgacagtcactgctctggcttagtgggttcctttaggcctggagctctgagaatgcaaattggcctctgggaaaggctcagtctctggaggcttgaggatttttctaagctgctcagatactcagagcatctgctctttccaagatgtacttggcaagaagaga

SEQ ID NO: 218970 - DNA, 924 bp, Homo sapiens
taggattgatttattctaacctctcttactaaataaatgcttgtattcagagtctgtttggaatttaacccaatgcttagaactccttaaatatacagaaatatattttaggggtaattgattcatggaactctcctactttggagcacaattgtattataattgtccggaaactggccagataatgtagaacgcacaagttgttgagaagcccttttgtttcctgatagttacatgtaattccagcagtatttggaaataatttgctaagatgttagaatgtaacatttgaagactcgttagaaaaatcaataaaattatctttggctaatgggtagtacacatcttagtctgtttaatatgcctttccaaaaaaaactgtgtctgttgagaattggtgtatataactagatgactttaataattagtgcctgagtctagaattgagatgtttagtcgtaaaaaaaaatattgttcgataaacagcgttgacttgtcttgtaccacttaagagtttgtgagtgctttaaataaaattagttgattaagtatttttttcctatgattgacatgcttagttttgcctttttattgaaatgtgtaaaatttggttttctggcatcttaacaaattaggtggtaaatgaatgacaatggattttctattatttttcagtattgtgatcagtataagtatataagagaatttagtaaccttttagaagaataaagtgcccttcccaaatagtcctacagcttttggaaaagtgtaaattgtagtttgtagttctaaataaatagagaagagtcgcagccacgtgctagggccagctgacttcattgctgacaggtatgaagccaaatggcttatgtagttatggaatatgtacatgagctattaataaatattatccatgttgtttct

SEQ ID NO: 218971 - DNA, 505 bp, Homo sapiens
aggttccgcaggtccacaactgcatgtggcctgtagcccccattctccacatttggaggggtgtgggtggcagaccagggctttgaagcggacctgcagatttccctcaaatccagctaaggcctgcgctggaagcagaaactgagttctcttggcctgccgcgaggaaacccgcgtcctgcccccacccaaggaaatttgcagtgactttggagcccagactgaggaagcggaggtggcgaaaggagagacaatacgagcccgaagtacaattaaggggccagagccgctcgtctctcccccgccctccctgcccgactgcgagctgtctggcctcaaacctcagggcgacacgcgaacctggagccggaaactcagcccgtggcagagggagtcagaggactctgcatccagaaaacagaagcaaagcgcccttccaacttggggacgccttaaccagcccctctcagttgcagataacccaatgaatgaaagtgcaaattca

SEQ ID NO: 218972 - DNA, 1055 bp, Homo sapiens
aggttccgcaggtccacaactgcatgtggcctgtagcccccattctccacatttggaggggtgtgggtggcagaccagggctttgaagcggacctgcagatttccctcaaatccagctaaggcctgcgctggaagcagaaactgagttctcttggcctgccgcgaggaaacccgcgtcctgcccccacccaaggtgggtatctgggatccctacacaccaggagtcaggtcccgaggcccagcaggagtgaaatccccagggcctgtgaacgtggctctctcaaagccacggcctgccgggcctgcattcccgccggcgcccccgccctgacgctccgcagcaagcggggctatttccggctcccccaacgcggtctggttttccagcctgggagtggctggagggggagccgccccagagctagagccgctccctgccctgcccggagccccagtggccctgcatgctgcctctcgtccacctgcatctctcttgctgtcgcgtgtactcgtgtctgcaatcggcaccatctcgcccgctgcccctctcgcggacgccacacgcacctgcacgcgcccccgcgccgcgctggcctgcaacacggccgcaccaccacctccgccgtcccccccctccccccctcccgcgcccccccacccccccctcgctcctcctcgcccctccccacaccacttcgcccctacccccgcaccgtcgccccggcccctaccaccaccccccgcaccacacctcgcaccccaccccgacccccacgcccccagcccccctccacacccgccccaccccagccctacgaccacccaccacgcacacccacaccacccccacccgcaccactcacaacacacatccacacccccctaccaccacaccacccccactcaccaaacacaccacacacacaccagcacccacaccaccccactccccccaccccactcacaccccacatcctccaacacacacaccaccaacccctccgcccccctccccacaccacaccctccacccaccccaccaccacaccccaccg

SEQ ID NO: 218973 - DNA, 467 bp, Homo sapiens
aaaaaaaaaaaaaaaaagtctaaaaggctattctccagaatgttatagagtaattatacttgggtgctgaacttataggttatgttattttctttgtgccctagtccttctaattctgaaacagcaacatgatacttttgtaactagaaaacatcttatttcttgaaaaggaaatttaaaaattgtgatgcctggtttgtccttaccttttgaaaccacctccttctgtttctttgacttagagagctcagagtcctgctatgctagtagcatctctttgtcatgggcagcagtgcactgaacccccctgcagagtcaggctcatttgcaagtgacaggagattcttgactgcccacatcattaagaactagtataatcagaatgctctaatgattagcctaactgtcttgtcagtctttgtatgattcactccactagtcctctattgtaaaacttcttttcattt

SEQ ID NO: 218974 - DNA, 618 bp, Homo sapiens
tgtttggtgcgtggcttcaggcatagcaggcccttgaggccttcagtcagctgccagccgagccagctccctgggatgcgctgccggggctctccgtgaggagcgttcaccctgcttggagccagagccacagcggcgtgtgctccacagcgtcagggtcacgctgggccagccgcgtgcccagggcccggaaacctctgcgctcacccaagggtctgggtaccgccacttggtgggggctggcgtggcaccacctgtcgggccatagagaggtcaaaagttctgcttctgcaggtctaagcaaatactaatgacagtaataacagcaacaacatccaaaacactaaacacttttaaatatcaaaatacattcatcataacttctttttttttttaatttatttatttatttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttca

SEQ ID NO: 218975 - DNA, 331 bp, Homo sapiens
gaatttccttttaaattttatcattaagtatcgtttctttctggtcagaactgccagcctcacctttaacgggatcagattggttccatcagtgggtcttgatgttaggaaaaaagtagagcatgtacaagttcaaaagtacagaaaccttacaggggcttttcttgtttttcctgttatgtgaggtctgtgaattgcaccctcaagcagctcctttattgaaaatgcagtttcagccgggtgggtgtcgagcatccgtagccccagcttcctgggaggctgaggcgggtcgttcgagtccaactgggcagcaaagcaagaccccgtctca

SEQ ID NO: 218976 - DNA, 1136 bp, Homo sapiens
  misc_feature (716)..(716): n is a, c, g, or t
gaggatttggaagacccagagcgggatgaaacgggacagagccctgaaggggcagggatgggggaaggcggaggagtttctactgaggccagggctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatcccttgtgaaccgtggggatcccaagcaagcccaaccaagtctgaacgagggctccgagagccccaggaactccagaccagnctgacatcgggaacacccttcggagatgtactcccgcaggatccggtccgagacgcactcgctcccaatccggaggggggggggcgcgggagccatgtgagatggtcctctcagacaggaaggctcctgggccagagagggaacggggcaggagggcaaacaatgggaggggcaggggccaggagcggagagagcaccacgagacaggtctgggcgacatccatgggcggacacaaaccatcggggggagcacattgagcccatgataaggccgcagtgcacacaggaggcgggccaccacaatgcaggcgggcagcatctggccgtggtgacacacatcatcgcactagcagacagaagagtatcaccgaagaacgaacgcaaaagaagggagcagaaaagaaggggccacaacaaccg

SEQ ID NO: 218977 - DNA, 1059 bp, Homo sapiens
ggcggtgaggccggctcagcgcggagcagctcagtgccccccgcgccccgctccggcagctccacgctcgcgcccgccatgccggagcagttcagcgtcgccgagttcctggccgtcaccgcggaggacctcagctccccggctggggccgccgccttcgccgccaagatgccccggtaccgaggggcggcgctggcgcgggaggagatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatccctggggaggtggcccaggacatgcagagagagcggcgcatcttccagctgcacatgtgtgagtatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggaacacctgagccggaagaactcaggatgtggctatagcatccaccagcaccaaggcaacaagcagtttgggacggagaaagtgggctttctatacaagaaaagtgacggaattcgaagagtctggcagaaaaggaagtgtggaatc

SEQ ID NO: 218978 - DNA, 918 bp, Homo sapiens
ggcggtgaggccggctcagcgcggagcagctcagtgccccccgcgccccgctccggcagctccacgctcgcgcccgccatgccggagcagttcagcgtcgccgagttcctggccgtcaccgcggaggacctcagctccccggctggggccgccgccttcgccgccaagatgccccgatcttggaaggagaccaagccatcctgcagagaataaagaaggctgtgcgggcaatccatagctccggccttggccatgtggagaatgaagagcagtaccgagaggccgtggaatccttaggcaacagccacctgtcccagaacagccatgagctgtccacaggcttcctaaacttggccgtgttcacccgcgaggttgctgcgctcttcaagaacctgattcagaacttgaacaacattgtctctttccccctggacagtctgatgaaggggcagctgagggacggtcgacaggattccaaaaaacagctggagaaggcatggaaggactatgaagccaaaatggccaagctggagaaggagcgcgatcgggccagggtgacaggagggatccctggggaggtggcccaggacatgcagagagagcggcgcatcttccagctgcacatgtgtgagtatctgctcaaagccggggagagccagatgaagcaaggtcctgacttccttcagagcctcatcaagttcttccacgcccagcacaactttttccaagatggctggaaggctgcccagagcctgttccccttcatcgagaagctggcggcctcagtacatgcactccatcaggcccaggaggacgagctacagaagctgacccagctccgggactccctccgagggacactgcagcttgagagcagagaggtcagcccctgaactatcccaaaaggaatgccctccc

SEQ ID NO: 218979 - DNA, 628 bp, Homo sapiens
tgatacatcccagagatttggtatgttgtatctggttttcatttatttcaaataatattttgatttctgccttaatttcattcttttcccaaaaatcattcaggagcaaattgtttaatttccaggtaattttgtcattttgggagatcttcttggtactgatttctatttgtattccactacggtctgagagtatgttcatatgatttcagcttttttgaatttattaagacttttttgtggtctgtctttgagcatgttcggggtgtagatgaggagaatgtgtaggctgcgattgatgggttgagcgctctgtagatgtttgttaggtccaattggtcaagtatccaacttaagtttaaagtttcttggttagttttctaacctaacctcaatgatctgtctaatactgtcaatgggatgttaaagtctcccactattactgagtagctatctaagtattttcctaagtctagaagtagttgttttatgaatctgggtgctccaatgttgggtgcttatatatttaggatagtgaagtcttcttgctgaattgaacccttcatcattatgtaatgcccttctttttcctttttcctgtgttcatttaaagtctgttttatctgat

SEQ ID NO: 218980 - DNA, 565 bp, Homo sapiens
tgatacatcccagagatttggtatgttgtatctggttttcatttatttcaaataatattttgatttctgccttaatttcattcttttcccaaaaatcattcaggagcaaattgtttaatttccaggtaattttgtcattttgggagatcttcttggtactgatttctatttgtattccactacggtctgagagtatgttcatatgatttcagcttttttgaatttattaagacttttttgtggtctgtctttgagcatgttcggggtgtagatgaggagaatgtgtaggctgcgattgatgggttgagcgctctgtagatgtttgttaggtccaattggtcaagtatccaacttaagtttaaagtttcttggttagttttcttttattgtgatgtcctttttgggttttggtatcagagtaggcctggcctcacagaatgagttggggagtgctccatcttcttttattttttggaagagcttgtgaaggattggcattaaattcttcattaaccctttggtagcgttcaccagtgaagtcatctggtcctcaacttttctctgt

SEQ ID NO: 218981 - DNA, 847 bp, Homo sapiens
tggaatttggacgatgtcgcgtgccatgtcaagcattccaatgttgagactaatacagaatcttgttcatgtggggagacctctgagaccctgagttgcattagcatggcactactgtcatctccaagcccgtcagagaacagcgcccgtccagtgcagacatttgaagctaggcgaggcgggttacacagcctggggagtctttgtacttttcaatattctccaagggaagtctagacaggcttcacattttgttaagtacagctaggttctgtccacaataaaacagaactaggacaactgttttggaaacatagttagcacataattgtagctaatttagtttttttctctgaagcagcatgaaaagaaatttgtttttgtacaaaagatgtttttatcttctatagcccacaattcccaacaacagagtgtcctctctccttccctctgctgcaaatatatgcacctacataacacccacatggcacgtttttttctagcctaagccactatctacccctgctgttctctttttggggatttcttcaagcatatttacaaaacacttgctgagcccaactgccgcctcactgctgtatcctagttacatgagccatcagttccccaaacgcttgctttcacctgtctgttgggaaaccacctaagcctatacgaggaagaaaaatcattcagaacaaatgttggcttgaatactcatgtcgttttcttaactgcttgatacaggctttcaccgagatttggtgggaatcaaaagtacatctttaaaagaatcctggcctttaccttacactatatataaataaactcaaatagatcaaagacc

SEQ ID NO: 218982 - DNA, 1127 bp, Homo sapiens
caaatattaatgtcttttggcaacaccctcacacacacacccaagaccagtactttgcatctttcaatccaatcaagttgacactcagtattaagcatcataatggtttttattttgattatacttaagatgccgtaaacttcgatatggtcaacagcagtatcttccaaaccagtatccttatttccattccaatctgagcaagacttgaaagccagaaaaatctgaagtgcatctccaatctgttatttagcagataattttaaacatctgctgtgtgccagacacctctttaagtacaggggatttagttgtgaacaagacagaagacagagtccttgctctttagagggagttcacagtctagatgagaagtcaaactttgaacaataaatttcagcttcagagtcttaatgacattaagttcagatgctttgcagcccttgaataataagtttcatctaaaggactcatctcctggcctgcatacccatttcagatgttgttagggagaggcttcagaagaggctttctagagcaggtgacatttaagcccaaggcttgaaagaataagagtcagaatagggtacagtatgtacaaggaaactctgaatagggtacagtatgtacaaggaaactctcagttggaaaactgacataaatcccattaagggggagagtggaaaaagatgactggagagagaagttgaggtcagatcaggcagactttctaggccttcttaaggatgttatagcaagacagtgggaatccattgaaaggtggtcttacaggatcactataaggggatagaggggatgcacatactaccctaggatctgatattcatattataaccaatctgggacagtgcccctggagttgtgcagtgccagaataatctggagtacagccatctgtactcccactggaacatggaggagtagactaaacaggactttgcatgtatatggtgaagatcagtggaataaaaaatggtacctggctgggcactgtggcttacacttgtaatcctagcactttggaaggctgaggcgggaggatcacttgaggccaggagcacaagaccagcctgggcaatatagcaagaccccatctctaaaaacga

SEQ ID NO: 218983 - DNA, 440 bp, Homo sapiens
agaacagggccctgctctcagcaccaggggcatctttgtcctggggccatcctgtgtggttagggtattgagccgcaccccggcctccaccctccaggtgcccgtggcacctctgccccaagtcatgacaaccaaacatgtctccagacactgccagtgtcccctgaggggtaaaattgcccctggttgaaaacgaccactttagaattgacatttactaacccatcaccgtcaaatctaaggttgaaaggtgtgtgcataaacacagggaccgaaattctcaacaaatgccgtaagttggcaaaatcacaggtagttgaaattcctaattatatctttattaccagtggagagaagctcccctaggaagtgtcagatcccacggggacgcctcacagtttctcattattgatcacgatctacgtaaccagagctctgtt

SEQ ID NO: 218984 - DNA, 150 bp, Homo sapiens
tgggaaatactgcaatatactgcaagtgtcctttctctttacgtgaattgaatttgtattttattgtttctttttccaggtctagccttagaaattttataatatggccaggcgcagtgtctcacgcctgtaatcccagcactttggcag

SEQ ID NO: 218985 - DNA, 514 bp, Homo sapiens
agtaccaagacgctgatgtagatcctcttcttggtgctcgactgtcccaacttgaagctgaagaagctgctttggatgcataggtcattggccataacagtgtttgccccagtgttgtcttatttcatcattaccagcatcgccaaaaccttaagtgttgactctttgatcacaggcccaagaggcctttacctttcttggcctgtggagtaaatagacaatatattatgaaaggacttgtatgtaccctttctgtttacaatgagatgtttaggtttcttaattttgaacaaattcaatttaccaaatattccagaacacttgatttcttctttttctttgatttgtttcttatctattcattgtctgtgtcttacttttttcatagtaagattgttcttgaaaaatgaaacttctaggctttctaaaaggctggagtgcctttttagaagaagtcaacagctaatagatttgttcttatcattgaaatttcaaaagttataccaaccctcca

SEQ ID NO: 218986 - DNA, 208 bp, Homo sapiens
tttgtataatcagcatgaattagctttcttagcatttcattatgcccggttaaactgaccactgagtccatcagagccaaatgcatgtctaagatgatactgtctctaccacatacagaatccccataaaatgtttagggtgcagacgaccatggcacccaagcaattccaggacaagcatgtatatgcagaacagaatgtgacattc

SEQ ID NO: 218987 - DNA, 344 bp, Homo sapiens
aacaatcaaaaaggcaaagaaactcttgggtactttatgcttctcactacttactcttgaggaagaaaaaaaggtcaaaagcagcttttctttaccaatgaagaagttgttgtcaatattttgtaagcaattcagatcattgcaatatttcttgtattcctattcggtgcttagcactatgctaagtattagggattatataagatttttatagtatttaggaagacaagattagttatttcataaaacttggtcttgggttcccaaatcctttcgagttctgtttattcctcagcaagtaaataaaaatgtcaatttctttggcactgaatctaaatagcaga

SEQ ID NO: 218988 - DNA, 534 bp, Homo sapiens
cagtggctcacacctgtaatcccagcactttgggaggctgaggcgggtggatggatcacgaggtcaggagatcgagaccatcctggctaacacggtaaaaccccatctctactaaaaaatataaaaacattagtcgggcgtggtggccggtgcctgtagtcccaactactcgggaggctgaggcaggagaatggcatgaacccgggaggtggagcttgcagtgagctgagatcgtgccactgcagtccagcctgggcaacagagcaagactctgtctcaaaaaaaaaaaaaaaaattaggatgacatcttagaaacaacataattgagaagagcatgaaacaatgcttttgaggtactgaaagacaaaacctatcaacttaaattctatatgtagcaaaaatacctttcaaagatgacggcaaaaaaaatacattcagacatacaaaagctgaattaattcattgcccaatagactcacaatgcaaaaaatgttaaagaaagttcttcaggcagaaagaaaatgctaccttata

SEQ ID NO: 218989 - DNA, 625 bp, Homo sapiens
gaacaggttgggagttggatgatccacattctgttaagtttgacgtgcttgggagagatgttatctagagttttacatttcaaagtcttcagtctctggatggcatttaaatctttgggactgggtgaggtcagctaattattgaatttagatagaaaagataggagtgctagagaccaggcctacctgactccaagccctggggcccaacatttggaggttgggtagaggaggaaggtagaagcagttcagggcctcttgtgtttgtatcgtaccttcatacacgtaagggttaataaatatcttttaaaataatgctaagtgccaggtgctgagagatgagagcactcttcagggaccacctcctcctgcgaagtgcatggatgcccaccaccctcactgctttgggtcaggcagcctccgtctagactctcatgtccttctgtgtcagctggttgacttgaatattgatcaagagtcagttttgtttgtagcaaaccctgttttggtcagtaggacttgttgtaattgcgtaattaaaatgttatgttatctgattaaatcagtattatttttctacaaaaatatgttaaatactttggaaagcttccaaaggcaagcctca

SEQ ID NO: 218990 - DNA, 800 bp, Homo sapiens
tcaaggtcctgaaagccaaataaatagtatttcaagaattaaactctgaatcatcaatttaatgattagaagaaaatgagtatggtttgttagacctaagattacatgaaagaagaaataagagcactgcatttatctgattgtggtaggcagaaaaatggtcctgcaaagatgtccatgtccttccccgaacctgttcttccctgaataaaagggactgtgtagatatgattacgctacaaatcttgaaatggggagattatcctggattatctgctgggctcaatgtaattacaaggatgcttgtaagtgaaagaggtaggcaggagatttgaaggagatgtgatggaagaagaagagtcagagtgatcgttatgcagaatactcagctggtcaccactggatttgtgggcagcttctagcagctgctgaaggcaaggtaacagattctttcctagagcatccagaaaggagtgcagttctggaataggacactgatggaaaagcatgttccccacttagataatcctggccgttcttttaatgtggttggttaagatttttaaaacattcgtggagtttgtctgaaagaacaactaaattagacagcaatgtgtttaagcatatgtttatcagttcatttaaaagacataatagtggtggtgaactgaatcacaatttcctcccaaaggtttgtttcttttgctgttttttaatgtgaagctacacttcccaacactcttgcaactttgttaaaaatgaaccttgaaaggtgcctatataatttcatagtagtaaaa

SEQ ID NO: 218991 - DNA, 354 bp, Homo sapiens
tagtctcgaactcccgacgttgggtgatccacccaccttggcctcccaaagtgctgggattacaagcgtgggctaccgcatctggctgagtactataattattaatgatgatagagaaagcgttgtaaaagtacaagtgagggccacagctttgtctatttctgcaaatccgcagaaaatatcttctacagttagcctaccttgtgtttggaggatagtttctgcggtctctgtctacattttcaagtttaaatgtatcctcaccttagttaccttcagagagtgggggtatgcttaattacccctggagttggggtttgggggaaccacagcaacagggctctttaccagcag

SEQ ID NO: 218992 - DNA, 484 bp, Homo sapiens
cgtgcgccctgttgtaggtcagtgaaaggactttaggttttactctagggttaaaagtccctaaagggttttgagtagaagcttgacatagtttgattaaaaaaatttgttttttctagttgtttggttgagaatagactgaagtggggcaaaggcagaagcagagagaccagataggaagctgctcccaataaggctggtgagagggtggcttggatctggtgtaggtgtggtgctcgggcccgagagatgcagtgagtcagtgccgaggccatgtcgggggacagactgccttgctttcagtggagcttggttctggatctgggacaaaagtggtgggaagatcccagctcaattttgaaggtagaacagattggacgtgacgtggtgcacgagagaaagaaaggcaaaagagatgaacctaaggtttctgattaaatgttagacattgtgtaggaaaaaaatcacatagaggctctggcaa

SEQ ID NO: 218993 - DNA, 601 bp, Homo sapiens
atatgtgaatatcctcaaaggaagaataaataacatagcaaggggaaagccagtgattccttgaactttccgttctaatgttcactcactcaaaaaggtatctattgagcaccctattgtgttacagaaactttgccaggataaattgccaaaataaagtaaagctaaaatgaagagtgtctaaaagatacttccaaatcctttgcacatccccaagtatcatttttgagcattttccatctgtcattttgttcatcttattctgtctttcttgatcttctactgtgaaagcagacacaggaacgtgctctgttagtacaggatgaagagaaaattaaaaggcaagaaagatctactgaaagagccttgccccagcaagaaaatgaagaaattcttcccaaggtttctattccaatccctgaggatcacaagtctctcaaaaagtgccacctctactttagtacttttccatctcctcgtattcctttcatgatgtcttttctcgtgatccttgtgttggctgtttggtggttggtctttctgtgatcagaaaacagggtgctcatctgaaatgtcaagaccattgaacttctgtccttgg

SEQ ID NO: 218994 - DNA, 449 bp, Homo sapiens
aaaatgtgtggataggcaccgtgtctggccaagagtcaatatgttaagatgagaagttagtaatagataaaaattgaacttcccagaaaatataaagtaacagatcaatagcagggccaagttagaatcacttgaacccgggaggcggaggttgcagtgagctgaggtcgtgccactgcactccagcctgggcaacaagagtgaaactccatctcaaaaaaaaaaaaaaaaaaaaagagtaaaataagggcaatgggatagtgggtggctgggttgccatggaacttaaaattgggtggtctgaggctgagtgcagtgtctcacacctgtaatctcagcactttgggatgctgaagcaggaggagcgcttcaagccaagagtttcagaccaaccagggcaacaaagcgagtccctgtctctatttaaaaataattttttttgaaaaatt

SEQ ID NO: 218995 - DNA, 968 bp, Homo sapiens
aagtagctgggctggatcagaggcggtcattttgtcctccagctctccctgcagtcccattttacaaagggggaaactgaggccttgaatggggaatatgaacctccctattccaggcccagtcagaattcactttctccttgcggggtcctctttacgcagggatcctgtgggcctttgctttccactagatcaccaaggcctagtgccaggtacacaatttggtgctctgcaaatatctgttgaaagaatatcatcagacacatagtaggtgcgcaataaatatttgttgacttaactatgaacgagtaggggttgtatttatgaacaagacagactcccatcctgcctcctagaacctacgttctagtgggggtagaagggacagaatagggtaaaatgagcaaatatgtaaacaagatccttcagggtttgatcaaagtgatgtataaagaataaaataggccgggcacggtggctcacgcctgtaattccagcactttgggaggctgaggcgggtggatcacctgaggtcaggagttcgagaccagcctggccaacatggtgaaaccctgtctctactaaaaatagaaaaattagccgggcatctgtaatcccagctactccggaggctcaggcaggagaatcacttgaacccgggaggcggaggttgcagtgagctgaggtcgtgccactgcactccagcctgggcaacaagagtgaaactccatctcaaaaaaaaaaaaaaaaaaaaagagtaaaataagggcaatgggatagtgggtggctgggttgccatggaacttaaaattgggtggtctgaggctgagtgcagtgtctcacacctgtaatctcagcactttgggatgctgaagcaggaggagcgcttcaagccaagagtttcagaccaaccagggcaacaaagcgagtccctgtctctatttaaaaataattttttttgaaaaatt

SEQ ID NO: 218996 - DNA, 531 bp, Homo sapiens
ctgtgtaagagttcaataacttttataggaggaatttataaatgggggagagtaggtaaatccttggatatattgtgattaaattggaaatgttcatgttttattatgataaatgtgtttttgatattttagctataagtgaaaagtactattatactattaaaatgtttcaatgtatgagtcataaatgtgggattaattagatgtttttgttagtgatatttgattctactagttaagaggcaaatgtggtttgatttttaacaaatttatgctcagattttactgttgttacttggtaaaaaatatattggaaaactaaaaatggttatgaattgtagaaaatgtttatcataatttatctttctgattaaaatcagtttattttgtatatttcctgtagatttaaattaaacatcttagtactactttacaggaaagtgtttcaactaagaacaacaatattttctctatacaatttgttgttctatagatttaatttctttaaaagatgtaattcttaactttctg

SEQ ID NO: 218997 - DNA, 450 bp, Homo sapiens
tacataaacttacagaatagtggtgaaaatatttctattagagaggcagaatggcttgcttttgtggtttgtagctctgctccctgaagccctaggagttttcacagggctcactctgaggcaactatagagttgaaagacaaaaggatataggaaaaaatggcacagaacttgacaccttgtataagcaataaatgcaaacaacagccataaacaaacagaagcctccccattgacataaagtctaagaaattgtagaaatatgttaattgtccttttgaagatcaattttctcatctacaaaacagggttaatattacctagggtgattttgtggatttttctatatgttcaatgtaaaatacacagttcaatacaggtatctaatagctactgatttcctgtctaggtccccttcatccaagatttaatggctgacttttgatagtg

SEQ ID NO: 218998 - DNA, 347 bp, Homo sapiens
aactttatagcattaagtgcataaattgagaataacgaattagtgaaggaagaattttccaaaacaagttaatgacatagaaaacaggactgacaaagggtgtttcactacagatactacagacattaaaataacaataaaggactgggttccagttccacatgtaaggagtttggaaatcaccattacttcctaacaacaaataacaagctgaacagattgaaaaatcaacactctggatctagatgacacagggcaaactgttgcctccaacactggagagacagacaggtgaaagcagggagttagtcttgccagatcaaagactcatgaggataagaaaacct

SEQ ID NO: 218999 - DNA, 275 bp, Homo sapiens
caccagcctgggcaacatagtgaaaccctatctctacaaaaaatacaaaaattagccaggcatggtggtgcatgcctgaagtcctagctactctggaggcggatgtgggaggattgcttgagccctggaggttgaggctgcagtgagctgtgattgtaccactgcagtccagcctggtgaagagtgcagagaccttatctcatgaaacgaacaaaaaagataacgagcacggtcttctgcagaaatacccaacataagttacatgcattacttaa

SEQ ID NO: 219000 - DNA, 695 bp, Homo sapiens
tcttctatgagtactgcaatggtcattttcaaatctggagttgtaaacagaaactctagaatgagtttcacctatcagattgcaggtgaggccaggaacttcatcttttattcagaaaagctgccatcattaccattattcgtagaataattacaattatttctagaattgactcctgtgagtaaattaggatttgttaacaaaaaccacatccctctcttaactagaacccagcccaatttagcaaattactacagttggtttctaaagagataaagagaatataatactatccaggatggttagaatgctagcattttcttcaaagtatatgtagttgattttaaaaatatgccaattatcttattaattatacacttaaccacattgaatatacatttttatttacaagaaatatatatgtttatttacaaaagctttatcaaaatataattctcatatcatacaatttacccatttaaagtttatatttcagaggtttttagtattttcacaaaattgaaaatcttagaaaattattttgtaaaaatcaaaaagccttgaaagagttacctgattattataagaagtttattttcacagaacactttatttagtacttattttgaattgactcaaatgaaagcttcctttggttaaaacaaacgaaagtacttttggtatttttttaccaa

SEQ ID NO: 219001 - DNA, 570 bp, Homo sapiens
acttgtgatatggtttggctgtgtccccacccaaatctcatcttgaattgtagctcccacaattcccatgtgtggtgggagggaccctgtgggaggtaactgaatcatggaggaggtctttccatcctgttctcgtgagagtgaatcagtctttattagcagcatgagaacagactaatacatcttgtttagtatctgtctttccagagattacatactagaatgtcatctcatgaaggcagcaactttatctaaatcactgcatctccagcacaagaacagcatctgacatgtaaaagacactcaataaatatttgttcaatgaatacatttatgtcacacaatcacacgattaacttccataactgagtaccaataaccaaacagaaaaggcattttgcaatgaaaccctagcagagaaccatgatacactattacttggcaatgacttctaattggattccctaactactagaaacttctaggcacctgctgtccacagactcagaagttgtagctcagattatgtacctagaggaaaataacagagcatgcttctttgggccagtc

SEQ ID NO: 219002 - DNA, 246 bp, Homo sapiens
tccggatccaggaaagattaactcacagaaaaagagactaaaatcttataccttcaaagaagttttgacagaaaaatgttactgcaggccaccatgtattctttctgagagttgctatctgtgagatttctgcaataacaagtctgcttttgctcaccatgcctttcctcctctctccctcccatatcctatctttcccctattccttctgtaacctcaagatggtacaaaaacttcagctatctg

SEQ ID NO: 219003 - DNA, 443 bp, Homo sapiens
ttactggtgagaatgtaaaatggtgtagccactttggaaatgttaactagagttgccatatgacccaactattccaccttaggtacacacccaagataactgaaaatatatattatacaaaaatttgtacacaaatgttcatagcaacattatttataatagcccaaagtggaaacaattcaaatgtccctcagctaatacatggacaagcaaatatttatcctgataatgaaatattactcagccatgaaaaggaatgaagttctgatacatgctgcaacatggatgaaacctgaaagtattatactaagagaaagaagccagatgcaaaaggccacatactgtatggtttcatttatgtgaaattatttatcagaatagtcaaatctataggaagaagacaagtggttttcagggaccaggatgaagagcacatgggcagt

SEQ ID NO: 219004 - DNA, 498 bp, Homo sapiens
tgagatgtgggtagggacacacagccaaaccatattagtcatttacatacttctgaccaaaaaccaaatctctggcctttgacctaaaacatgcgtctcagagaaagcagcctgagcctaaatcctcatgtttctctcactgttgcagctagtgtcattaaggcaggttagaccaccctgctgtagggagggtcacaacagaaaaagagtgaatcaaacgggcagagcataccatttgaaacatggtttgctcctgagaaagaagaggggacagtaagtaatggaaagagacactaatgaaaatatttttgtatctaatatctaatcaaagtattgccaagtcagcctataagggcaacggcaggagaaattcagaacataggtatataccacacacagaccagcaatataggaatgcttggtataggtgctacttcacaagctaggaatgtaaggcccatccccacaaaatttgtctccaaattctggtttactcca

SEQ ID NO: 219005 - DNA, 437 bp, Homo sapiens
tcagtttactgaagaattcaaaaggactgaaaggaaaagaaactataggtctgatatggtttggctgtgtccctacccaaatctcatcttgaattgtagctcccataatccccatgtgttgtggcggggagataactgaatcatggagatggtttccacatactgttctgtgatagtgaataagtctcacaagatctgatggtttaataaggggtttccccttttgcttggccctcgttctcttgtctgccaccatccatggaagacatacttacctggcaggggagatgccatgatcacgaaggtggttttcccagggcgaggcttatccattgcactccggatgtgctgacccctgcgatttccccaaatgtgggaaactcgactgcataatttgtggtagcgtcgacgcggccgcgaatttagtagtagtaggc

SEQ ID NO: 219006 - DNA, 325 bp, Homo sapiens
gatgttgtgaggagcaggtctggagttctggagcctctgctggggcaggctatggctcactgcccgtaaaggctgcagagagggtgcacagatgcagtttcatcggtgaaactccagaaactcgccttgagttgagtgcttgttgaaaagatgggttaaacctttatcttttgtaattcacagactcaagccatctttagaccctttaagagcattcagtgaaaagatgataacagaaagaacagctgatccctcttctgaggcctttagaaaagacttagaactggagactgttctgaagctgtggggattgtggataggaaat

SEQ ID NO: 219007 - DNA, 178 bp, Homo sapiens
gtgtacataggggactttgagaagttccaatatatttctagggatttatgcagttatgtgcaggaatgtgtgtatgttcagagaagacctgaaaagacccaatctctcccttatgactgaccttgaagctctgtgcaatagacagtaaaggtcatttcaaagtgctaagtgactggaa

SEQ ID NO: 219008 - DNA, 435 bp, Homo sapiens
gtttcatcccaaaaccagctcccaccacccctcacctccagtccttggaaaaattatcttccaggaaaccggtttctcatgccaaaaaggttggggactgcagttgtagatgaattctccctgtgtcttcacatcatcttctctctgtacgcgtctgtctctgtgtcaaaatgtcccctttttataaagactcctgttgtatggcattagggcccatcctagtgacctcgttttaatttgattccctctataaataccttgtctcctaataaagtcatgttctcaggttctgattacaaggtgtctttttttgcttgtcacaattctacctataacaaacacctactagtagccaggcactatatgagccactcacaaatggcacagtttctgccctcatggtgcttagtaatctagcaaatataataatcatta

SEQ ID NO: 219009 - DNA, 469 bp, Homo sapiens
ttccgtatctgtaaaatacaaataatatgtacctcatagaagcattatacagataaaagaaaaatgcatagaaaagctgtaaagatcctgagctttaaagtacatccatactcagcaaaaaagaaaacaggaaagaaaaggaacaaatcactaatacctgcatgaaactcaaaagcattatgttaagtgccaggagccaaaaatctgtacatatttcatgatttcatttctgtgacattccagagaaggcaaaactgtggagacagaaatcagatcagtggctgccaggggctgggtgtgaggtgagagactttagacaagggaaatttctcgcagtgatagaaatgttctatattttgatcgtttggtggttacacaactatacatgtttgtcaaaactcagaattgtacacctcacagggtgaatattactgtatgttaattatacatcaataaatcttacttttca

SEQ ID NO: 219010 - DNA, 691 bp, Homo sapiens
cctgtgtttgcctcctgactctttgtatgatcatgaacaacacatttaaattccttaagcctcagtttccctatctgtaaaatagagatgataatagcactgccctgacaggtgtttttaagaaaaattaagataatcatatgataaatttggtgtataccagaactcaatgcatgtttttaatatataatattcacttacttagactaactaaagttttgctttgtaaggttcttttcacaccaaacggaatttgttaatctgtcatgacaatgataactcttggaaattttttgttcttccttctcatggtggttaaattatttcacagtatatcagctatgatccaattccacagttcatactcaggcaaaactgccttctcaaataacaggagtttggtacagaagctacaaaaccagggcaaaggatgttaaattgatacttccaatgtgccttattttgagcctgatactatggaattttgcctgctattacagtacccaattattgcttggaataattttgcatttcctcgcattttacagagcatggcttgactgacaatttgacaatcagatagcctaggctgatgccattgtatctatttaataactttgttaaccaattaacacaagcagacaattcccataataattgagtattaaaaagcacaacaacaaataaacag

SEQ ID NO: 219011 - DNA, 228 bp, Homo sapiens
caatagtttcacttttaaaattggtgtattttccccttccgcatatgtgtatgtacacaaaggaatacaaacaaggacagacctgattgttcctttgttataagtaaagaccatctaattataataaagcacaattaataattgtgtgtaatgagcaaattagagcaataatacaagaaaatgagaggcaattccttgaaatgtttctgtcttatcttttaattgaaa

SEQ ID NO: 219012 - DNA, 473 bp, Homo sapiens
ggtttcattttccatttaccaacttgcaaaattagtaaacttggaaaacatccccatggttaattgagaaacaagaactccaaactacccagagataacaacactcggttagggcagtatttgctcagattggtgtttttttgttgttgttgtttttgtgtttttgagacagggtctctcactctgtcgcccaggctggagtgcagaggcacgatctcatctcactgcaacctccgcctgccaggctaaagcgatcctctcacctcagcctcccacgtagctgaggcgggagaatcccttgaacccaggagacagagattgtggtgagccaagattgcaccaatgcactccagcctgggcagcagagcaagacagtctcaaaaaataatataaaataaacataaaggcagtaacaagcactggggaatacatagaggaactggaatcctggtacatgcattgctgttgagaat

SEQ ID NO: 219013 - DNA, 781 bp, Homo sapiens
tacgtctctgaccagcaggacacattctcgacagagtttctgttttgttgtccagatatttgccttttatcattctttcactcagtatctcatcagggatgaaccatgggaaactatgatctggggcactgattggagtccagctcctggctatgctcttctcccttagattatcagtggaggaagcagccctggctcaaggcgggtacctgaaggtttggtgtccagccagaacccacagggcctggtcaaccttgtcagtcttgtcaaacattttaggctttgtttaaagagcagttgggaagccatggaagtgttttttgaagagggagctgcgatcacattttgcacattgactggttagggcaagacccagagggcatatacgggtataatattcactttgctggtgacattcagagctaagtgaccagaatatcgggagccatttctcccctctcctccatcctcagcctggagaggggccatgtggtgggcatgctctgtggatctacacagaattaaaaataaagttaaaaggtcttgttgattacaggaaacgagtttcttttcttttcttctcttttcttttctttttttgagatggagtttcgctcttgttgtcagggctggagtgcaatgacgtggtatcagctcattgcaacctctgcctcccaggttcaaacgattctcctgcctcagcctcctgagtagctgggattacaggcatgcaccaccatgcccagctaattttgtatttttagtagggatggggcttctc

SEQ ID NO: 219014 - DNA, 403 bp, Homo sapiens
gggtagggatttaggtggaggttagaaaattctctgctattatctcttcaaatatttcctctgtctcatgttctttctcttctctttctgggactctgattagacgtatgttatatgttttcactttgccccactgtcttatcctcttttctctatttcccactcttttttctgtctgggcttcagttcatatatttgctattgacttgttttccagttcacatagcctttctttggctatgtctaattctgcttttaaatacattcctgcattttttattcagctatatttttgagttaaaatttttatttagttattttttatagttcccaattttctgggaacatcttcatttttcatccatttcccccctttcctctatttttcttggaaatggtaatg

SEQ ID NO: 219015 - DNA, 166 bp, Homo sapiens
ctagctttgactcctctgtcacttgtccgctttggcatcacctcctcatagaagacttctatgactcccgagattctcaggagcatggcaggtgaagtgctcctcccatgaatggatggagattagggagtgtgtgttattcatgcttaattcaccagtgcttagc

SEQ ID NO: 219016 - DNA, 213 bp, Homo sapiens
gggtcatgttagtgcaaaatgtagaaaactacagttaatcatctgttgccttctgtcttgcataatgtagaagaacaagcacaagctttggcatcacacagacttggtctagcaagttaattttagtcccagttcctcatctgtaaaataagaatgtgtaccttgtaccttgtatgggcattggattaaaagtaacataaatcccctactaca

SEQ ID NO: 219017 - DNA, 559 bp, Homo sapiens
cgggtcaggcagtgtcaaggtagagtcagggaaaacagttagaaagttattgcagtaatctaggcaggaaatattagcatgctggattagggtagtagcaatggaggtggtaagaaaccaatttctgggtaaatctttaaactatagctagaagaagatatggtaggatctgaattttgtaaattgaggacacctatcaaaaactaatacaaaattagaaatacataattagatacaaaaaagaatgttattcagaataaaaaaaagaaactacaaattttaaattacaaataaaaatcataaaatataattttgaaagctgacaaaatgccacaaacatcataaaatcgtggaaaataacataatagcacacatctataatgcttccttcccccttacattttggtttcatgctctttgacagcctttccatgtgacaaacatcgtgtagtattttctttggagattatagaaaaacaatccagtctttcctctaacatgatttttaatattgatagtttggaaatgcttacaattttcattgatatgccttgcagaa

SEQ ID NO: 219018 - DNA, 464 bp, Homo sapiens
catttaaaagttaagtctttatgctgggtgcagtagctcatgcctgcaatctcagcactttgggaggccaaggcgggcagatcacgaagttaggagcttgagactagcccggccaacatggtgaaaccccatctctactaaaaatacaaaaaattagctgggcgtggtggcacatgcctgtaatctcagctactcaggaggctgaggcaggagaattgcttgaacccaggaggcagaggttgcagtgagcagagatcacaccattgcactccagcctgggcaacagagcaagactccgtctcaaaataaataaataaataaaagttctgtctttacaaaccaaaatgctaaacaaatagcatttttttccaaatgttgaaagtatgtgttgtttgtaaccaataaagccaatttccacaactttatatgttaataaacaagccttaaggtaaggcttttattga

SEQ ID NO: 219019 - DNA, 464 bp, Homo sapiens
cgtttcgagttaatttttgtagtatatggtataaggtaagggtccagcttcattcttttgcctatggatatccagttttcccagcatcgttggttgagaagactgtttccccattgagtggttttgtcagtttggttgaaaatcatttgattttgtatacgagggtttttgtgtgtttcttaaaaaacaaagcaattaaattgattcattttttaactgtagtaaatgtatttttaaaataaacttataatggaaaacctgaatcattatccctaaatagaaggtcacactaaaaataccatggagctaggcagatgtgttcacccgtgcctgtggtcccagctgctcaggaggctgaggcaggagaattgcttgaacccagcaggtggagattgcagtgagccgagatcatgccactgcattccagcctgggtgacggagcgagactctgtccccgactcccc

SEQ ID NO: 219020 - DNA, 521 bp, Homo sapiens
agagagcaacccagaagccaggcctggagaaatctcttctgccccttagagaaggccaacagaggtcagagagtggcccagcagcactgcacaggaaaggctctgagaattaaactgccatttgaaccacagctcatgaaagtaggacaaggcctgcatgaatctcaacaaagtgactggctgttaaaattaaagatttaaataggaattagacttgtcatgtataacggacaaaatatcgaggatacaatctatgatcagtcattataaaaagaaccaagagaatcacaactggagtgaacaatagacaatgttactgatgctaccactgagattaatcagatgttgaaattctctgacaaggattttaaagcagccatcaaaaaatgataaagaaacagtaaaaaaaaaactcttgaaacaaataaaaaatagattagcccagcaaagtaacaggagtaatagaaaagaacaaattgaaagttatagaactgaaaaatacattaagagaaatatagcaa

SEQ ID NO: 219021 - DNA, 535 bp, Homo sapiens
gtgcaattgtgatcagatcatcttcctgcttgactttattaaacccaatgggtgcctaagtcctgtaagtgtatggcctaattaatctctgcccatggaaatcagatggaaagttctgattttctatcctgtgctcctacctgctaacatcattcacttgttaataattattgttttaaaaaaaaaaactcttgtcaatagacgtgtcagatttagacctgtggtttcagaaaaatttttggagcaaatttaaacatgtttggcactataggtaaatttgtatttaaaaaaaaaaacaatgtttgagtgtgcttttggtaatgctgagctttctttaaatggcttgtggagtcgtgaacttttgctaatgatgtggctccaaaaggtaatacatattaacattagactttaactttctgtaaaattggtttacttaaagttgggcggggggtgtgatactgtattagtattgttttaaagtggacactgtaacacgtgtggaaaaacaaataaatatgaaataaagtttaaatga

SEQ ID NO: 219022 - DNA, 195 bp, Homo sapiens
cccctttctccttacacccccaccctcctcccattcatgattaaatcacctcccaccaggcttcaccacccaaatttgggattacaatttcacatgagtttttctagcaaaacacagccaaaccatattattccgaccttgacccttctgaatctcaggttcttctcacagggtaaaatacaatcatgccttttc

SEQ ID NO: 219023 - DNA, 251 bp, Homo sapiens
gtggggatatgttctctgactcttggcacatagtagtcttcaggattgtaatcacaaaatcctttccccctatcctagagaaacacttttgggagctccttttatcatcagtgggagggggtgtgttgaaagtcttgtctgtacgtgttttctgtgctaatctgagagctggacccaaccccgggacttgggtcacttatgcacagagatctcattgtgaggggggaggaaaatggcagctcctcagctgc

SEQ ID NO: 219024 - DNA, 547 bp, Homo sapiens
catggtgactcacacctgtaatcccaacactttgggaggccgaggtgggtggatcacctgaggtcaggagtttgagaccagcctggccaatatggtgaaaccccgtttctactaaaaatacaaaaaattagccgggtgtggtggtgggcacctgtaatcccagctgcttggtaggctgaggcaggagaatcgcttgaacccaggaggtggaggttgcagtgagctgagattgtgccattgcgctccagcctgggcaacgagagcgaaactccgtctcaaaaaaaaataaaataaaataaacccttttcctttaagagaacctttcttattgctttgaggctacttccttactgctttgattgtgtgaggcgaagtgaaagttggatatttataattcttttggcttaaaaagttcttccctggaaagaaaggaacaaacttggatttctcaaaatggtctaaaatgtatgactgatggtttgcagcaggtgcagagcaagtccggggcagtgtctggcacagtacctttcctgtgtggcatccattg

SEQ ID NO: 219025 - DNA, 528 bp, Homo sapiens
caagacctcaattctttggagaaaaatggatgaagttccagggatggaatccgagtgatcgctaaggcaattcatatattttacccaccttaggataactggtttaggattggacaaacaatctcagctgcttcaatcagactcacttcctttcattcagatggaagatgggaaaacacaatgctatagactttggaatattgtatgggctcgtaatcagcgtactgaatttcaagccattccttggccactcaatggccactactaaatcacacaacccacccaactggagaattaaatcaaatatctggagcaatttaatgtgcatgcattcgtggccacaaaaatgaagatacaaataagtgctggatattagaccttcgtcagacacatagaccagtggaacagaatagagaacccagaaattagatcactcatcttcaaccatccaatcttcgacaaacctgacaaaaagcaatggggaaaggactccctgttcaataaatggtgctgggagaaatggctggc

SEQ ID NO: 219026 - DNA, 509 bp, Homo sapiens
tgtgaagcatatctgtcatgtctcctttaattccccatgttgattcagtgctttgtatgtggttggtgccatatatatttaaattgttaaatttgaaactgttaaattgaaatatgggaaatagcaatgggttgttcatataacctacttaatgacaatgtgtttaaaatagagactgacttaatcttgtaattttaaactttccttaaattcaccagaatattttttgtcctacaaattttacataatttctcattatcattactgtcttcttaatggatatttctcctatccttttttattggtaaaaagaaaacaactaaatacatgtatctgcttgctgtattttaaggaaatctaatagaagaaatggaaactgatggcctttgagaacatcttttaagataaatattttagggaaagggaactagtataccatttggtaatgtggaacggagtactctggaatgttggaagtcgtttattgaaatatttttcaagtctttttg

SEQ ID NO: 219027 - DNA, 376 bp, Homo sapiens
actggaggggcctgtttcctgttctcatctccgaagccctcaaaggacagcagcttccagcctagggtagggacgcgaaacaaggggcctccagaagaaggctggcgtctcagcagggagcacggacagggggtctgcagtcccttttccctcccggagcgcggcccggggtggagagagatacaccacactgcccaccccggctccgcctcccccagccgcggctcccgctccggctcagccagactccccatccggcggcacccggaggacggacaccgagcgcgcggctgcgcctccaagccctccccttcgccctccctctctggggtctctgcctccgtctccttttttaaaagctgcgtcacatgcatgc

SEQ ID NO: 219028 - DNA, 611 bp, Homo sapiens
cctcgacggtgtctgtgaagtggagccactgtggctctgcctgcttattacaggcttcacacactttgggaacaatttccttcttttttctcttttttgagacagggtcttgccctgttcgcccaggctggagtgcagtggctcagtcatggctcactgcagcctcgacccttctgggctcaagggatccacctcggtctcctgagtaactgggactacaggtgcatgctaccatgcctggctaattttgtattttttgtagagatgaggttttgccacgctgcccaggctgggaacgatgtcttccatcctgtactgcagcactaaggttcccagggaccagggccttaaaatgaacctgcagtgtttcctgggaaccctggtgtttcctggtggcacagtggttactgggtctcttttggagcaaaagaggagacagctgcctctgcagtgacttcagtgttatccacctgtccccacgtgccaggtggcagagaccagggcccagcaaaactcagtgtccactcgtcacacattattcctctcacttagagcaagcttgtccaacctgtggcctgcaggctgtacgtggcccaggacggctttgaatg

SEQ ID NO: 219029 - DNA, 634 bp, Homo sapiens
aactatgccgtggctggtggagaatttgaagtggtcattaaaaatgttaaaaatcccatcttttaaagtgataccacagctcattcaagaagatactggatatctagagattaagaaacgtggtctcctgttaaacatgaaaatgactccgtttataagcttctctaccacatgcacttgtctttgcatgatttcccatccagccttcttcccctcctcaatcacacaataccttaacggcgcacatttaggaaaaatgcaacctcctgggaccaacgagcctgatataatagaaccatgtcaacctaaagtatttatgacaaagataaactcttattttgcagaaatggtctgcttccttcagccttgttctagtatagagatctgccattccttgttgatccagattcaccaagacagatacctttatgtcataacagaagggaagttccagaggattctggagagtaatgaagaattgggctgagaaaccacctgaaggctaacagtgcattgcatgagatttcccacagtaaagctgaggtgcttttgggttcagtaattaaatattgagttcccaccctttaaataagcagttctaggttcctcaagcaattatttcactctgtaagta

SEQ ID NO: 219030 - DNA, 414 bp, Homo sapiens
tctgatgtgaaccaggccccagtgaggggcaatttaactacccaatggaagtgtgagcatggaaaccaggcagccagcccactggcagcaactcagggcagggggcgggggcactcccggaaggcactgtggccgcagactccccacaaggccacctggctggggacctgtccgtcaagaggcaagagccgtcaccagggtggtttgcagcttgatgactcatcctgaaggccagcattcaggttgaaagtcacaagttgcctgtgaaatcctgttagtaccactttaatggagtattaagttacaatattatgtaaaagcatgttgtaccgcaaaggctttcaccccagcagaccaaaacgcctgcattcctcatccagtgagcgtgcaggatgcctgcagggcaccaggagc

SEQ ID NO: 219031 - DNA, 420 bp, Homo sapiens
cgcacaggcaattctcctggatcttgtgtaaccttagcaaagaactgggactgaatttcccggtaggtggcaagatggggactcagatatattttgatataaaataatatgtactgtgacatttctttcaccctcaaacatcatatactttactgcttgttctaggaagctccatgacctcagagaaaaagataggctttacagaaaggcaaatttatattctaagcaaagactgtctcacaaataccactgtccaacaatgaaactttcccatgcttgtttcacctctaaaacaacactaggactaactttaaaggattgtttagaggattaaaatgtgtcaatacacaaggtgctaaaaaaaaatgtgtagcatgtaaaaatggctcaataaatgtatttttactgtggtatagcagg

SEQ ID NO: 219032 - DNA, 334 bp, Homo sapiens
cccccacccccagttgcaaatgctaataagtagttcaaatttctagattgattctctaaaagtttatgcaaaaaagaaataaaaaagaaaaagaaaaaagaaggaaaccaacaactaactctgtttctaagattttaaagcgataggcaagtcgaagaagcagagatttatttggagagaaagctcctgaaaccgacccagcctttggaagaccagcccgtctgcttagaagttgggactgttgattccttcaattaatgaaatgcatttggtgtttttaatcgtatttattttactttatgagaagggggagacgctaggagggtgcattaaa

SEQ ID NO: 219033 - DNA, 331 bp, Homo sapiens
aagaaaacgctgcttggaattgatgaagttaagtgctttaatgtgtagtgcctgacacattcattgtgaatttagagtgaggttacatttccgtgagtctggctcattcatgagattattcttagctatttttgaacccataaagcttgcttatagctcttcatatgcaagcattctcaacaaggaagtacacacgtaagaagtttgctcagctgggcaccatggctcgtgcctttaatcccaggactttgggaggccaaggcgggcagaccatgaggtcaggagttcgagaccagtctggcaaacatggtgaaacctcatctgtactaga

SEQ ID NO: 219034 - DNA, 370 bp, Homo sapiens
agtggtttgacttgggaatattcagaaggtttgggctacacataacagcctaggaggtttgaacagccctttcttgatggctagttcggcagtacccatctgaggacaaagtttcattccttgcttcttcattcatctgtgtgctgtttcattgcatgttattttgacccagtagccaacagccctctaatatggtttaggggataaagaagcaggcagagggacacttccacaagtctttgtaattgaacaaccaccaccagaagatggtttttctccactaagtctggcattttaatgagagaagttctttttgtttcctatctctgataactgactactcctccccaatcccccttcatcctttgcc

SEQ ID NO: 219035 - DNA, 515 bp, Homo sapiens
taaccaggcgtccacagcaccaggcggcagccagagggcctgcggtgggcagcgtaggggctgcgggactcgagtcacaggcgctcagatgctggcacccattcgcgtccctgacagggcgtggggtgtcctgcagaaaacttttgaggccaaaacacaaccgctgttagtctcctttcaaacattttggaactctagaaagaaataccctaaaactaagtcaccaaagcccctgggccagcctctgtcctctgctttatccatttcctcatgttttcccacaagaggaaaataaatcccaagctcgttcattcatcttcaattgctgcttcagctgctatctctcaacactcactgcagaatgaacaaatccccagcagtctccacacctttgctagggaactccttccccattcctggaaagcaggaggtagcaaagctgcttctcctagcaacaccctcccaagcttttactcctgcacttcaattaataaaaatcacgagcactgccccga

SEQ ID NO: 219036 - DNA, 538 bp, Homo sapiens
cttgtgggtgctgaattccgttcagctgcacggtcccacaccacccaaccgtggggtgttttctctgaaccttttgtttcaaggctatcctggagatgggtgatgacggggatgggtgtttaagcagaaatagctcaggagaccaggagcaagtctagaggtgagttcaggggtcaggctgtgggccacaggtgggcagctctacccaagagtttgatgggaacagagtttcattttaggaagaagaaaagagttctgtgggtggatggtgatgatggtagcagaataatgggaaaatatttaatgctactaaactgcatacatagaaaggttaaaatggtgtcttatgttagatatatatagtggctggtattcttaccctgtctataaacacacactttttggcactgccccttccctgccatgttgagtccccatgggtgaatctctgtgtgtctccaagtgtgtgccactgactgtcttctgtgctgtgtcccatgtgctgtgcccacaatctcatacagccggtgacttcaga

SEQ ID NO: 219037 - DNA, 517 bp, Homo sapiens
ccctccctttatgttcctaggttgcatctagattcttagcgaagaccttctgacatagtgtcacccaggcattgtcaactgccctgcacacagggagtgactctaatagtgaggagtctggcgtcaccatagaggatggggtaaagatttgaatggatcctgccagcagcctataagcataacatgaagatacttgtggcaaagattcttccttgaccgaactatacttgggttcctctggactgtcttctcaactaggccctgacttctgggcttccgtgtttgcctctgcattgtccaattttagcaagaatcctgctaaaccagtttaatcagaatccaccaccctcaatatttgattgatatctgatcagcttcctcaccctctaccatccccagatgatgtctggtaactctggcctgccttcagtaagaatcctgttaggttggtttagccagagtctacccttagccctgatgtttcctcttaataaattttcattcactgaccccgcca

SEQ ID NO: 219038 - DNA, 196 bp, Homo sapiens
cagtgattatttgattggcaaaggaaaaaggggtaagtcagggaaggatgactagactcatgccaagtggataaggttagggaaaagacatttcaggaagaatgactagtacatatatgcagagttatagagacatgaaatggtgcgatgcgctctgagtgctagaaggaagtctgtattgtttgtataaaatgcc

SEQ ID NO: 219039 - DNA, 416 bp, Homo sapiens
aacgagaaagaaatgtgtaaaaggctataacccagcccttcctgtttagaatccaagtaacagctttgcctgaccaaggcaggaacttacataaaaccaaaattgaatttgagaatagaaatgtaaattgatcaggctgggcatggtggctcacgcctgtaatcccagcactttgggaggctaaggtggttggaccacctgagttcgggaatttgagaccagcctgaccaacatggagaaaccctgtctctactaaaaatacaaaattagctgggcgtggtggtggatgcctgtaatcccagctactcaggaggctgaggcaggagaatcgcttgaacctgggaggcggaggttgcagtgagctgagatcgcgccattgcactccagcctgggtgacaaaagtgaaactccatctg

SEQ ID NO: 219040 - DNA, 554 bp, Homo sapiens
tctattgaggagtgaaaatggaactcctaaataaactagtatgaaataacgcaagccagcagagttgtcttaaattagtggtggatagaagacttagaatagaaacttttaatattaccgatgggggaaaaaaactactgttaacactgctaatgaaagaaaatgcctttaactttctaatgattatagataaatataatatgcatctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatgatctttccattggaaataactggaagtgaagaggttttgttgcttgtacagtgtcagatgaggaacaccactattttaattttgcgatacactgcatttgctggtgctatttttatacagtgaagcaacagctttgcagcaaaataataaaatacttctttgtta

SEQ ID NO: 219041 - DNA, 195 bp, Homo sapiens
ggtcgccgggcgccagcgtgggaacctgtgtccctctgctccacgccagggccgggaggaaggaggagccgcccggctgccgcgccaccaggaaggtccgcggtccccgccccgagggcccgggcggtcgctgggaggcgggggcggtccctgggcggcgggggcggtcgctgggccgggcccgggggcgggacg

SEQ ID NO: 219042 - DNA, 496 bp, Homo sapiens
taaggctcgagtcttgattgaccttgttactggaaaaggacccaagtcttgctgcaaatttatcaagcatctctgtgaagaagaccctcaacttgcctcaaagatgggtttgcactaagagagaagatggaactctggagcacttcagagacttcccagagcttcttccaagggagaagatattctcgtgaaagaaaaaaacaaaacaaaacaacagtgcttttttcaaacctgattaatttcatcaatttccaataaatctttcattctctcatattactttcttcttattctttctctcctcataccaacagaggataattcatcaataataatgaaggtcatgatgattgtaatgtaattaagaaagtccctccctttcccttcctttctgtttagttcctttgcaatcctgtagagacatgtacagcttactttggtgcttttagcactgagagtctgctgtgatgggaataaaatgaagtcccagctcaga

SEQ ID NO: 219043 - DNA, 371 bp, Homo sapiens
ggtcactagagattgtattagtccaaggttaaagagtcataatgctattaattttgcacaaagactctgaaataggcaatattcctatacgggagaagtaacagcatagataaccctgggatagaagaagtcagaataagccaaaaatgttgtgttggtgaatgaatataggggatagtgtcattacttgagaatcaaggtaatgagtagaaaagagagaaagctattgtgaccagggttaaagggaaggctgaaaaatattcagaaatcaggaggaaaggcagctacttgttagtaagattgaattctttctttatttttattttttttgagatggagtcttactctgtcgcccaggctggagtgcagtg

SEQ ID NO: 219044 - DNA, 811 bp, Homo sapiens
tcactgcaagctccgcctcctgggttcacaccattctcctgcctcagcctcccgagtggctgggactataggcgcccgccaccacgcctggctaattttttggtatttttagtagagactgggtttcaccgtgttagccaggatggtctcgatctcctgacctcgtgatccgcctcccacagtgctgggattacaggcgtgagccacggcacctggagagaaaaaagcttctttaatgacgacctcaacataatttacatggagaagtttcttaggtggaaaaccgatttgtatggtcctcagaatgtaacctacaggttcttgccctcagaaaaatgcatgcatacttttatgttacaggcttattttccaaatgcggtagagggccatcccttctttggcttcttgccttgtctctgaccccactgactgccccttttctgcctccatagctagtttcttattttcctttggctttttttttcttttcttttcttttcttttcttcttttttttttgagatggaatcttgctcttgtcacctaggctggagtgcagtggtgcgatctcggctcactgcaccctcctcttgggttcaagccagcgaggtagatattatcattttagagacagcaaaacagactcagaggggctaatgtgcccagtgccccaccgcttttaaatggtagagctgggatttgaatctaggcatacaggtaccaggatttctgttcttatctcccccatagcacctggaatgaggccatccatgtaagaggccaagtaataaagatttgttgaatgaaatgga

SEQ ID NO: 219045 - DNA, 575 bp, Homo sapiens
aaaagaaaaaaagaactaatcttcatctttccttctccttttggcttcttattagttagggttgtttccatagtgaatgtcaaaaacacaattcaaactggcttaaatgaaaaaggaactttgttggctcatgcaattgaaagtccagggatagtagtagcttcaggcataattgggtcttggtgctcaagtattagctttctccatctctaggctccacattcccctgtgcaagcttcactcttagagaggctctctcaatatagaggcaagggtggccccagcaactccaggcttgccaaccacagtgggatgagatccagctttcccagtagttccagccaatgtcccttttttttgacttgggtcaactgaacatccctgcaccaatcacagcagccaggggaatggatctattcatgggccaggccgggtcacatatctaccttaggagcaaggcgagtgggtcagcccccattgagctacatggactgagagtaaagggaaagatggctgcaaaggaagatctaggggctgaattcgggagcaggagatgaaactcacaaacatcctct

SEQ ID NO: 219046 - DNA, 556 bp, Homo sapiens
cttagttatggttggagagggtgttactgggcttcactgtaggggtgacttgggagcagtgaaaggatcaaattgcccagccctgactccacatgtgaatcctcatggtgccctggaggaggcagtgctgctgaggtaggcacttccctcgctgccacattccttctgctcctcttctctctgaccctcagaggtcaagtgggacaccctggaaagggaagcagctgcccacaaggccagtaccctccccagtttttttaggtaacaatctgaaaggacaaagccacagggcactacttggtccagcaggggcttgtcaggtaaaacgtccaaagagaggaaagggaacaaaagtttttttctttagttacctagaattacaatttattctaaagattttacttaaaaggaaaaaaagggactgattatcttggggcggagcagccatactagagagtgcccgcttcccgcctccctctgttgctcttatcaaccagagactaagaaaacttcagcttcagggggctgaaaacctaaaacaaatgaaagaaaaata

SEQ ID NO: 219047 - DNA, 381 bp, Homo sapiens
tacaaagcaaggatataatattcattcactgaaatatataaatattcatttgctgacaaccttcttcacccacactgtactactaggtattgtagatataacagtaaacaaaaaaggtacagtgtgtggattctgcaatctagtatcttagtcaaatgaggataaaattagaaaagaaatgtgaaggttttaaaatcctgtaattatcagtttattaacaaagcatacatatacttttgaagttcatcagatactttaaacttaaatatttcacctctataggaaaccagtgcataccttggattgacttctttagtttttttttttttttttttttttgagacggagtctggctctgttgtccaggctggagtgcagtgg

SEQ ID NO: 219048 - DNA, 469 bp, Homo sapiens
aggcggcaccggcgcccgggcaagccgagcccttccgcgatgagtcggcgccctggggtcgctgcgccaagagctcaggagaggcgcctcccctcctcggtgtttccgcagcccgcacggccctcccgcccaagaccccggggcgaccccttcccgcgtggcggggccagcgagctcctcttgcggggcgtggacggggccggggtgcccgggcaggcgccgccccggagcccacggtccacgcgctcccagcggccctgactttctccttgatggaactggttgacttcacggaatatatggagtgacttttcccactggattggaaactgttttaagcctgaataatgttagatacaatgagttctaaacttcccttcaaagaatcagtatatcagtatgttcagtctttgtcctgcattttaaagtctaccttcctcgcagtttcagtaaacaaccttttccacca

SEQ ID NO: 219049 - DNA, 135 bp, Homo sapiens
ggaaattaaacaaaatacttcataacaagcactagatccaaacagaaataaaaaggaaaccaaaacagtattttgagaccaatgaaaaaggaaagaacataccaaaacctatagaatgcagcaaaaccaatccta

SEQ ID NO: 219050 - DNA, 362 bp, Homo sapiens
gtggatggaatatgaactctctggcctttctccatcattctggaagtgagaggagatgggacattataatgctcttcatcaaagcatgggccctgtcagcatagctggtagtgtagtctccatttaatgtggttactttaatctaggcattcacttataatgcccacttcatattatctgataaatacttggatagagatatgacacagaggttaagaactaagagttaacttttttttattaagtttcagagccctataagaataagcatcgcaaataaaaatgttggtagcgtccggaaatttgcaattgcattcttaacccttctcccatccttgccaccaaccccaaagattctatga

SEQ ID NO: 219051 - DNA, 175 bp, Homo sapiens
tttaactctagagtatccttcgattggtgggattagagagcaggaagcaaggaagaaaggaaagaaggaaggaaggaaaggaaggaaagaaggaaggaaggaaggaaggaaggaaggaaggaaggaaggaaggaaggaagggagcccagacagggaagggactcacctaagtagc

SEQ ID NO: 219052 - DNA, 436 bp, Homo sapiens
atccttgtaaaagtggaatcatacttgtccttctgtagctggcttatgaaatctgttttttaaatgctggtaactaattcatttcattttttaaaaatgtattttatgtcttaaaactgcatcagattaaattgccagtttgaacatcaggcatggtggcatatgtctgtaatcccagcactttgggaggctgaggcaggaggactgcttgagcccaggagtttgagaccaacctgggcaacatagtgagaccctgtctccacaaaaagtacgaaattagctgagcatggtagagctcacctgtagtcctagctactcaggaggctgaggtgggaggattgcttgagcccaggaggttgaggctgcagtgggccatgattatgccactgcactccaatctgagctatagagcaagacccatctcaaaaaaaaaaaa

SEQ ID NO: 219053 - DNA, 433 bp, Homo sapiens
tatttctttattctgaatcattaaccaatgacctgttttttaaattctgaaacatttttcagttactatgcatttacagcactctaaaacactaaccaatcagctaacaagttttattgtaatgattttattgcgctagagaatacttttttattataatatttgagttctaaactattcatttctttttgttcttgaataagaatttaagggattcttggagattcttagctgcttttatatttagaatgctagaacatgatgcaaataccctcactttaatcaggaaatatggacactgacattaaaaagtcttccccctcacatacttgtgagtcatttttcctctacaagattcttttctgcagatttccactagacccacacctcactcaaatagactctcagtctcttgagtcaggcattcatttat

SEQ ID NO: 219054 - DNA, 484 bp, Homo sapiens
ggaccctgggtcctgtgtgtggcagatggtcctccctgcctgccccggcccccgccttccccatgggcctacggccaggactggaggacttgccccagcctaggttggccctctggccaggggaccgtccgggattcccgggcccaggcccactgaggtctgccatggacaagtgtaagatgcccaggacccccttccttggcagtgcccagatgggcccaggcccggcttctcccccagggcggctggcggctgcataaaccctgctcccccagggccctggcaaaggccgggcacccagcccaggagactccacaaagggttaaggggcgcaggcggctgtgcccacagtggggcggagcagccgggctggtgctgggccaggagcacgggcgaaggcgctgcattttaatgaatcgttattgccggcgaggcctttgtctttctttatccggtgcacaataaaagaattaattagacagaa

SEQ ID NO: 219055 - DNA, 280 bp, Homo sapiens
tattggagttggtataggggatgatgactgactgaaataggacttgcgagctcttttggggttattggaaatgttcttaaactggattgtggtgatgattacactccataaatttactaaaattagcaaaatgtacacttaaaatcggtgaatttttttacactcattatgtgaaaattcttaattacagacattatttgtaaactgttgggtgacatttgtattgacaggtgatagtaatgaagaagccattcaacaacaggtttgtaaaaaatacagc

SEQ ID NO: 219056 - DNA, 359 bp, Homo sapiens
tcgagatccagcctggatgacagagcaagactgtctcaaaaaaaaaaaaaaaaaaaaaagatggaaattgaataaaagctgcagatgcttcatataaaaacatcacacggtgatacccatctatgtagaaggagaattctatcctctccagctccgtagaacaagcagccacctctagcaagaaagatgtcatgggagaggtcagaacaaccgtgatacaaatcacgtgcgcaaagccttgcacttggctctttgaaagacgcctggggcttaaatcaatcatggtggttttgccacagttgcaatgagcttgggtctctctggcttgtactaaggtagcaccactggggtcaaacaat

SEQ ID NO: 219057 - DNA, 164 bp, Homo sapiens
aacttggggcagaattttgaggatgatgactaatctagtgaatccaaagaatgacaatgataaagagatcaaatcatgtagacttgagctgtgatgatggccttctggttttgaatatgatcatttacttggctttaccaatagctattcatttatcaataact

SEQ ID NO: 219058 - DNA, 235 bp, Homo sapiens
caaacccttagaatagataataaagagggatcaacacagtgcttacctggtcaggtgtggtggtcattatacttttatatatgacccttattgcacaattttaggaaatcactcaggctgggcacagaggctcgttcctgcaatcccagcactcttggaggctgaggcaggaggatcgcttgagtccaggagttccaggccagcctgagcaacacggcaaaaccccacctgtcca

SEQ ID NO: 219059 - DNA, 328 bp, Homo sapiens
gggacttgggggaaatggtgggagggaggtgagggatacaagactacaaattgggtacagtgtatactgcttaggtgatgggtgcatcaaaatctcacaaatcaccactaaagaacttactcataaccaaacaccacctgttacccaaaccctatggaaataaaacaattaaattaagaaaaaaacactggtgaaagaaattgaagaaaacacaaattgcaaaataccctgtgttcattaattggaagcattaatactgttaaaatatccatactacccaaagattcaatgcaatctccatcaaaattccaatggcattattcacagt

SEQ ID NO: 219060 - DNA, 491 bp, Homo sapiens
agtttgagacaagcctgagcaacacagtgagacgccattgctagcaaaaaactaaaaattagctaggtgtggtggcacgttcccgtactcctagctactcaggaggttgaggcaggaggattgcttgagcccagatgtttgaggttacagtgagctatgatcataccactgtactccagcctgggcaacaaagagagatcctgtctcaaaaataagtaaataaaaacagagtagaaaaattcaatcaaaaccaaaagaaggtagtactagaactcagagaaaaaaagataaacacttgcataaaaaaaaaaacccgcaaaatgacagaaataagcccttttgttgtatataatttggctggtttttgtccctggtttctggaagacagcctctaagtctaaacctttggaatttcccccagtgataggcgtgcctttgttattcatagtggataccttagaccacacctggtaaggtgactcatggtgggc

SEQ ID NO: 219061 - DNA, 543 bp, Homo sapiens
cctgtgactttgtatgcaccctgatcaaaaatggcattctgctctcagtcctgggtgtgggaaaatgcctgcagctttcccaatgtcttttccttacaaagtctccaagcctctccccaagttagctcttggctttgggagaagcaaagtgctctcccttggcctgggtttcttgaatctgcagtggaaaggtcagttacagagggaggccctctgcttctttcacatactgggggtcactcatttttatcagccggacactgataaaatcagaatctgaggtgtccttcacaatttgtatggattcctactttccttcttgaattaaagctgacagagttggtctttatgcactgtcttgctatttccaagtggctgaggtgcactaaaaatctctaatcccccgtcttggggggaacaaaatcaactttttttaatgtctatttcttttatctttcaaagagtatgtaaatcatgaaacaagacagaatatgagaatatgccttcatgtttccaggtagtcttttatttcccctcttttcc

SEQ ID NO: 219062 - DNA, 483 bp, Homo sapiens
cagaactgagcagaaagtagagagttcctatatatcctgaagttctactttcaacatcctacattggagtagtatatctgttaaaaaaatcaatgtacctacactgacacatcaacacgcaaagaccatggtttacattagggtttactcttgatgatgtacattctatgggttttgacaaatgtgtaattacatgtctctatcattacagtatcatcatacagggtagtttcattgccctgaaaatggtctgtgctctgcctattcacttctccctcctgcctcggccctggcaccagtgatctttttattgtttccatagttttgcttttttcagaatatcatatatttggaaagctacagtatagagtcttttcagattggcttccttcacttaataatatgcatttaggatttcacatgtctccttgcggcttgttagctcaatttttttagtgctgaataatagtccagttctggagg

SEQ ID NO: 219063 - DNA, 311 bp, Homo sapiens
tgcttacttacctaacgcactgcctggcacatagtaggtctacatggatggggctattgttgtttatctggctggttcctttgctatcagggacaaaagctaaccagaatgaaagtgctttcacgttacacacttaagccttatgagggaggcattgctataatccccattttacagagcaggaaactgaggctcagatagctgagcagaacactctcactggaggctgtaaagtgaggagttaggtgttctgggttgggaacctgggtctctctcccatccttacctctcctcagtccctctaccccttg

SEQ ID NO: 219064 - DNA, 537 bp, Homo sapiens
caagccctgaggcagagggtgtggacaaaagtactggagttccaacaattgtctataatgtccactttccacaaacaagagacaggcaaagaaacaggaaagtatgattcacacactggaaaagaagcccacaacagaaactgcttgtgagagcaaccagatttaacaggcaaagacttcaaattatacattataatacatattcaggtagacaaaggaaaccataaagaagtaaatgtaggtatgatcataatgttgcatcaaaaagagaatatcaacagagataaaaattattaaaaataaacatatggaaattcttaagttacaaagtataataactgaaatgaaattttcactagaaggactcaatagtagacatgaactggcagaagtattaacaaagttgaagacagattaatagcaatggtataatctgatgaacagagagaaaacaagacaaattaacatctcagagaaatgtgggaccccattaaccacactgatataaacaggagtaccagaagagaggtgagagag

SEQ ID NO: 219065 - DNA, 355 bp, Homo sapiens
ctgttgctaggtgtgtaatgtgctacaaaagattaaggaagtaatcagggagttatttatttattttcatttttttgtagagatggggtttccctgtgttgcccacgctggtctcaaactcctggcctcaagtgatccacctgcctcagcctcccaaaatgcttggattacagatatgtgctgtctcagccaggccagacaggtatttttaacatctaaaatgttaaattggcccagaaatcccaatttggaatccagaatgttgagatcaatgacaaaaatgtttattgtagcattatttgtagtgacaaataattgggaacaatcaaatcttggaataaattataatctattc

SEQ ID NO: 219066 - DNA, 560 bp, Homo sapiens
actggaggtcagtgtagccatcatctgtgctggagagccttgagtatatcactttactacggagattccagccaggttgatgtgggagggcatcataacacactgacacagctacagttggagtgccatgccaggctgccagtggcgagactttgctcacagttggcagcagaggcacccaaggctgtgccacctaactgccacccagcccaccccagcaagggccagtgccctggaagtctacttgacctcttttagaatctgtttccttatctctgaaaggggacaatgctgataccacctcaagggttttgtgagagattgcagagataatgtatgtaatgtggctcacagtaattgctcaataaatggtagattaaaaatggcaagggcagtgaagtagccagcaaaaaagaggttgaagtgatgcacaatggcacctacactgggtagggattgaagccatgaggtgataatgagctggagaatgggagaaatcaaaggatgggagatcttgatgagaatgaaaaatgtttggctgtgaaatgagtccttgatca

SEQ ID NO: 219067 - DNA, 336 bp, Homo sapiens
tcacagagatctgtggaatgtgtgggttccctgaagaggtggacggacccccggggtcgcgcgttttctcagccctgggcccgtagcggagctcgatccttccagagctcagggccagaaatgttgcgattccgaacactttgcctttcttctgagaggagccgcccggcagacgctcatcattaagaagcaacgtaattaacaacgaatgtttccccttggcgctaatgcgaacaccctggggaactgccaagtctggtaggggaatcgcagccgggggtgtctgggggaagccagcgtgggcgggcgcggtgggcctgggattgcttttaggcg

SEQ ID NO: 219068 - DNA, 859 bp, Homo sapiens
ggagtggggaggccccacagagacaggatgcccctgagaggctggaggctatgtaggagcttgcaaagcttgggtgggcagaggatgacatgatcagcagtctaggcagaggcacagagacacgaggctctggggaattaccagtggatctggatgacatagtggcatagtagaaggtggcgaggccatgagagagctgagttgatactggagagtctaggctctccccttttagcaggagagagcctccagaggcttcagcacctgcttcaggggagctgcaagcttagtctgggctctgggaagctgattttggagcacagcgggaggagggttggtggtgaccagtgtgaggaggagggttggtgatgaccagtgcgccccctctcccctacgatgcccctccccctgcggctgttcgcgcgcctctctgctctcccccgccctccttgccccctgtccgtctgttccctctccgtccgcgatcggccgcggaccgcctcctcccgcctgtcgtcacatcgggcgatacgctgtcctgcaccctacgcccgtccctgtctctccccttgcccccgccttgtctcccgctctccacccgcagccggtttctctccactctctctttcccacctccaccctcttccgcttctccggcccgcctccttgccccctgctcctttcttcaccccccccgcctcgcctccgcccctccccgtcctcttcgccctctccctctccccgacgtccccgccgtcgccaggctcatctgtcctcgtcctccccctctcctctctctgctcttccaccgcctctctcagtcctcatttctgccccgaccgcgtcctcacctcgctcc

SEQ ID NO: 219069 - DNA, 549 bp, Homo sapiens
ggagtggggaggccccacagagacaggatgcccctgagaggctggaggctatgtaggagcttgcaaagcttgggtgggcagaggatgacatgatcagcagtctaggcagaggcacagagacacgaggctctggggaattaccagtggatctggatgacatagtggcatagtagaaggtggcgaggccatgagagagctgagttgatactggagagtctaggctctccccttttagcaggagagagcctccagaggcttcagcacctgcttcaggggagctgcaagcttagtctgggctctgggaagctgattttggagcacagcgggaggagggttggtggtgaccagtgtgaggaggagggttggtgatgaccagtgtgagtctcgcctcctaagagacaggagagaactgaagtagggggagggagcaggtgtggaaagtacccggggagttctgggatcgtaggtgccctagttacggtgccctagtggtgttaccaccccaccctcattcctgctgtgtcagtgagaaggacttgaatcagacct

SEQ ID NO: 219070 - DNA, 377 bp, Homo sapiens
ggcgagactgtgggaaaagaggcccctctcgtacattgtctggtgggaaaacaaaatggtgcaagccctacctggaggggaacttttgccgcaaaattacatttgaatttaccctttccctggcaatcccctcttggcaaaaataagagaagacagattcataaagctattcatggcagcatcatttgtaattgtaaaaaaactagaaaccactcaaatgtccatcagtaggggcagcttgaccacacaatagacaactctgtagctagaaaaaggaaggaggccaggcgcagtggctcatgcctgtaatcccagcactttaggaggccgaggtgagtggatcacaagatcatgggttggagaccagcctggccaat

SEQ ID NO: 219071 - DNA, 114 bp, Homo sapiens
ggtgaaggctagacatagcaaaaaataaagatattcaaggagcgaagacattgatgaatgtctccaagaaagagaataacagagtaataaaaggcaaatggtgctgtaatattt

SEQ ID NO: 219072 - DNA, 192 bp, Homo sapiens
actaattgagctaattgcttatcttttgatgtggagattcaataagttttcctaaagttaataaattaagaaacagttttaatatattaaaacttacaagaataactttaaaatcaaaaagcattccaaatctcaagaaaaaaaataaagaagaaagcacaataaaatacgaactattcaacaaaacattga

SEQ ID NO: 219073 - DNA, 479 bp, Homo sapiens
acatcaaattatttggatccattatatctgatttgtttgtacctttagtctttgttcataaggtgatttttcagctgaattttgtgatttaatacttggccattgttcaaatcaatatctttgatttccatattatagaacagaaattttaaaatcttttgaaattcgtgtttctggcttttgtacatggtaaacagtcatttgtgaaacttgacagcatacaattgtattacttagaacaaatgtttttgcaaccacgtttgaaagatgttacacaatgcagtatttttacaatgtcttctttagaatgtgtgactatatttgtcaggttcagatgaattatgtaacaattaaacctcaaagctgttatgaagtatacagtttatgattacttttgtaaaagaaaatggaaagcatttgaaatataattttactctgtttcatatgtactttgaaaaagaaataaagtattataaatt

SEQ ID NO: 219074 - DNA, 365 bp, Homo sapiens
gtcagcatcttatcactgtgggcttactatgatgcctttagaagtcttttagaatgataatctttattttggaagtcagttatccttacatataaagttccaatttagaggtagtgaatttccaaatagaagtttatataatcatatacctttatcagaccaattgtgaatttccgaaaatagctgtagtataatttagtggaaacaactctagtctgaaaaaaatcatgagaatgttcttagccacagactgccatacttaactttgagtctgagtcacttaaatcatgttggccttcaaacttccccatatgtaaaatgagtgttgaactgattactgtggtcccattcagctaaaaaaataa

SEQ ID NO: 219075 - DNA, 491 bp, Homo sapiens
aggaatgtttataaattgttagatgtgcagcaaatctgtgaaagcgcaagatctatctcagggagaagtatacataacatataatgaggcactatcaagtgctaggaaacattttgaaagattctttgtgttgatcttatttaaactttcctttctgtctttcctccctctctctatctgtatctgtccgtggagtttcagctctgtttattccacttattggctttccccacagggaagagaactaattatctggatgatcaaaacacattatctactgtagtatatttattacttatcatgatcactgtgttctaaaaatcagaggaattcatacaaatccgtgaatgacctctcttgtactttatttgggcatcaagctgtgtgactaaattaaactatgggcagttctgtggatggagctgctttatcccatccatctctgttgcattcatcattgtcggcttagtgggtgcccatctgtcttcagg

SEQ ID NO: 219076 - DNA, 417 bp, Homo sapiens
tgctggtcagatttgttgggtgaggctccaccttgtggagatctctgagcagagctcggcttcaaaaccaaactcccaatgatgggttatgctttcaagtcgctactggtgtgttactgtttgaacctctgaaattactggcctgagacacaatttgtcaaaaacacaaagccttgcagtttgatagtaaatagaggatccttaaagaggggctttatttgggttggagatagtgatttgttcatatgttgaaactaggaggtccaattaaaccataggtgataaaatttatggggagagagaggcttattaacactttagtattactgaataataaatactgagaagagcgtaaattaaactggctttttttccatgacaagcatactttggtatcaaatcaacaagaggaaagca

SEQ ID NO: 219077 - DNA, 443 bp, Homo sapiens
atggaagaaaatatttgcaggctattcatctgacaagagattaatgtccataatgtatatgaatcttaacgctatagaaaaaatctaataattcaattaaaaatggacaaaagacctgaatagacatttctcaaaaaaggacatgtaaatgtcaaacatgtatatgaagaggtgctcagcatcactgatcatgagagaaatgcacctcaaaactacaatgaggtatcattttactgcagttaaaatggcttatatctaaaaggcaataacaaatgctggtgaggatgtatagaaaagggaatcctcatccatagtagtaaaaccactatgaagaacagtttggaatttccttagaaaactaaaaatagagctactatattatccagcaatgaaactgccaagtacatacccaaaataaaggaaatcagtatatcacagagata

SEQ ID NO: 219078 - DNA, 376 bp, Homo sapiens
tggacatgacaatcacccttcatctcatgcagattaatcttcctgtcaggttaaaaatgtgggggtggggttaggattgctaagagccaggtagattccttgagtaaaaagcattaatatacatattggcttaaggctagagtctgctggatacagttacaccatatcttggaactcaagccctaatgaattattcaactgagcagaataatccagcataactagcaataagcaacacattcatttgaggggaatgctgtagggaggacagacaggaatatttatttagtgtttatctgtattgtgccaaacaccttaagaaggacattccgctattccccttacacagcgaaaacacggagcctcagaaaaagat

SEQ ID NO: 219079 - DNA, 714 bp, Homo sapiens
gacttccatacaaagtgaaaaaaaaattaaagaatagatgaaataaagaccttcccagacacacaaaagctgaaagaatttgtcaccagctgaccatcagtacaggaaatgttaacagaaggcttttagacagaaagaaaatgataccagatggaaactgaatctgcacaaagaaataaaaagcactagaaaaggtaaatatgaacataaatacaaaagacttcttgtttttaaaaatatctttaaaaaacaattaactgtttaaagcaaatattataacaaggtattatggtagtaaaatctgtgacaatagtagcacaaaggccaggaaggggcaaaagggaaaaagtgtcatgaagttattataatatatataaagtggtataataaaacttgaaggtagactgtattaatgtaaagacgtttattacaaaacttaatgaaatgcctaaagaaacaatataaagagatatagctaataagccaataaagaagataaaaaggaatcataaaaaacacttaattaaaaagaagttaaaaatgagcaaaaaggaacaaagaacagcttggaaaaatagaaaacaaatagcatgacgatatatttaaactcaatcattttaatagccacattaaatgtaaatggtctaaactctgtcaattaaaagacaggctctgtcagactggattaaaaaaaaaaagcaggacccaactttc

SEQ ID NO: 219080 - DNA, 501 bp, Homo sapiens
gggatttcataattggttaatcttgcagtaacgccaggtgggagttaatttgaacagtgctgctgtgagcatcctcagacgtgctgttgtacagtcaggtaagtatttctttaggcttgaagtccaagagggttgcctgggtttagaatctgcctcagcgccatttgcactgagagcacaccagcccgttctcttagcagttctctggggaacatctctcggggacagggactgaccaggacttttcttccatgctatctcttatttgtagccaacagcctccatccctttcatgtaagcaataagttcctgcaccgcctaccatgtcatagatactcagaacatttccattgaacagaaaccgttttgttcatattaaagtgggatctgtttgttttgtttggttttgtttttaaagagactcagttaaatcacgtttatttccgcagctgtgtcattagccttgcgttgttatgtttaagtgtctacaccaggctccaa

SEQ ID NO: 219081 - DNA, 448 bp, Homo sapiens
caggggccaagttcattcagtcctccactcaactaataggtcttgaccatatgctgcatgtttggttttgtcctaggcactggagatacaacactgaataaaacagacaaacccctaccctggtggagcttaaatcctggtggaagagaaacagacacactaaataaaatacgaaatatattagaaaataattttctttttcttttttttggagacggagtcttgctctgtcaccaggctggagtgcagtgacacaatctcggctcactgcaaactacacctcccagattcaagcgattctcctgtctcagcctcctgagtagctaggattacaggcctgtgccaccatgcccagctaatttttatatttttagtagagatggggtttcaccatgttggccggggtggtctcgatctcttgaactcatgatccacctgccttggcctc

SEQ ID NO: 219082 - DNA, 432 bp, Homo sapiens
ccgcgatctcggctcactgcaacctccgcctcaccggttcaagcgattctccagcctcagacacccaagtagctgggattataggcatgcgccaccacgcccggctaattttgtatttttagtacagacggggtttctccatgttggtcagcctggtgttgaactcccgacttaaggtgatccgcttgcttcggccccccaaagtgctgggattacaggcttgagccaccgcgcccagctaagattaatctttttatgccctgcagcaaacaactagtcatgccaaaccatttttgtgatttggggaaacatgagcagatgatgctttggatctgattataattcacagtgctcttgtaatttacgtgagatttgcatacctgcctcccagcctcacaaaatgcctttaaaaaattacatcttggccaggat

SEQ ID NO: 219083 - DNA, 331 bp, Homo sapiens
ttgcctgtaagagattgggagccgagggcctgagggtgaagcctcgtttgtgcaggtgactgtgggactctggtgtaagtaacgctgggcccaccctggtaatgaaggaagacccaggcccaggcaggggcggtgtcacaggcacaggggctcgcaccctgggcactgacggtggctgtcgcaccagggccgctccttgcagaaacctcactgagcctgtgcctgttgagtagcttcatgaggagcggatatcaggcagagaaagcccgggcaagagagtgacacacggggcttctgcccagaacacgtgcgcccacaatcccgggagctg

SEQ ID NO: 219084 - DNA, 684 bp, Homo sapiens
cattagaccagtaagtgaaagcacataaaagtttaatgaaatccatttataatgtgtgccacagaacaaggctaaccctggccccaaatgaccagtgacacaaattatctcactttaagtatatgcaagaaccataactaaatccctgggaaaacactgtactaaatgggcttccactgtattcacataatatgttggtcaagaaggagagccaagattaaggatataactagatggagatgggaaggacagctctgagttttggatcccggaatacactgaaaaagatcaggagatgctcagttcatgtcaaatcaatcacaggtaggctttcaaacgcagactaatcagaaagaagcatcttgtatgatggtggagggtgatggaaggtggctatggcggtcaaaaggaaaaaacggcaggggcaatctatgtaaacatgagccagtgatttaacccctaggagcctctgtttcctcctctgcaaaaggggatttacagtatcttcatctcacaaagctatgatgaggattaaatgagaacatttgaaagcatatggtgcatgggtatataacagcacaataaatatttgatatttttaataatgtttaagcagtacagtgacaaaattaagacaagcaaataaaaagacctgagtagatacagttcagggcaaccaaagat

SEQ ID NO: 219085 - DNA, 428 bp, Homo sapiens
caagtccactgtgcagaaatgtttgccctgccttagtgatggtgaagataaggtgagtggagggaccataatttagtgtagttcatgcctgcctttgtcagattctgttcatttttgtaaaaagacgttaggaattaaacatggcctcacgtgctatgtgtctgaaaagtggtctttttaagagagcaaggagttatgctggaagcaagcttatttacttgtataatttagagtttgattgactccatgtatctctggggacattattttggcactagtttttgaggacttaattttctagtaataataaaaatgcatatattctcttatccccaccctcaaacacctgttcatttgggacatgcacatgtaattagaggcgtgtttcaggacttgcctgtaaaattcctttgcatgcagttactgtg

SEQ ID NO: 219086 - DNA, 369 bp, Homo sapiens
actttagttttgttttctgggccaaagaacagagcgaaagcatctgtccactgatttctcctccagtctctccctgtcaacctgcgcagaaagcacagccacaagtgtaatccaatactgagacaaggactgctgtggctctccagccgcttgagatgggagtggaaggacgctggatgaccgaacaaagactgtcagggaataagagaccttcaacatgagaggagcagaaaccaatacggatcaacattccctactgatacaattgattcattttcctgtatttcctcagccattccattttccttgttaaaataaaacattgcctggaaacctctgttaacagccaacggaggactcatgtgaaaa

SEQ ID NO: 219087 - DNA, 515 bp, Homo sapiens
cctcgactaaattgtgaaaaatgctttttaaaaaaccaaacattccttgtttcaagccatccacttttccatttagtcgttttcagggaggttttgtacaaggaatagttgtttgtgccgccgaattccaaggtagtgtggtatacaagttgcatgttgggatcttgactaatttctttggaaactggctgaacatactactaatgtatagcagtaccacaaaaacttgatttttgtgcataagaatcaataggaaaatttgtatttctcttacgatgaaaagtggttaaaaaaatgaatatcattagtatttcagtaaagcttggggggagataaatattaaaatctaatgagaattattgtggactttaaaagttgtgtttcttgaatagtatggacctttttaaaagaaaaccgaaaggacagagaaaaaagggctagaaaaaaagtctaaaaagctgttcaggtatgagttggtacccgaattatatctcaataaagttgttagttacaaa

SEQ ID NO: 219088 - DNA, 441 bp, Homo sapiens
aaatgaagctcagagaggtatgcatttctctcaccatatcacctctttttgacactaagagccagcacaggaaagtaaagcagtgcttctcacacttaattctgcataggaattgcctggagatcttattaaaatacagattttgatagagtaggtctgggtggggtctgaaattctgcatttctaaccagctcccaagtgatacccagtccatggaagaactttgagtagcaaggtcttaccttgtctctttgacatgcttctctctgcctttgccttatttccctttctacttcttgccttcatctagctttaaaaaacttcctaacaggaatgtcccacaagcgtgagccagtatatttgtcattctcaaaaggatttatagcattaaattcactcagataacaggtaattaatgcagaattcctctgtgcaatattc

SEQ ID NO: 219089 - DNA, 602 bp, Homo sapiens
tgtgttcagaaaacaatgtgagtctccaattgagcttttctctgcagtccagtgggaagcacagaaacacatgtttcatgatgaacaaagtttaagaggggtaggtttcttcttaatttttcttcttgttttctttacttgaaaaaaatatctgatgatattgtctgacaataaagttagaaagaagcagagctaacagactcgttaggctatcagaaaggctttagtatcatagatgtcatatttagtataatagatgtcagaggctcccacaaagttcataaatattatattgatagccttaaagaagagtgtaattgaatttagattttgtctatgtgtgatttggtggaatatggaaagcctttatcctttactttttttgccattctactaacttatgtatctaaagaaaactgttgctttttgatgtcttattcaagaaccaaagtggagtttttatttttttttcagtggataatgggttgtttgtgagtaagtcacctttacagcatattataagaagtactatgaggccgggtgtggtgggtcatgcctgtaatcctagcactttgggaggccgaggcaggcagatcacctga

SEQ ID NO: 219090 - DNA, 392 bp, Homo sapiens
cacctcccgggttcaagcgattctcctgtctcagcctcccgagtagctgggactacaggcgcccgccaccatgcccagcaattttgtatttttagtagaaacggggtttctccatgttggtcaggctggtctcgaactcctgacctcaggtgatccacctgccttggcctcccaaagtgctgggactccaggcgtgagcacctggcctgttctgacatattcaatagtgtcagggttcttctgtctcctgaaatgaggggcctgttgaaagcagtaggggtgtggaagaagaacagagggtaacatagaaacgaggcagcaaacacttgcacctgctacctgcgcccaggctgccgtcagtcgacgcggccgcgaatttagtagtagtaggc

SEQ ID NO: 219091 - DNA, 284 bp, Homo sapiens
accacgcagaatcctctcttcaacaccaccttgtctgtggtggttgtgcccactccctccactgcccacactgctccagactggtagtagccaatacgtgcctcctcctacctacccaacacattcaggtgctcggagcgatgccctgcagatggaccgaagtctgccatttgattactcacgttctgtttcctgtttctcttttcttactttcttgaaggttatttgaacatgttttagggttgcatcttgatttatctgtagtgcttttgaaccatatcgct

SEQ ID NO: 219092 - DNA, 352 bp, Homo sapiens
ccttgtgatcaaggtcaggctcttaaagtaatgtgatcattctgtacacattagaagtataccagaaggctgggcccgatggctcacacctgtaattccagcactttgggaggccaaggcaggcggatcacctgaggtcaggagttcgagaccagcctggccaacatggtgaaaccccgtctctactaaaaatacaaaaattagctaggcgtggtggtgggtgcctgtaatcccagctactcgggaggctgaggcaggagaatcacttgaacctgggaggcggaggttgcagtgagctgagattgcgcccttgcactctggcctgggcgacatatgatactctgtctcaaaa

SEQ ID NO: 219093 - DNA, 399 bp, Homo sapiens
tcacccacatactcttttgcttttttccaagagaaatggcacattttctggatgtgagagttggtcaaaagatcacaaaaaaagtcaaaaaataattctactctgtgaatgaaaaatggatatttgtacttaccctcataagcattaaaagaaaataatgcatgaaattccatagaaatgtgcctatcatgttatactgactcaaaccagaagacctagagtatgatattgctaatataatacatgtggtgggtatgagtggaagtatgtgtgtgagatttatcattgccatagtgtaaaagagttgaattagcttccacttgactagatgagagctcttagttcttattttgaaagcaatcaattgagcatggttaattaggatatcaccaagtagtt

SEQ ID NO: 219094 - DNA, 181 bp, Homo sapiens
gagcttttgcatggcaaaaggaagagtcagcagagtgaacagacaacccacagagtgggagaagaagatgtaaaagtggtccacaaacatgagaaaatgctcaacatcactaatgatcagggaaatgtaaatcaaaaccacattgcgacaccaccttacacctgcaagaatggccataatc

SEQ ID NO: 219095 - DNA, 664 bp, Homo sapiens
agccggtccttcatctcctcccacctcaggctgtaaaaacacatctgctacagtcccttttgccatgtaaggtaacatattctcagggattaggacttggatgactttaagagccattattctccctgccccagccagttacacttgactgatattctctgagccccgtgtgagcccagcctatgccagttggaaacagagaggaacagggctggatgagcctctttctgcttccaggccccatctgcttatgggaggtcaacattccctctccatccctccaccaccacttccaccccggccctgcccttcacctcccctggtgaccttgcgccctctgtgcaaatactaggctattactcctctcttccccaatgcagcaggcttctgacaaaggaggtgggtctgagaacttatttagaagatggacagaggccatgcctagcatccggccacctggccgcttgtgatgaattgtagggatgggacagagatcagcacacacattgttagtgctttctgggtgccgggcatattccaggcgctttacttatagtaaccatttaatcctcacacccacccttcccggcagataccacactagtttcctcatttgtggggcaccagaaggctgaataactcgccaaggtcagctagtaagcag

SEQ ID NO: 219096 - DNA, 1104 bp, Homo sapiens
tggtgtttggcaaggagtacacagtgggaaccaaggccatgtacagctgcagtgaaggctaccacctccaggcaggcgctgaggccactgcagagtgtctggacacaggcctatggagcaaccgcaatgtcccaccacagtgtgtccctgtgacttgtcctgatgtcagtagcatcagcgtggagcatggccgatggaggcttatctttgagacacagtatcagttccaggcccagctgatgctcatctgtgaccctggctactactatactggccaaagggtcatccgctgtcaggccaatggcaaatggagcctcggggactctacgcccacctgccgaatcatctcctgtggagagctcccgattccccccaatggccaccgcatcggaacactgtctgtctacggggcaacagccatcttctcctgcaattccggatacacactggtgggctccagggtgcgtgagtgcatggccaatgggctctggagtggctctgaagtccgctgccttgctggacactgtgggactcctgagcccattgtcaacggacacatcaatggggagaactacagctaccggggcagtgtggtgtaccaatgcaatgctggcttccgcctgatcggcatgtctgtgcgcatctgccagcaggatcatcactggtcgggcaagacccctttctgtgtgcgtaagtatgtcatccactctccctagtcatggggctcagattcaacatggactttctccctgtctcttaattagattagctagaggtttgttttaaatatatatatatatatatgattgctattttttttttcaaaactgaaagcattgttgatctaatgttttcagttctctgcatcattaatcactgttttcacctttattatttccttccttgtgatttcttttggtttacatttttgttcattttctagcttttgagtaggaatttaattcatttattttcattctttcatttctattgagttttattgctataagtgcttaagactatgaaatttcctctgatcactgctttaattgtatcctatagagtctaataataaatgtttattatttattagaaattctgtaa

SEQ ID NO: 219097 - DNA, 5463 bp, Homo sapiens
tggtgtttggcaaggagtacacagtgggaaccaaggccatgtacagctgcagtgaaggctaccacctccaggcaggcgctgaggccactgcagagtgtctggacacaggcctatggagcaaccgcaatgtcccaccacagtgtgtccctgtgacttgtcctgatgtcagtagcatcagcgtggagcatggccgatggaggcttatctttgagacacagtatcagttccaggcccagctgatgctcatctgtgaccctggctactactatactggccaaagggtcatccgctgtcaggccaatggcaaatggagcctcggggactctacgcccacctgccgaatcatctcctgtggagagctcccgattccccccaatggccaccgcatcggaacactgtctgtctacggggcaacagccatcttctcctgcaattccggatacacactggtgggctccagggtgcgtgagtgcatggccaatgggctctggagtggctctgaagtccgctgccttgctggacactgtgggactcctgagcccattgtcaacggacacatcaatggggagaactacagctaccggggcagtgtggtgtaccaatgcaatgctggcttccgcctgatcggcatgtctgtgcgcatctgccagcaggatcatcactggtcgggcaagacccctttctgtgtgctggtgtcctgtggccatccgggctccccgcctcactcccagatgtctggagacagttatactgtgggagcagtggtgcggtacagctgcatcggcaagcgtactctggtgggaaacagcacccgcatgtgtgggctggatggacactggactggctccctccctcactgctcaggaaccagcgtgggagtttgcggtgaccctgggatcccggctcatggcatccgtttgggggacagctttgatccaggcactgtgatgcgcttcagctgtgaagctggccacgtgctccggggatcgtcagagcgcacctgtcaagccaatggctcgtggagcggctcgcagcctgagtgtggagtgatctcttgtgggaaccctgggactccaagtaatgcccgagttgtgttcagtgatggcctggttttctccagctctatcgtctatgagtgccgggaaggatactacgccacaggcctgctcagccgtcactgctcggtcaatggtacctggacaggcagtgaccctgagtgcctcgtcataaactgtggtgaccctgggattccagccaatggccttcggctgggcaatgacttcaggtacaacaaaactgtgacatatcagtgtgtccctggctatatgatggagtcacatagagtatctgtgctgagctgcaccaaggaccggacatggaatggaaccaagcccgtctgcaaagctctcatgtgcaagccacctccgctcatccccaatgggaaggtggtggggtctgacttcatgtggggctcaagtgtgacttatgcctgcctggaggggtaccagctctccctgcccgcggtgttcacctgtgagggaaatgggtcctggaccggagagctgcctcagtgtttccctgtgttctgcggggatcctggtgtcccgtcccgtgggaggagagaggaccgaggcttctcctacaggtcatctgtctccttctcctgccatccccctctggtgctggtgggctctccacgcaggttttgccagtcagatgggacatggagtggcacccagcccagctgcatagatccgaccctgaccacgtgtgcggaccctggtgtgccacagtttgggatacagaacaattctcagggctaccaggttggaagcacagtcctcttccgttgtcaaaaaggctacctgcttcagggctccaccaccaggacctgcctcccaaacctgacctggagtggaaccccacctgactgtgtcccccaccactgcaggcagccagagacgccaacgcatgccaacgtcggggccctggatttgccctccatgggctacacgctcatctactcctgccaggagggcttctccctcaagggtggctccgagcaccgcacctgcaaggcggatggcagctggacaggcaagccgcccatctgcctggaggtccggcccaatgggagacccatcaacactgcccgggagccaccgctcacccaagccttgattcctggggatgtttttgccaagaattccctgtggaaaggggcctatgaataccaggggaagaagcagccagccatgctcagagtgactggcttccaagttgccaacagcaaggtcaatgccaccatgatcgaccacagtggcgtggagctgcacttggctggaacttacaagaaagaagattttcatctcctactccaggtgtaccagattacagggcctgtggagatctttatgaataagttcaaagatgatcactgggctttagatggccatgtctcgtcagagtcctccggagccaccttcatctaccaaggctctgtcaagggccaaggctttgggcagttcggctttcaaagactggacctcaggctgctggagtcagaccccgagtccattggccgccactttgcttccaacagcagctcagtggcagccgcgatcctggtgcctttcatcgccctcattattgcgggcttcgtgctctatctctacaagcacaggagaagacccaaagttcctttcaatggctatgctggccacgagaacaccaatgttcgggccacatttgagaacccaatgtacgaccgcaacatccagcccacagacatcatggccagcgaggcggagttcacagtcagcacagtgtgcacagcagtatagccacccggcctggccgccaccaccgccaccgagagccccgcctccagcagccgttccccagggggcaggaagtaggctcccctgagcacagtgcccagtgcccatcttcgttcgtctccttgcctgtgtctgctactgctgggactcaggccctcgccctgccgccatctatgccagttaccctggagaggactcctgccgtgtcctgaaaaggcagaaaaggaagaggggctgcagacagaggaagaaagtttatggatttaaaatagcaaagcaacttgtggatctgtgtgtgtgtgtgtgtgtgtgtgtatgggcctgatcacacacaaacacacacacctctccttcattcacgtcctatggaagagaccataaaggcttcaaaactagaagtgcgcatgaaggatgcttcatgccctgttccccacacagagaagagatgaagagggggaggtacggtcagctttcaaaacaatatgccccccgcccatcccatgtgtgaggacatggtgactcggtgactgtaacagtaggacacatcccatcatgcggtcagagtgcagaaacccggtcagcgtgcagaaaccagctgtctgctgatgaacggcccatctgcacagcggcagcaaggattaccccaagggcaggaaaaaagtctttggaaatagattgaaaatcagtttctttatttttttcaaacactgttttattgagttctaaacccagtggattaaaaagtcatttgggtcctgggaagcactgggaaagaagggagagccggggaggatagggcaggagtctggccaggagcccaaggtcaagtctggctgtcaactgacaaagagaagagaagacaagtctgtggcccagacagggtgccaagtctgggggcagcagcagggtccttgagagaacaggggagcaagcctgccccagtacccaaaaaacaatggctatcatgtactggggttattctctgtgcctgacactttacctatagtatttctagtctgcacaataacaccaaaatgtaggatttgttattcccctttgacagatgagaaaacagaagcctgcaaaggtaaagacagagttaggaagtgtggagtcagaatgcaaacccagatcagtctgccccaaagtccactacaccagctgccagaaaccctgttctagaaggggcagctaagaagggaggagccgatgaaactctacagtagcactgtggccaggtctggaaagccaggcaagacacctgtgtgtcctatctgggttctgctgtctccgcgtaggcagcttcggggcaaggattcaactccccaggcctcccacggttggtgctggctccttggctcccagcagccgctgaccatagccagcaaaagacctggcaggtcctgaatcaaaacaacagagtggctgaaagtcacacctctccagctccttgcgagtgggtttgattgattttgacagctatatcatgcttgggtcgttcatgaattccatgagaattgttgggaagttcatgagtttaggaatcaaagtatagcatttagggccactttctctgtcctcgggaaggcccccacaagcttaagcccctgtatacgtgtgacatgctggcctcagagattcatgtcacatattgaaatagcaaatagaaatgtgcaggagcggagggacagcgacacctggttcttaagcaaattctagattggaacaattagaagatctgactgatgttaagagtggccagaggaaagtgagaggcgtccatttccagcagacacaatggaggctgacagaggcaggagcctacccctggccacaccacctctgggacacggcacccccctgggcctggagggagagggccaatccagacacactcacactctcatctctttccttggctggaaacaagtgcaggaagctcccctcccaatttcttatgctcccttcccccttacactcctctccttcgactgctcccttcccccttcttatgcccctctcagaccacccagcggatgcctattcccgccccccacccctcccctgcgtctccttgtaaagttccatgagatgctcgaggagcacctgctggtggggcacccagcactctgctgggcatcaccctccgcacccctgacatttctctccacctccagaggcttggaagggaacagggcagatgaggcccttcacccaccatctacgccatatacccatcaccatcccatgaggaaaaaaaaaaaagtaaaacaaagacaaaaaaaatcttttgtacagagatatatttttattatacaaagtttgtacagtaccaaaaaagaaaaaaaaaaggtgtaaatttttttttcattattgtaggtaaacggtagtggaagccttttttgtaaatgtaataaaatgtataaatatggttttcagaaaacatcaagtgctgtaaatatgtaatctacacaccttcttggcttgtctgcagtatatacatttaatttatctgtctctgtatatgaggcttccccctggggtcctgcattatggtactttcctgaatttgaaagcaattttaaattttttgaattcaaataaaatataaatttttgcattg

SEQ ID NO: 219098 - DNA, 442 bp, Homo sapiens
tgctggaatggggatttgaaccgaggtccatcaggattaaccagtgcataaggccttagaggccaggggcggggccccaggacaagcatgggagctgcttggggaaagccactccatttctgccctgcagcctttgcccagcccgccaagtccgctgctctctggagccagagggtggccctcaggctggtggcctgcctctcccgatggggcctgcctgcaactcgataaggctaggggaaccctctgctaattgtctggtaacctttgaaattctccttcacggtgggttctcttttcggatgtttttcaaggtaattcattccttttccataaattgccagtggcggagcattaggcagctggtaattaatcataggagcagcttcgagttgattctttgaaaaagaaaaaaaaaatgaggaagagaaagccttggtga

SEQ ID NO: 219099 - DNA, 327 bp, Homo sapiens
catacccagcttaaatgcatataggttttataccttagtctattctaatacctcagtaatgatgaaactgatttctaaagtttccaaaatcattatttttggagaaataccaaatacttgaaaagttccaagaaagcataacggtgagataatatattaagagccatatatttgtaaattagaagccaacttagctgacttgtacattaattgaactttctataggttctcagttctctcaaaaggcccataatttgcttgtttagatttatctgctaattacacttttcaaatatatttccatttctgtagcagtcctagattcga

SEQ ID NO: 219100 - DNA, 277 bp, Homo sapiens
taatgtaataagctgagggaacttactgtagagtctacagtagatcactttgccttaatttctatgtctaaaaaatgaaaagcatgcttgctgaaccacataggcacactgtaaagaaggaactgatacccttttaagcatttaggaaattctggtataaagtagtgccagcttaaaaagatgtactgccatataatgaactgaaatttacattatgtgaaataaatagaaaattagcggccaggcatggtggctcacgcttgtaatctcagcactt

SEQ ID NO: 219101 - DNA, 461 bp, Homo sapiens
tttaaaggatgaattctttgtatttctcttgtgaaccaaggcttagtctgctctaccacgtttttttaaaggaggcttttatcactcaatttacatcagtgagtgaagctgcaagatatttttcctctttcggaactgcgtttttccaccctgagatattacacataaggctctagagtgtgactatgcctcagggtcgtgggactttcattgtcaacccaatcattccaaaactcaaatctctgagtttcctgtgttatttaataacattttcaattaggctgcatctatcaaggtctggtttgcgtttaggtaaataggtgagcataaatgcacacttcctatctaggatggatgggagagtgtacgccatggaatattccctatcaggttcccatatttgggtaagagttggcttggagttgaaacacaatagggtagttggacctgaagaaatataa

SEQ ID NO: 219102 - DNA, 155 bp, Homo sapiens
gcacacgcctgaagtggacttatgtctgcagggtggacactgtgccctgtctcctccacctggcgtgtgagtatgccccctggtaatgcagttcacccagatcttcaaatcaaaccatggcataccttgtctgtggatgtattatgatggggtga

SEQ ID NO: 219103 - DNA, 493 bp, Homo sapiens
aaaaccctgtttttctccccgcaccctgctccaggtattcttctctgactcctcacagatcttagctaggaagagtctattatacatattacaacaatataatcccttacgtttttatggtgttttagagtttacaaagcagtctcagatagtttattccctttgatgctctcagccaccctgtgagatggggcagagaagaaatgaagtctcagttcctgctgcagatggttgtagagtgaagagcagattcccaggttttccaaatcaaagtctgcttttgttctattacattaaacgtacatttgtaatacaaaatctgtcacctattaaaatatctttgcaggtttatcccaactaggtgccatatcttataaaaagaaagccctagggatcgttaactaaatctttcaactgcctcaaagatcccttttattattattattattattgccctatctgctgatttcctactggtagaaaaagaatctgg

SEQ ID NO: 219104 - DNA, 387 bp, Homo sapiens
tggcacatgtatacatatgtaactaacctgcacattgtgcacatgtaccctaaaacttaaagtataataaaataaaataaaataaaaaaaggaaaaagaaaagaaaatggaaacacaaacacacaacccttgtaggaatgatctggggaccttctcacaaggtgcgggaccacagggcaatttcacattgctagccatcacatgctgtgcagtgcttcttttccagggaggcttttggctttccgcagaaaccccatggaaactgccactcaaactttttcatcctaagaggagccatccagaatgatttcatgtaacagcagtgacctgtaaaattaattccaaacaacggatactttctgtgtcccctataaatgttcaaattac

SEQ ID NO: 219105 - DNA, 123 bp, Homo sapiens
gagccgagattgtgccactgcactccagcctgggcaacagagcgagactccgtctcaaaaataaataaataaaaatagatgatcatagacaggagggatgaagtagaagattcaaagcagctt

SEQ ID NO: 219106 - DNA, 422 bp, Homo sapiens
cgagcggccgcccgggcaggtacctcacagaggtcccaagattatcaaataaaagcacacacacagggtgtgaatgtgccatcgtgaagcaccaaataatgtataaacatcagcatatttaataaaaataaatatgtataataaatatctcatttaatcttcaatgatgtcaaggcctttaatctcagttttagtagatgccaatactgaggctccaagagtttgctgttaacacccaggattatatggcagatttgtatccccagtcccagttcataaggctccaaatcaatggtcatttgacttaatgggttgtgaggtatgtggctgaaagtcattccctacttatcatcaaatattaaagtctggaaatttaaaaaataaatataatttagaattatattcaattttgaattatacaa

SEQ ID NO: 219107 - DNA, 831 bp, Homo sapiens
gaattttacatttatacacatacacacacacacacacacacacacacacacacacacacagagaaaattattgctaaattaacattccatgatcaataagcaacatggaggatgacgacataggtgctgcaatatttagcccatacaccattttgtatgattacaaagtactaaagaaagtgactgtcatagcatgtgacatttgggggatttcaaatatttttacagaatatacacttaagctggcccagagttcaggtgttaatgatagcactctccactcaacacccacccccatcaagaagcaacaagacagtacagttaagaacacaggctttgaagccatgttctttgttaccaaaaaaaaaaaaacagtcttactttgtcgcccaggctggagtgcagtggcacattcttggctcaccgcaacctccgctgcctgtgtcaagccattctcctgcctcagcctcccgcgtagccgggactacaggcaccccccattgcacccaactaatttttgtatttttagtagagacgggggtctcatcatgttggccaccctggtctcgaactcctgacctcaagtgatccacatgcctcagcatcccaaagtgttggcattacaggcatgagccaccacattcggctggagccatgttctaatcccagctctacttctcactagctatgcggttttaggtaagatattaatacttaagtgctatgaatctcagtgtcaccatctatacaaataggactgagaacacctatctttcacagtttaaggtgagaattaaaagcattcaaatatatgaaaggtcctgtaagtca

SEQ ID NO: 219108 - DNA, 595 bp, Homo sapiens
tgactgtgaaaaggggaaggggataatttgccactaagtaggggatagaaagaaaggttgccatctttatacttttcaaaataagagcacgggatttggatttataatcctaacttttgttaatcaaaagctgtgaaactatgaacaagcctcaacctctctcagtttcctcatctgtacattgtggggaaatttcctaagtcataagattgcagttaaggttcaatgaattaatgatgtcaaaagtgttttgaaatccacaaaatgccaaacaaacgccaatcattacaaagttgtctgtcttctcatcagtttaccagctacataggacagtggttatttaccatttgacaggtgagatcatcaaagcccagagaaagtgcttaaagtaacacacagctcaattctgacttcttacagcagaggtaactgttcctttactacaggggttcttaattagcctgcttgcctcattaaactgacagatctctgagggaggggactacatacatcttacacatttttgtaccccagtgcccatcatggcacacctaaaagatgtgaagtgttactagaatgatgactaacatattgg

SEQ ID NO: 219109 - DNA, 648 bp, Homo sapiens
  misc_feature (606)..(606): n is a, c, g, or t
catatctgttgtagcatgtaccattatttaattcattttgatggccaaataggattccaatataaaatgtacttaactgtttttccttatattaactggttgacattttgacatttgagtatttccatttttcatatttggttataacaaacaatgttccagtgagtctttgtgtgaaccaacattttcatctcttttgggcacatgagtgagagtggagctgatgcaccaatatggtaattccatgttaaacatttcgagaaactaccaaattgttttgtaaagcggctgtgctgttttacagttttatcagcagtttgtgagggttctatgtttacatctctgccaatgcttacttttgtttgttgttaaatcattctactgcataagaagggatatctccctgagggttatttttttgagacagggcttcacttggggacccaggctggagtgcaatggcatgcttatggctcactgctgcctccacctcccaatctcaaatgatcttcctgcctcagccactctgggctaagatgggaggatcacaggagcccaggagagggaggccaggcttcaatgagctatagtcataccacctaattncaccttgagcacagagtgaggccctgccctttaatcaaaatt

SEQ ID NO: 219110 - DNA, 443 bp, Homo sapiens
agtctgatttgcctaaatactgctaggtcgccttcttaagagtatgagaaactccactttcccatgcctgccagtttaaagtgttgactccgtacttggctattacagatggcataaagtgtgagctcattcctcttcattcatttattcaacaaacaggccgggtgtggtgttctcaggcctgtaatcttgacactttcggaggccaaggagggaggatcccttgagcctaggagttcaagaccagtctgggcaacacagcaagacctcgtctctaccaaaaaaaaaaaattaagaaattatccaggcatggtggtgcaacctgtattcctagctacttgggatgctgaagtgggaggatcacctgagcccaggagttggaggctgcattgagctgtgattgagccactgtactccagcctggactacaaagtgagaccccg

SEQ ID NO: 219111 - DNA, 201 bp, Homo sapiens
tatggccaggtgtggtcctgtggctcaattctggccagtggaatgtgggtgaaaggagtaagtgcttcttctaggccagcccacaaaaacctcctgggtcagtgtcccaggtgccttctccctctgttggcttagagcagccagtcatagtggtcttgggggccatgtgttgaaggtggcagagtcagaagagggaaggag

SEQ ID NO: 219112 - DNA, 526 bp, Homo sapiens
ctagaattaaaggaatggtagggtttcctgtggtaccatattgaaaatctgtctcatatttctgttccactttagctcccaagctgtccttcattgaagggagtgagattgaattggggataccaggaacctggttttgttttggatgatttttagtaagttatttctattgaagaaacttcttcaataagaaaatacaaactacataagtgcccatgattttctaattaagcaagttctgctgttactgtggggtcactgatgactaacaatctcattcagtctctggggcccacaactattctgatatttcaacaactagaaggaaaacccgtagcctatggacatgtgaatgccaattattctcttgaacatgacccagaaaaacctgcagcacacctgccaactctcacaagcaggtgctagccttgtgtctgtgtccctgtaggacactgatcctttttcttaccatttacagggattctcaaactttcaacatttctgtgtgattgaattgcaatgttac

SEQ ID NO: 219113 - DNA, 343 bp, Homo sapiens
tacctcagaatatgaccttatttagaaatagggtctttacagagataatgaagttaaaacaaggtcattagggtaggctctagacgaataggactggtatccttacaaaaagtggaaatttgcacagagacagacacacacagagggaaggcaatatgaagacggaggaagaagacagtaatgtgactggagtgatgaatctaaaagccacgaaacaccaaggattgctggcaaacacgtaaagctaggagagacaaggaaggattctcctctagagccttcagagaacaagacacttgattgtggatgtctaacaacctcaactatgggcagtaagtttctg

SEQ ID NO: 219114 - DNA, 554 bp, Homo sapiens
acctccaagtttgcatttttttctttgtcggttttggtttctgtctttcatgttagaggctttcctcaagtattttatgattccaggactctggaaagatgtctgttaaaattagggcatactgagctctgatatgctctgcctgtaaatttagagtttggattgtttgaagtttttgatccttttaaaggaattttgcttgtttacgctggagtgttcagatcccttttttcttttccaatccttttgtgaaggcccaggaggtatgcagggtcttcccagggtagaagcaagttgaagtgttgatgtcacatataccattgctgtttatggtgttgggagcacagtttgaattttttcttaatcaggtgcttaaacaaatagcttgtcttatgtaacaagaaatttggaggtaggccgtcactggcgtgggttcacgagatcaacactctcagagtcagcatatgtgcaattgttttggactttcctttgtagttataaggtgatagttgcagttctaaccatcgtgtttgtatttaaggcgcaaaaaaaaa

SEQ ID NO: 219115 - DNA, 686 bp, Homo sapiens
cctggctccaaaaatgctttatgatacttgtcctttgtccatcttagtctctgtgtctaaaattagcaccaacatccttcccaggcatgactgagttggatgaaggttataagggtagaagctctctttctggtcagctcttacagtgcctagaacagaactgcaggaatgcatactttttagaatctttatgaccccaattaagtaaaccctattaaggctcatcttcctatttcccctctctccgtttccctatttgaggaggggtaagtatcagaaagagagaacctgaactgaacaggaggaaacagaagttccacatcaactcactacctgtcagccttggtatcaggggtgcccacctcccacccctgccttgctggcggaaccgagaaactcggaaaaaaacaaacaaaaaaacaactgttgtagcttggagagaattaatagaactaggattccatggatgtgaaagtcttcctcaatatgctaaataaaccaagttagataacagtgcagtttgtaaagacacttttttcccacggtttctatcttccagtttgggcagagggcaggaaaggcacaattcttggaacttgaataaggaacagaaattcctaatttagcctcagaagagacatctctgaaaaatactctaccaggaaaaactgaagtgtaaaatgata

SEQ ID NO: 219116 - DNA, 734 bp, Homo sapiens
agcggtggctcacgcctgtaatctcagcactttgggaggccgaggtgggtggatcatgaggtcaagagatcgagaccatcctggtcaacatggtgaaaccccatctctactaaaaaatacaaaaattagctgggcgtggtggcgcacgcctgtagacccagctacttgggaggctgaggcaggagaatcacttgaacctgggatgtggaggttgcagtgagccaagatcatgccactgcactccagcttcgtgacagagcgagactccatctcaaaaaaaaaaaaaagaatcttacatgagatgaagcagctagtgccactccccatgctctcttgtccaagaatatggcagaagtggacgtgtgtgggatttttttgtatatccattgacacttttccctttaaattatacatttgaccagtagatacctatcttaccttcaagttgaaaacataccaggttactgttatatattctgaaatttgaggtatgaaactgatcataaggtcaagtgtggtgctgactcgtgcctataatcccagcgccttggaaggctgaggtatgaggatctcttgaggccaggagtttaagatcagcctgggcacatagcgccccatctctacagggaatgagcaagttatgcttgcggcgaatttgagctacttggccaatcgcccatagggggcgtatacaataactggccgggtttcaacggtggatggggccctgggtt

SEQ ID NO: 219117 - DNA, 584 bp, Homo sapiens
aatttttttccaaaaaaaattttatcttagtccatttgggtcctgagtttgggacactgcatatatgatcccgaagctctattctagaagtattattccttatccagagtatcccacaagcaagactgctccaagcttatatatatcatattaggcacggagggggacagggacatgtctaaaaggtatgctgtgaccctcacgcaaacattatgatccctaactctggacccctttggtgaagaacatgaagtcgagaaactactcgaactttatcagaaaatactgttgaactctccacagtgtttcccaactccttcctccttataattccttcaacaaataaactctttaatttcctaagcagtttctgtatctggtttttaaaaaatcaatccaaatctacaactggcatttgataacacagtggtcctgtaaggattaactggcatccttataatcttaaatcttttataacatggtatatccctccatttaaattatttaggggagaggtggctggagaaaaaataaattatttaggtctttttttttttgagacaggatctcactttgtcacccag

SEQ ID NO: 219118 - DNA, 394 bp, Homo sapiens
aatcagcttacggttgttgccagcattacacagtcatagaaagctttaccaaaaccgaccaggccaatgtgtatcaggaaatccctttcaatccccaaatctggccggcgtgctcctccagctgggacgttggctaaagaggcagcggaaaagactgtttattatggcggtctattcccagcatggtcggagtggaaaggctcttctgaggttaactagttcatccttccacctcctgacaaagctgccttctgaccaggccagcaaagagcataattctgacaaagctgctggagaaggattcccccactgcagtgctcacccagcccatgttctactcagtcagaccttctgacccaaatggttaagacaaaaaggacaagaaatctgtttt

SEQ ID NO: 219119 - DNA, 415 bp, Homo sapiens
gtcacaaaaaatttagcccagatgaataaatgaagttaagaagcatttgaagaaagaaaggaagtctcccaatttttgctagtttattaagctagtgcttgcattggaaagtagtgaaaaatctgttttgtttttaaaggcaaaactaggcaaaatcgcacttggcttaggttttgatgggatagtcatttggcttttaaaaatgcatcctacagatacaagagcatgcacagactaggaaccggcatgacttgtttcaaagttaaggacacaaatatggttataatatagtcatctccaccctacctccaccaatcaatcatttactcccctgtacctctttttagaaaacaaaacaaaacaaaataaaatgatatctttctttaagacccaacttcgctttccctgctaggca

SEQ ID NO: 219120 - DNA, 541 bp, Homo sapiens
ctatcattatatattacatgactgtactacctcatggggctgctcctggaattaaatgagttaaagcagtaaattgtttagcacactgcctgatacagagcaagatctcaacttagttgtccttgctgttacttataaggttggaaccagcaagcctgagagaagctccttggttttattgtagagatcagaaaaatcaagaaagaggtgaaatagtaatagcatgcttggtaaagtgctttacagtttctgtgatgtattttcacgtgcactgtctcctttaaaggctagaggactggccccatctctcgccacaccatttatgattgtgtgcatatcatactgagaggagatttggaagttatccagggaatgtgatgtgtatagaccccaaacagaaggaacgttggggactttccatcttagctggagaggagcttgggatggaggataggaaggaggtcaccgggggtcactgctgccttactccttgctatccacagaagaattccacaggaggcagaacagtgtgatggggagt

SEQ ID NO: 219121 - DNA, 653 bp, Homo sapiens
  misc_feature (240)..(240): n is a, c, g, or t
aaagtacaaaattgagctgggcattatggcaggcacccgtaatcccagctacctgagaggctgaggcagaagaataaaaggaaaccaggagatggatgttgcagtgagctgagattgcaccactacactccagcctgggcgacaaaccaagaatctgtgtcaaaaccaaaccaaaccaaaaaggagggactcagagagccagagaccagggaaggacaagccactcccgtaccggtgttnccctttgtctgctcccagacagctttctcctgcctcccagctctgcatctctcagatcctggctctgatcccacgctgctgttgcttccactcatgtacccattgctaacggcatcatttcttggagtaattcattgcaaagttcatttcccacgataaacgcagtctgtgctcattacagtcaacagggtggcccaaaagagttcagttaagggaaaaaaaaatcaaattttcccttgaaaagaagccagtgatatggcttgggtccatcttcctgaggtttgaaaacttctctgttagtgttagttgcttttaggcctggtcctgctgcatatacaatgtgtatctttctctctctctttttttttttttttcctttttggagatgagacaaggggaaacaccggggactc

SEQ ID NO: 219122 - DNA, 372 bp, Homo sapiens
agtgtgttgtctcacatctggtcttatcccacgctcgtggtcgatgacagcttatgctccgatgatctcaggggtatcttcttggagtgatctgtaggcattcagtttgcacgtagtacgtcgttctgtgctctcttgagtgggaagggtggcccaaaagagttcagttaagggaaaaaaaaatcaaattttcccttgaaaagaagccagtgatatggcttgggtccatcttcctgaggtttgaaaacttctctgttagtgttagttgcttttaggcctggtcctgctgcatatacaatgtgtatctttctctctctctttttttttttttttcctttttggagatgagacaaggggaaacaccggggactc

SEQ ID NO: 219123 - DNA, 1011 bp, Homo sapiens
gaagatttgttctattcaatattaagttaggcttccttcctgtattcatcaaattgaactggatggaatacgagtccctaatccaacacctccaactggagaaatagtctgctgattctcacagatctcatgtcctgcttagtgtagataattttcatatggattataatgaataatatgaatttaaacaattcactagaagcctaaaacattttgtttgaagctcttctttgtccagctaaaaataacttctggtctacaaggctaccatcataattgagttctacatctccagtcacaagtagaaccaaaattacagtcaacgtacaataattctttatctcttggttccagattttcctcaattatttatatctctctattatggtctcatattcctttctgttacagagtttcagtctatgttgagtcaagcaattttagggctgcttaaactctggttcattagccatggtccactagcatccatgtcatggcactagggtttaatatggttaataggatcctggctggatgaggaagtatattgaaaattaaactttaaattaaacataaaacactaaaaattattagaagcattaaaaaataaatgtttccatatatgggttagaaaatctgactttattttgatcctaggggctgctggctgtagtgaaatgtataaaaaggagagtgtgatcctagtttctgtctctaactatgagttacttgtgattaacttcaaatattctctccataagaagaggcccagaagaagaagatgagcttcagttattctagcacaactgctgtgatatttgtaaatattcaaaacctataataaaatgtataaaaggaaactccatttgaaatgatttgaaatctcacatggaaatctattttttttaaatcagagcttagtaagagaaaataacagaacattgtaataattgaattacaaaaacaactgaattttggaaaatttattttctctcatgtgatgtgtgtgta

SEQ ID NO: 219124 - DNA, 671 bp, Homo sapiens
tctcacctgaggccttcacctgagagctggagcctgtgcgatggattatctggacagggaccccaatgaacagggctctgctggagtgaggaagctgactgagggaagaaccagaaggctgccaaaatacaattgtgtgcctttaaaggaaataacaacaagaattaggagcgccctggaggcaaggtctgctgctggggaaaccaaaccacagtaacttcagaaatatatacttggaatatgtcatgtattaatgggtaaagacaccgtggatatgaaggaaatcacctatgggagaatattaagaagagaagaaggggctgctggctgtagtgaaatgtataaaaaggagagtgtgatcctagtttctgtctctaactatgagttacttgtgattaacttcaaatattctctccataagaagaggcccagaagaagaagatgagcttcagttattctagcacaactgctgtgatatttgtaaatattcaaaacctataataaaatgtataaaaggaaactccatttgaaatgatttgaaatctcacatggaaatctattttttttaaatcagagcttagtaagagaaaataacagaacattgtaataattgaattacaaaaacaactgaattttggaaaatttattttctctcatgtgatgtgtgtgta

SEQ ID NO: 219125 - DNA, 461 bp, Homo sapiens
tctcacctgaggccttcacctgagagctggagcctgtgcgatggattatctggacagggaccccaatgaacagggctctgctggagtgaggaagctgactgagggaagaaccagaaggctgccaaaatacaattgtgtgcctttaaaggaaataacaacaagaattaggagcgccctggaggcaaggtctgctgctggggaaaccaaaccacagtaacttcagaaatatatacttggaatatgtcatgtattaatgggtaaagacaccgtggatatgaaggaaatcacctatgggagaatattaagaagagaagaagatgctctccacaccagtccatggctgccgtggtgtcaatgattcaggactgtttttttaatctcttcaattcctcttccagagacatgaagttaaaaccaggtactatgagtgctcacttaatatttggttcttacgaaggtat

SEQ ID NO: 219126 - DNA, 347 bp, Homo sapiens
agttttgctcttgtcacccaggctggagtatagtggcacgatctcggctcaccgcaacctccaccccccaagttcaagcaactctcctgccttagcctctcgagtagctgggattacaggtgcctgccaccatgcccagctaattttttttgtatttttagtagagacaggatttctccaagttggcgaggctggtcttgaactcctgacctcaggtgatccacctgcctcagcctcccaaagtgctgggattccaggcgtgagccaccacgcccggcctcttttctgtctttctttcctgttttcttacaccctgtctcttccctttttccttctgtctgtctctc

SEQ ID NO: 219127 - DNA, 331 bp, Homo sapiens
ttctcaaatacagtgtttgtcattttccaagctctgaaacgagtgctttttaatttccaagatggtaatctgatcagaagtacttggttcatatgctatctgatttaacttgaccttcctcccccacacccactccccttgagtagtgatccatttttctttccaatccacattattttaaaatcctccctatggccctttaccttctatgccttttagcatctggcacccacatatgttctgtttattctgttgatgtgatgccagccaaccttctaatcagtacatggcttcttactcatttttctcaattttcttttttttttttttt

SEQ ID NO: 219128 - DNA, 433 bp, Homo sapiens
aaactagaaggactgcgattagattaggcaaggtgggaaagggataccggcaagtaaagcgccggaaacttacaacttgggttattttctaactggcgtcttgcaaagggacaccatgtaggtatcccgctcgtcaacttgtaaatgaacttcaggttctctttggtggcaggagaattctgaatgtgagaacctggcggccgttcaacgaccccgccctcggggtccccagggggcgtcctccggcaagcctgattgtctgcggccaaggcgcagggcgagcagggagggaggaggagaaccagggccggtggccccgaaagcacacacaaagcggcctgactcctttggtgggaacttccccggccgccagcggagcgggagcgggagggggcggcggagagggggggcggcggttcccctcgccgaggcg

SEQ ID NO: 219129 - DNA, 1028 bp, Homo sapiens
ggtcattttgagtagtaattttggagttctgttttctctcctttccctcttccatgttcccctctctctatctaataggtgtcctgttgcctctccctgttccctctacctaccacttaggtaagaatcaggtgtaaaaacagtgggtcagactgggcatggtggctcacacctgtaatcttagctctttgggaggccaaggcaggaggattgcttgagcccaggagttggaaaccagcctctcaagatgtagcgagaacccatttctacaaaaaatatcaaaaagaaaaaaaaaaaaaaaggcaggcatggtggtgcacgcctgtagtcccagctacttgggaagctgaggtgggagggatcgcttgagcctaggagtttgaggttgcagtgagccgtgattgcaccactgaactccagcttgggtgacagagtgagactctgtctcaaaaaaaaaaaaaacaaaacacacacacacacaccaaaaacagcgagttagattaaggatatcacacatcaagtcggtcagttgtttcatttcctgggctggaggccttatcacagtcctctccctctcttagttctgtaactttctcaaaatattaaactgtcatcagcaaattttataatctctttgtaggagtcaaggtggcacatcctcattcccagcctcaagcattgaactggttccattttaatggagcacttttcgtttttgttacttcattgaagcctgcatcttggctgtcactgcctgattacagaaccagaattgagtaggcccgtagcttcagccctccttaccattttacatttctgtttagtttctcttccataagtctgtcttgtgttaaatctagataatgtctgtttgtttgtctctctgttttctctattattgcttatacttgggagcagaactgtttcattaaagcctgaatgcactgcactatctggccgttcactggctccttttaagttttgttccatttttaaatatcagatccaataaaagaaaaaaaaataga

SEQ ID NO: 219130 - DNA, 303 bp, Homo sapiens
agatggggtctccctatgttgcccaggctggtctcaaattcctggcctcaagcaatcctcccacttcaccttcccgaagtgttggaattataggcacgagtcactgcatcccgtgccttcaccttttctttacttttccccatttaagaattgttcttccaaacagagaagcctgaggccagccaaaatgtgaacggttctgctttcccaatatgtatccttttgtttgtttgtttgtttgtttgtttttgagacacagtctcactcttgcccaggctggagtgcagtggtacgatctcagct

SEQ ID NO: 219131 - DNA, 388 bp, Homo sapiens
ggaagacactccttcacagggcggaaggagagaatgagtggcaagcgaaggggaaagatggttatacaaccatcagatcttgtgagaattcactcactatcacaagaacagcatgggggttactgccccccatgattcagttacatcccactgagtccctcaataagatttgggtgggacacagccaagccatatacataatgaatgatgatactgttgagccatcatcatttactcagaatttccctgattataaaattaatacttgcttattatagaaagcatgtacataaatataaaaataataaaaatcacctgtattggtccattttcacgctgcttataaagacatacccaagactgggcaatttacaaaagaaagaggttt

SEQ ID NO: 219132 - DNA, 407 bp, Homo sapiens
tcgagctcgctaccgttataggctgcagtgcactccagcctgagtgacaagagagagactccatctcaaaaaaaagaaaaaaaactcaaaaacctagttgtaaaatgtaaatttgaaggcacctgtagtattgtaacatagactgtttctcacaggttaattttggtggaggcataaaagtcattagaatcaaaatgaaggcacttgtgttagaaaaacaaacaaacaaaaagcccccacgaatggagccagtgaacgccgtgaagggagtgttcccacatccatcgaataacaaaaaatatgatagaagacgctgcaaaacccaaaaccttgcacaaagaccagcacaaccttacacaaaaaatacttctgcaaggatgtctgcccagcacctgcctgtccaacct

SEQ ID NO: 219133 - DNA, 491 bp, Homo sapiens
ctctagaatcctgatcttatttagaatctatctggaacctagaataccctgaagaaatacctattaactggctggcttaaaatggatatatattcgtgaggaaaattctggaatacctttgggtataaaatagagagcctgtggatactttgaaagccaggagaaggtgcacaaccaggacctgggaaggcaccgcccacccttccggatcgcctttgggtataaaatagagaaccctcagctttggccagattaggtttagcttaacctccaggggagagaccacagcaccatagtgtctcttgcaatattgcctattaaagcagaggctcctcaacttggaatagggtcccgtcccgataaattcattgtaagatgaagatactataagttgaaagtgcgttttcaatttatgatgggtttatctggatgtaaccccaccaaaaatcaaatagtgaattgaatacatattgcttttgcaccatcgaaaa

SEQ ID NO: 219134 - DNA, 436 bp, Homo sapiens
gcctcgacttcccaaagtactggggttacagatgtgagccaacacacctggctgaaaatatgcttttaattgtcgagttttttcttcttcatttattcatagtctatataaatggcagatagctggtgtagtttattctgagtcctttttataatgaacttggtgttaatggattgagatttgcgctggtccaaggtaaactattgtgtatggtgtaggggcttgacagatggggcattgtggagatccactgatgatcaggttccaaagttctgcattagcattaatgtaattaatataagacaagcaggctcttaatgatcacagagatacttgtctttgacgttaaagtttttatttataggatctatgatttttgtttttgtttttacaattactctttatttgaaacatttttatagatgaatagatgaat

SEQ ID NO: 219135 - DNA, 482 bp, Homo sapiens
catatatttgctaaaattatcttttaaaaaatgcaagaaaataatataaacacaaaattcagcatgtcagagttatgcagcagggtaacgggatggggaggattctatagataggcgcaaacattgctcatgtttaaattcttgggttgggtagttgacttttatcactaacaaagtaataagccagggaatacaacgggtaaatgaaaaaataaaatagagtcatgatgagaccagtgatgatagtatatcataaatcaatataaatcaactcttctcatctttaaaatggaattaataacagtacttagcctcctagggttgttatgaaggttgaaaatcttagaataatgcctggtacatagtaagttttatattagtatttgtgaaagatgaaagagagagagagagaccgagagacagagagagacaggggcgggtggggggcacggtggggggaagaagtaaaagaaggaagaaat

SEQ ID NO: 219136 - DNA, 354 bp, Homo sapiens
tgtggtggctcatgcctgtaatcccagcactttgggaggctgaggcgggtggatcacctgaggtcaggagttcaagaccagcctcaacatggagaaaccccgtctctactaaaaatacaaaattagccaggcgtggtggtgcatgcctgtaatcccagctactcaggaggctgaggcaggagagttgcttgaacctgggaggtggaggctgcggtgagctgagatggcgccattgaactccagcccgggcaacaagagtgaaactccgtctcaaaaatagccaaaatacagaatgaatccaggtattcaacaacagataaatggataaagaaaatgtggcatgtatacacaaca

SEQ ID NO: 219137 - DNA, 463 bp, Homo sapiens
agtgctggctctacttagcacacgcacagtggcactaggacctgcgtgcctggccctcagtgggtagggcggtgctgcctaggcacacagcagcgcttacgggccccaggtgcctactaggctgccttcctcttccccgctgtcagtctgtgtcctccacgtgcttatttcctgtggtgagagcagttgtggtgtttgtataccttgtgccttatgatcaaggtgggccttggaggagggcgggaaaggagcgaccaacatggcggtcctccacccctcagcgacacccaccgcccgagaaactacagacaatggccacaagtttggcgtccttcaatttaattctttaaagaagtgctgggaagaaaaagctatgtggtttctaccattttagcaggataaagaggataactccttccattagcaaattttacagttgttaacagtactctgccatatttga

SEQ ID NO: 219138 - DNA, 406 bp, Homo sapiens
tgattttctggaccaaataatgttccaccgtgtgactggacataccttagtctatccattctaccactgatgagcatgtaagctgttactatttttaactattacaaattatcttgctaacacatttttgtgcatgtcttttggtgaccaaatggactcatttctctcaggtatgtatctcagagtgaaactgttttatcacagtgtatgctttatatttagtgctttccaattcctgattaagaaatctttgcctgctcctaaggatgtaaaattattctcttatggcctggctcagtggctcatgcctgtaatcccagcattttgggaggccaaggtgggaggattgcttgaggccaggagttcaagaccagcctgggcaacatactgagaccctcatctctac

SEQ ID NO: 219139 - DNA, 452 bp, Homo sapiens
aggcagaagttagttaatgaggtataaagacttagagggtccgaaactgagtaaggtttccatgttagcttataccctatgctagttgaacaaaaccagatctcatcccagtgtggaagtgcacatttaggacctcctaaatattgatgtgatatgtgtggtagctcctttttggcactctttgctaattatcagcaaagtttgatgtggggtcaaatttgtattttgtgtgagttgattggccatttgtccttttgcgctcctgcaggcactcatcctcgcttttgtccttttgtgggttattttttttttgtctctatcagaaaatgggtacagagaccttcagcagatacagatggagagactcagcctaattcttctcatctcctaatgccttttagattcttaaggaggtataaaaatttttcccaaataaaaattgataagaagta

SEQ ID NO: 219140 - DNA, 580 bp, Homo sapiens
cagccctttgtgcaggcacacacatgcagagagagaaaactgtcctggtaagatcactgggaaattagagaagagaaaatacaggagaatggggccagatgccaagcccttaggatcccttggcccttaacaatcagcaaagggcttagatacttgtcctcttgattactctgaactacatcttgtaattaccaacttcagtcaagaaacactaaacagtttatccttcagaagctcccttcaaaatcctctttggcctggctcctgccctcatcatgccattaaactgccctctcaaaagccaccagggctctcggtgattgtctcaagtttgcaaaaaaggagaccagcggtagccaaagagaagctatatccttaactaccgctgctcagctggctgggggcaaagctgagggcctcttgtttccttagtctagggattattgctacatagaatttattattattactattattattttaatcaaaaaatgacatattgtgtagatttttggtatacattgtgaaactttgatatatgtatactttgtggaataattaaatcaaactaattaatgta

SEQ ID NO: 219141 - DNA, 314 bp, Homo sapiens
tgagatggtacatccctctgtcgcttgggctggagtcctagagtggagtggctcactgcagcctcaaactcctgggctcaagccatccccccacctcagcctcctgagtagctaggattacaggtgcaagccaccaaatctggcttgaaagcatattttatttgctgttctacaccttgcatttttcacttaattttttgtggaagatgattttattcagtaaatatagggctgcctccttatttagccataaagcattgcattatatgaatgtaccagaattaatttaattggtccctactgaaggacacata

SEQ ID NO: 219142 - DNA, 885 bp, Homo sapiens
agcttgacaacagatgctttcaatttggggtgttgaccctagccctggtgggggccaagagggagggagggaagatgctggcccgtagcttctcccttgggtttgttctctcccgccattgaggctgggagaggtggtggtccctgggaagctgcaccctcaggcgctaccttccttccacttcctacccctggtgtctacacaagcaatggtgaccgtggctctgcatctctctgggacctggtttctgggtgtaggtgttctaggtgtccagaaaattctacatacgaagaatcaacttccttttggaaggcacaaggagtgaactgaaggagaggcattgaggccacccttcttggtgtggacatgaagtagattttccttcaatttccattgtaaattaatttccaagttgagctccacaaagcgagtctctgccaatggggcattcttacaggcgcttccagcaaagtgcaaaactgattcccttctttatccgtcttccccaaactggggaagtctcagaaatgagtgttttatagacaggtggaaagatacgtcctccaattcgtgttcgagagggagaaagactggaggtaaatttcagcattgactgatcttgtgtgatgtggtttcatgaactgaagtgagaagatatggatgaatgtgaacacttagacaacctcaatctgtgaaaaatgttaaggagaggtaccagtagcagcaactacagcaacagcagcagaagctaacacagaagctctgcctgtgagccaggcccatataatagctttacattaaatatccccttagtcccagtaacaatcgtaagacgctggttgtgttattaccttcattacacagataaggaaagtaaggcttaag

SEQ ID NO: 219143 - DNA, 198 bp, Homo sapiens
gtgcttactatctatggtgtgtataatagggttgtcttattaattagtctgatgtttggatctggagaagtaaattaatgagtcaggttttgtataacaaatgatcactttttaagtaattagtgtagcatatgaccgtagagattaatattaactcttaaaatatggaaattgagactccgatggaaaatgtgaaag

SEQ ID NO: 219144 - DNA, 705 bp, Homo sapiens
atgttgaacaatgtttgagctacaactaaaggtcttcccacattctgtacattcacagggtttcataccagtatgaattctttgatgtgcagtcaggaccaaactaaatctgaaagttttcccacactccttacattcatagagtttctcaccagtatgaatactctgatgttgaacaaggtttgagccactattgaaggccttcccacatttctcaaattcaaatggcttctcgccagtatgaatgacctgaagtccagcaagctgtgtcagaaaactgaaggcctttccacattctttacattcaaagggttttttaccagtgtgaatttggtaatgttaaataagtggtaatgatatctaaaggtcgtcctccactccttgcatacaaagagtttctcactggaatgaattttctgatgctgaataacgtttgaaccacaaatgaagcctttcccacaccccttacattcacatggttttacaccagcacgaatactctgatgttgaacatggtttgagacacgattaaaggactttccacattccttacattcaagatgccttctcacctgtgtgaatgttcttatggcgattaagctgggtgggaagactaaaaacctttccacattccttacattcaaagggtttctcaccagtatgcaatttctgatgtcgaataagttgcatatgaagtcgaaaggc

SEQ ID NO: 219145 - DNA, 906 bp, Homo sapiens
cagtggttgcctttgtattaagaatataaaaggattccctgcctttttacatttttctctgctttccaaaatttccacatgaatattatacctagtaatcagaaaaaaatacagggacactcactcttatcctttacatttctctcctgtttggacctcagattcctcagtagaaaattaaactagatgccagcctgggcaatatgatgtcactctgtctttacaaaaaatgcacaaattagccaggtgtggtgttgtgcacctatagtcccagctgcttgggaggctgaggttggaggattgcttgagcccaagaaatcaaggctgcagtgagctgtgatctcgccactgcactccagcctgggtaacaaagcaagaccctgtctcaaaaaaaaaaaagaaaaaaaaagaaaaaaagaaaattaaactagacaaattcttaagcctgtctctctttttttttaatagtcttatatgaagactattacttcatttcctgtgttttgtgttaagatgagctttaaagcaactctgaaaaagaagagggtgcctataagtaattcatagactgtttaaacaatagtagaggatctaagcatagatcccaagaggtaaagggaatctttatcactttgggaacttttactgataaatagaaattactgtcagtacagtccacaaatatgttgtttatcagccatctttcctccctgtcttcctctagcactgtagcctgtgttccccagaaaatatagtcaataaaattcaacattctttactagcttactctaatttgtggttggccataaagtattcctggtagagataatagagataatatttaactggccatgagaaaggaaacactatcgtatatgatacacccctttttctactcattccaac

SEQ ID NO: 219146 - DNA, 105 bp, Homo sapiens
ttaattgttctgtgttcctgttcctaaaataactatgcagtaaggatcacttcagtggatgaaaaaaagggctgtcaaaggggaaagggcttcaggttgtgtata

SEQ ID NO: 219147 - DNA, 211 bp, Homo sapiens
gtgactcaatactgcaaggtcttgatgtatgatgccaaagtatatcccaccaggtgaaggaggctttctgtgacctgcctattgatgatcccaccttacgtgacctggaatctggaaactggatctttttttttttttttttgatacagtctcgctgtgtcacccaggctggagtgcggtggcacaatctcggcacactgcaacctctacc

SEQ ID NO: 219148 - DNA, 394 bp, Homo sapiens
cagccctgggtccattccaggagctggctgtggttgagtgcagttctgatcacttgcttgaggggtgcagtgggggtaaagagagaggaaaaaaaagaaaaatcaaattgttctcggaaatcatgtttaatgtagaaatctggttaatattaaaatgcaatctgcagttttcaagtattctattcctcaaggaaaatatttcctgttcaaggggcaggggcagtaagctctcccttattacatcacttcctatgtcaggccaaactagcattcaaaatgtattaccgtattgataatgctaatttcaaaatgatgcctttttccccccctttggttaaagggtctgggcaaaattccaatcatatggatcaatttagccttagatggcgctgcc

SEQ ID NO: 219149 - DNA, 1771 bp, Homo sapiens
acctcctgtacctcttagcttgtttaattttttttacagcatttatcagtttccagttgtacccctacaataatgtacgttccaagtgcctgaaatagtgcctagcacataatgtgtgaaacacacacacacacacacacatacccataacccactgaatgaatgaagagaaaccgaaaaaataaaagtataatatcccatccctgatcactctccagaaatgtatacttccaaggaacttgcatatttctataggtagaataattgatgatgataataacagtaatagctatatttgaatgtccattatttacactaatattcacagcaactctgcaaagtagttattatgaagagactgaggtgcagagaagaaagttcacataactgctaggtgctgaagctgagatttgtaactattggatatctgaatccaggggtcatgctcttcccattaactgcattgttatattatttcacaaatgtaacaaatatcaaaagaaaatcttggcattttcattttaagaggaattaggaaggaaaacaaataggtatataaaggtcagcctaagttgtcagcaattcttttccttaatctgtaagaatcttgctcatcgatcagggtgctgttaatcacactaggtcccaatctcttaataagggagttgggaggggtgtttcatcctaggacaggagtcatcagactcggttagagtaatgaaaaggattataatactaatttctgaagagaatgtgggactgaagctaaaaatactcactataaagtaactcttttggctatagtctattatatcacaaaaatattataaaaatcctcaggttcctttctatcttccacacctaattttcaaaaccgatcaatttttttaagccacttaacctgtgtgtaattactactgtggtctcctagcacagacaacagctgctgactgctgtggtattggcacggatcatgtagtctatagagaatttgataaaaagactccaaacaatttcatgccctgtgctgttacagaggagaacaaaatgctttcagcaaggatttgaaaactcttccgtccctgcaggaaaggattgatgctgatagaagagcctggacagatgtaatgagaactaaagaaaacagatggctggagatgacatttatccagggtcactttgtcaggccctaggacttaaatcgaagttgaactttttttttttaaccaaatagataggggaagggaggagggagagggaggacagggagagaaaataccatgcataaattgtttactgaatttttatatctgagtgttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaaaaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagttcctataatttattttactggcaaatgtcatgcaacaataataaattattgtaaactttg

SEQ ID NO: 219150 - DNA, 513 bp, Homo sapiens
cattaggccaggccagaaggaccagggactacaaactcaccttcagggctcctaagctgctgcggagctagacggcgggctgtgggtggggaggagactagaatattctgagacggggtcaggtgggagttgggagaggtaacttggagttgctgcccaagatgcagctcagctccagtggccacaccaagacggtttaagaccgagagcggaaccagggaggttgtttttggtggctgggggcttgggtttgagttccttgaacagcagaaggtgcttggatttagggaggctctaattgcctggacgaagaaccccgagctgtctggccggcctttcacagtatccgaccggggcgtcctggaccgccgccagctctatctgaccacctcggcgcgggactttcggttctatcccaagacggagctgtccggatacccccgcaaggactccctgacctactggagcttcgaagagacgccccaggtctggagccacggcccgcagcggccg

SEQ ID NO: 219151 - DNA, 726 bp, Homo sapiens
cattaggccaggccagaaggaccagggactacaaactcaccttcagggctcctaagctgctgcggagctagacggcgggctgtgggtggggaggagactagaatattctgagacggggtcaggtgggagttgggagaggtaacttggagttgctgcccaagatgcagctcagctccagtggccacaccaagacggtttaagaccgagagcggaaccagggaggttgtttttggtggctgggggcttgggtttgagttccttgaacagcagaaggtgcttggatttagggaggtgaggctgggaagggttcgggtatgagaaaggaagctgaagttccctggcgtgggtggcaggaagggctctaaccctggggcggggtgtgagggccgtggccgtcatggctgtcgaggccgaaggagagggattctgaactcgggacccagggcttgggatggggtatgaaatctatgtcttgggtatgcctcctcccccaatcttgctcaggctctaattgcctggacgaagaaccccgagctgtctggccggcctttcacagtatccgaccggggcgtcctggaccgccgccagctctatctgaccacctcggcgcgggactttcggttctatcccaagacggagctgtccggatacccccgcaaggactccctgacctactggagcttcgaagagacgccccaggtctggagccacggcccgcagcggccg

SEQ ID NO: 219152 - DNA, 461 bp, Homo sapiens
cattaggccaggccagaaggaccagggactacaaactcaccttcagggctcctaagctgctgcggagctagacggcgggctgtgggtggggaggagactagaatattctgagacggggtcaggtgggagttgggagaggtaacttggagttgctgcccaagatgcagctcagctccagtggccacaccaagacggtttaagaccgagagcggaaccagggaggttgtttttggtggctgggggcttgggtttgagttccttgaacagcagaaggtgcttggatttagggagtatccgaccggggcgtcctggaccgccgccagctctatctgaccacctcggcgcgggactttcggttctatcccaagacggagctgtccggatacccccgcaaggactccctgacctactggagcttcgaagagacgccccaggtctggagccacggcccgcagcggccg

SEQ ID NO: 219153 - DNA, 276 bp, Homo sapiens
ctatcaaagggataataaactgacagcagacttctcaccaactgcaataaaaatggaatcatatcactaaggcattcggggaatggggggaaatgtcatacccaactaaactacaattcaagaatgagtgaaataaagatagtctttttgatatattttaaaatatttatttatttatttgttgagacaaggtctcactctgtcgcccaggttggggtacagtggtgcgatcatggctcactgcagcctcgatctcatgggctcaagggatcctcc

SEQ ID NO: 219154 - DNA, 462 bp, Homo sapiens
atataaatacagctaaaaacaagaatagatattcattctcacaaagggagacagcaaagaaaatggaaagtgcactggtgctagcgttagacagcttgtgttaatgtctcaattctgctactaactggttgcagcttgtgtgaccttgggcacattgtatgatctcgcagaatatcatcccaaatctgcaaaatggaattggcatcatctcttttgcaagattgttatgagaattaaaaggttcttcattcaatataataataaatattttgtatataaatgaatatcaattaaaagttatgactaattccacaagtcaaacatataaattttatttcttgattcatgatatgtgatagtattcataaaaatgtacatgcatgataatttcaaggaataagtatatatgtgagaatcatggaaatgaaattaataatattaactagtaattaaattgtaatt

SEQ ID NO: 219155 - DNA, 674 bp, Homo sapiens
ggtgcagtggctcaggcctgtagtcccagcactttgggaggccgaggcaggtggatcacctgaggtcaggaggtcaagaccagcctggccaacatggtgaaactccatctctacaaaatacaaaacattagcagggtgtggtggcggatgcctgtaacccgagctacttgagaggctgaggcaggaaaatcgcttgaacctgggaggcagagattgtagtgagaggagatcacactactgcactccagcctgggcaacaagagcaaaactctgtctcaaaaaaacagtctgtcattagaattaaatttttctgttgagtaaccacagacatactttcactgctggaggaatgtcatctaaaaagattagttcaaggtattactgacttcaggatacttaaattcttcaactgaaaaccgttttttaaatgagaagaacttcaattttctgcaatttgacaatgttgttaattaagtagcatccgctaccaggaccaccactcacaccagttacagtatgaacattttaactgacagcaacttattagaagataaagatcatggcattatggaaagaaaatggtctgtagtttgtaaacaatcaagttaggttctaatttcagttctgccacaaactaggtatataactttgataaacctgttaccttttctgaa

SEQ ID NO: 219156 - DNA, 447 bp, Homo sapiens
tgaatttgcaccggccttggtaatgtaagaaatgttgatacaagtatgctatcgtagagaatgcagagaagttatctgctttgtccccaaatggagatttttttaatagtctagctcgttgtctaatgtgtatttgcctcctttagtgtttaaccagttttttttttcatccagtgaatccaggtaatttgacttttcactgataaaatatttacttgttatattaggcagggtgctaaacttggaaactaaaagtacagagttaaatttaaaatttgttgaaaagtatgcatcactatgtattctatttaatgttttggcagtgcctctggctcttctcatttaacatgctaggagacagactggcagcagttgtaagctgaaacctggttgtatgcagagagactgataggggtacaaaataaaatggagaaaatttgaaagtgt

SEQ ID NO: 219157 - DNA, 394 bp, Homo sapiens
caaataacttcaataaattctcagtttcacaccattaccattaatatgagaatttatttgccatttgaacttcagaactggcatcaaactacagtggataccaattttaatgctttggagctttgagtgcatggcagaaatgagcattagaagataataaatcaatacagaatggcttgtaatataatttcccaaaccgcttattaagatctcctttataaaaaggacataatttctatatacccataaatgatgctatggtcattattctagtttgcctttcttgcctgtaaagtaatacacttatttgttcatgagatgacagcaaaatctttattactgtaaggttttactgaaaaaatgcacattaaaataaaccagaaacactgaagta

SEQ ID NO: 219158 - DNA, 445 bp, Homo sapiens
catttaatataagaggaggaacaaaaaatgtcctggggatggagtcagatgaactgataaacactgtgctaatggataaatcctagcacagtgtttaccattgagtgcactcattgaagtatatggtatccccagtgcctggaatgtacccaacacatatttgatactggctgggttgaatgaatgtgctaaggaaaaggggaaaaagtgtttagaaaatttgtaaaagaaccaagttagtgaagtatctagtaaatgatacaaatacatagagggtagcaatttaatgatgtagttaagagcaaaatcattaaagtcggaagcttctaggttcaaatcctaactgtatttaccaacagtgaccttagaagaggtatttaacttctctaagtattacttacttctgtaaatattgggaaaataaacacagtattgttgtgagcat

SEQ ID NO: 219159 - DNA, 228 bp, Homo sapiens
gagggccagtcttgggggtctcacgctcatcacagccttcggaatgttttagctaatatgtggtgtgaacttcacagaaattacctgaattaatatgaaacaataaatgagcctatttatttatttactttgagaaggagtcttgctctgtcacccaagctggagtgcagtgagccgagatcatgccactgcactccagcttgggcgacagagggagactccttctca

SEQ ID NO: 219160 - DNA, 565 bp, Homo sapiens
tatttaatcacatctgcaaggaccctctgaatgctgtcttgcctcaactcattttacagataagaaaatcaaggctcagagaggtgaagtcactgatccaaagtcacacagcaggtcaaaaggagatcatgtttcctgcctggaggagaggccccggtggactggaataggagaaagtggagggggtgtatttcaggatagaatcctgcaccctgccagggaccacgcttatccttggctcactcaataggatgcaagggcgtttactgtggccaggtcttgtgagtgcccagagccctgtggcaagaagcctctgccagggaaagggatgcggggaagtggaggcagtgatggggaagcagagccaggagagacccttgggcttccttccttcaaggcctctggtctctagcagagagaagagagggagcagtgctctcttgcccttctgccttccaccatgggatgatacagcatgaagacccccaccagatgctggtgccatactcttggacttcccagtcttcagaagcatgagccaaataaatttctattgtttacaaaa

SEQ ID NO: 219161 - DNA, 920 bp, Homo sapiens
  misc_feature (244)..(244): n is a, c, g, or t
  misc_feature (455)..(455): n is a, c, g, or t
  misc_feature (913)..(913): n is a, c, g, or t
gataaaagggcatgttgaaaagttcttgtgcagaagaaagagtgggaaagtcatagcatttacgatgttccgatttttagagttccctggtaaaatgggaagattttttaacaacactctttcatctataaaactaatctcacttctctcctatacctataactttcttctcttctctctgccgattggcagagtcaagctcagagtctcgagtctcaatcacattcggcggcatctcggctcnacatttttgtagcacaggcttcacggacgtcacgtcattattggctcacgtttcctcactatctgcttcatccgccacgtaatatttcactttacatccaaacatcactttggcttcgaagccgccgcctgatactggcattttgtagatgtggtttgactatttctgtatgtctccatctattgatgagggtcttaaaaaaaaaaaaaanaactcgtgccgaattcggcacgatggaataggagaaagtggagggggtgtatttcaggatagaatcctgcaccctgccagggaccacgcttatccttggctcactcaataggatgcaagggcgtttactgtggccaggtcttgtgagtgcccagagccctgtggcaagaagcctctgctcccaagctcaagcaccgctcccatctcagcctcccaagttgcttggactacaggtgcacgctatcacgcccagctaatttttgtattttttgtagagatgggtttttgccatgttgttcaggctgctcttgaactcctgagttaagtgatctgccttgcctaccttggcctcccaaagtgctgggattacaggcatgagccactgcgtgcagccgagccaaacctcattctagattccatctccagcctgggtgacagggcaagactccctctcaaaanaaaaaaa

SEQ ID NO: 219162 - DNA, 859 bp, Homo sapiens
  misc_feature (244)..(244): n is a, c, g, or t
  misc_feature (455)..(455): n is a, c, g, or t
  misc_feature (852)..(852): n is a, c, g, or t
gataaaagggcatgttgaaaagttcttgtgcagaagaaagagtgggaaagtcatagcatttacgatgttccgatttttagagttccctggtaaaatgggaagattttttaacaacactctttcatctataaaactaatctcacttctctcctatacctataactttcttctcttctctctgccgattggcagagtcaagctcagagtctcgagtctcaatcacattcggcggcatctcggctcnacatttttgtagcacaggcttcacggacgtcacgtcattattggctcacgtttcctcactatctgcttcatccgccacgtaatatttcactttacatccaaacatcactttggcttcgaagccgccgcctgatactggcattttgtagatgtggtttgactatttctgtatgtctccatctattgatgagggtcttaaaaaaaaaaaaaanaactcgtgccgaattcggcacgatggaataggagaaagtggagggggtgtatttcaggatagaatcctgcaccctgccagggaccacgcttatccttggctcactcaataggatgcaagggcgtttactgtggccaggtcttgtgagtgcccagagccctgtggcaagaagcctctggctatcacgcccagctaatttttgtattttttgtagagatgggtttttgccatgttgttcaggctgctcttgaactcctgagttaagtgatctgccttgcctaccttggcctcccaaagtgctgggattacaggcatgagccactgcgtgcagccgagccaaacctcattctagattccatctccagcctgggtgacagggcaagactccctctcaaaanaaaaaaa

SEQ ID NO: 219163 - DNA, 552 bp, Homo sapiens
ttgagatctcattgaaaatattttcctagttagaaatttatgatgtattcatatttgtcttaaagtgcttaaatattacctacagttgtaaattccatttattctttagcacagtagatgctactgatccctttacttcattatcagaacagagcacaggagagaagaattacaactctctgacttagtaggcaccattagactgcttaatagccagagattctgatacataattttaaaggcttaatgtcaatgttattcaaccaaatatattttacaagttattttctttgaacatgtatacattttagttgtagaagtcagttgtctcttaaacgaagtatcttcacaggaaaaatcatcattttgtgaactctgaaatgaatgaaaattttaaatacaatatcagggtagcctgtaaatgatactagaaataaactgacccaaacacacttaaccagcctgttttccacttagttgtttccgtacttgtttttctcttttaaaacttggcaaattgcattttgaatcttcataatttatggtagctta

SEQ ID NO: 219164 - DNA, 593 bp, Homo sapiens
gctgctgatccatatgttgactgccagtcattaaatatattttcaatagcatcacagatgacaattttttacttcaaaatgtctctctggaaatatccattaccactgaatgcataacaatacaagtaacaccagctatcacttattgaacatataatatctgccacagataatataagacattttgcatttactacatcacttactctgtataacagcataacaacttttcaagttttgcattcatttattttatagacgaggagactgagccttaacataggttaggtaacttagagatagaactgggattccaaataggatcagcctagcttcaaattctgtgctctttaatctgtgggaaatctggtatttggatggtcatctcacaagtaaatgaactaaaaataatttcacacaaaggctttggggggtttgtctccgttttttaatctcaagaaaagtgctacaataattgatgcataaagtacattaaaaatatgttcattaaaatacagtatgcatttcaaaaataaatgagtatgtggattaatttcatgaatattcttctctcagaatgctctaagtcaagt

SEQ ID NO: 219165 - DNA, 512 bp, Homo sapiens
aagtcagatataatcccatgacctagaaaaagtatatcaaaaaccaatttcctttagggtttatatgtatttgtttccaaaatattaactaagaatatggatacttacatataaaataaataatacggtcatttaaaattttaaccaattagagcttgccaatttctacagaaagtgtgacaactacatatattgcatatcatagaggctaaggttttgtgagagaagaaattataaaaactaaaaaagttttattaggcacaaaattagtatcataatgataaagtattttttcttctgtaaagtgttgaatagtatatatttttaagcaacattcaaaattacagagaagtctatgcattgctgacagacatatatgtatatatgtttgcttaaatctatatgtatatatagattataacatcaacaatgagattaaattctgaaatctcaactttactaaaattttagtatttatatttttttctaaatcttcttagaattcctcttca

SEQ ID NO: 219166 - DNA, 176 bp, Homo sapiens
cactgggattataggcatgcgcaaccatgcccggccttgctttgccttgtttcagctttcacactaaacaactgtaaggtcctttacgggttttttttttttcactgccatgtttcttgcagttttgtgctttttgtcggtaatttcactgcttaacatggcccacagagtgctga

SEQ ID NO: 219167 - DNA, 570 bp, Homo sapiens
ctttcatgtgctgctttttaatatgggtaataattctagcatgacgtagaagtatttatagcaatgtttttcaaaactgtgactttgtagtatagtcagaactaatatttttagacaactttaccaagtctcttcaaatagtcttggctttcgtctgctaaccacttggtagaggggatgtaggtcaatgattgtcaccaaaaagcaaggcagaaaagataaaatatattcactgaccaagaatatagtctcatctatttagttgccagcagtttacaatcaaacatgctactttcccaatatggtccttgggaaaatcttaacagagacaaggattctatagttagacctaaatagcttggtgttttaatttaagggtcttattttgaaaaactgaataagaaatgtaacagccctgcctgttctggttgtatctggttgtgatgtgattggttgacagtattgcatcagttttctcatcaaatgctgctggtgcagaatgttactggtatcttcttagataagtagaaaataagcaattaagtcaataaaatcttgctatgatataat

SEQ ID NO: 219168 - DNA, 996 bp, Homo sapiens
agagtctggacccctcctcctcctcctgccccagcacagcagggaacccggcaggacagctgtcctctaggactcttgagttcactcacttcagccaccaagcgctgactgtgtttccaccaaagggcagttcctgcggcttctactccccctctccaaggtgccagggttactgccttgtcctccagccttccatggcatcactgtctctccagatcatctcattcaattctctcattgctccagtgagcctggatggttttctgttgccgacaacaaaaaaccccaactgataccattccccttccccaaggtcacttacccagggcaaggtccagcctgagatttgagttcctactgagtcccctacaggggcacagctatgagctgaattgtgcctctctccaggttcattcctaacccctgagacctcagaatgggacagtatttggacacacggtctttcttgagctaatacaggttaaatagtttactgaggggatcctcatccaatacaactggtgtccttataagaggaaattgggacacacattagtgtgcagtgggaagtccatgtgaggacggacaaagaagcttggccatccacaagcccaggagagagactcagaacaaatcaatctgcggacaccttgatcttgggcttctagcctccagaactgtgagaaaatacatttctgttgggtaagcggcccagcctgtggtcctttgtcacggcagccctggcagacgaatgcaggccgcacttcccaccgccatggtgccactgtctgtggacagcatgccagcctcatcgcacgagttatccctgaagatgctcaaattagcaggctgttcttagaaccaaatttcctggacaggcttcagaaaacattctccctggtgatacagacatctgaaaacacacacacacacacacacacccaagaaaacaaaaaacaaacaaaaatgccaaaaacaaataaaaaacccatgacc

SEQ ID NO: 219169 - DNA, 171 bp, Homo sapiens
gagtgcagggtctctttttggggtgatgaaatgtcccaggattagatagaggtggtggatgtgcaacattgtgatgaattgtgttctttacaatggcgaattttatgtcatgtgaaatttactgtgataaataaaaaggaaatatgaaattattccattttcaaaaggcta

SEQ ID NO: 219170 - DNA, 414 bp, Homo sapiens
ggcttctgaaggattgatgatccccaaactggattatgtgttcatgataatggtgtatttggtggcctagcatagtgaggtgaggtaggtctttaaaatggctcattataaacatcattgttcctgagctcacttgcccttgcatctcctgccagagtgctttgtacatagtaggccctcatcaatgcttgtagattttaaattcggaggcacacttggaagacaatggtggctggtaaattaattatcagggttagcaacttcatttctgcttacgcttaaaaagtgctgcgtgaggaggctgagacaggagaattgcttgaaccagggaggcagaggttgcagtgagctgagattgtgccactgtgttctaccctgggcgacagagcgagaatccgtctcaaaaaaaaaaaa

SEQ ID NO: 219171 - DNA, 409 bp, Homo sapiens
aaagctgtgatatcatgtgaaggtttgtctggagctggatgatccctctcaatttggttcgctcacatgtctggcaaattactgttagtttcattcaggaggcctccgttgccacatcagcttctctacagagctgcctgcatatcctcacgacatgggagctagcttcccctacagcaataatccaagagaaaaaaaaaacccacaaattcttttttaacctagtgtgtccaaggtcatgccccaccatctccacaatatcctagtggtcacacaggtcagctctattcagtgtgggaggtgaatacacacaggcacgaataccaggaggcaagaatctctgggagccatcttgcaggctggctatcacatttattaaaagtatttcttaaagtatcttcacctgacc

SEQ ID NO: 219172 - DNA, 294 bp, Homo sapiens
ggactaaccccagcactgctcaggggcagggagcccttaggacctaaatgtgggggggttggtgagtttgctctcatcttctctgagcacaggttgcctggctgcagatagatggtgcaaaacacaccagcgagccagtgtgcttgtctaacggtctgctcgtgtaacttttgcaccacaaaacaagaggtcaagtatgaaagggtggttaacaaattgagcagcccttttttttttctgttaaaggggccgtgtcagaaaaaacaaacaaaaaacaaaaacaaaacaaaaaac

SEQ ID NO: 219173 - DNA, 414 bp, Homo sapiens
ctcctcagttaagtgagagggaactccacctgttgtaaaactattcttagtagtctggattgtgttttttcattttaatagccatataaaattattcagatgattcagaataagcaggatctattttaaggtcccacatgataggttcttacttcagatcaaggaggtgaaaggttttaaagttgggaatttgggataaattctgtattggtggtgtgtaagtttttcttcaccattgttttaattacttacaaaggtaaaacttcaccgtctcctaatgccaaagcctactggggatgggtatttcacttgagattacttcccaatttttattctgtcttccagaggattaaagatggaactctaataccagttatgacaagattcttagtagagagttctccacaaccaggt

SEQ ID NO: 219174 - DNA, 614 bp, Homo sapiens
tgctaaaatctcacctcaaagtcaacaaggatggatgttacatatgtttacctactgcacatgctcttgactcctctcatacatacgtatcgctttgcccccaaactcctaaatatatgtgactctagtgtgatacaggccctgtgaggcataaaacccaatgtgtcccttcatcttcagcacacaccagagaaggtctcttcccagtctgtaaaatgttactgcctataaacctctcctttctattaatcagccatcctggtggttctttagatgaaaactgcaatccaaaaggtctctgaaatttccagaagaaaaaatgctaggcttaaggagactgtgtatttagaaccgatggattttgtcaaattgcttttgaaagagaatgcaataacattcccacattctgacaactgtcacgctgaggggttttgtcttacatagaaagggactttcatacttctttttaaaaagtatttctctcccataattcctttgagtaatttaatagtttaattattaatcttacaaataaacttttggaatgggaaatagatggcacccaatctcaaagaatattccagtagagagtacacttagcacctattagccct

SEQ ID NO: 219175 - DNA, 498 bp, Homo sapiens
aggaaaactgaaaaagacagaaatccagaatatcgaatttgaaccaaaagaaaaagttcaatgccctcctacacgtgtgatgatactgacagctgtgaaagaaatgaatggaaaaaaaggagtgtccatcctttccatctataagtatgtcagttctatatatagatacgatgttcaacggaacaggagtcttttgaaacggatgctgaaatgtttaatttttgaaggtctcgtgaaacagatcaaaggccatggtttttctgggacttttacattgggaaagaattacaaggaagaggatatatgtgataaaacaaaaaagcaggcagtagggagtccaaggaaaattcagaaagaaactagaaaatcagggaacaaggacacagattctgaatacttgccatcagacacctctgatgatgatgatgatccttactattattattataagtccaggagaaatcgcagtaaattgaggaaaaagcttgttccatccac

SEQ ID NO: 219176 - DNA, 255 bp, Homo sapiens
ataaacaaggtcaatagacttctagctagattagcaaggaaaaaaagagaagttccatgtaaacaaaaatcaataacaacacaggagatggaaatcaaaagatcctcagggatcattatgaagacccctatgcacacaaactagaaaatctggaggaaatgggtaaattcctggaaacacacaacttcccaagattgaatcaggaagaaattaaaaacctaaacagcaatatcaagttctgaaactgaaacagaa

SEQ ID NO: 219177 - DNA, 447 bp, Homo sapiens
aaaggtcagggctgttttgtgcactaatgttctagagaaatttcaagctcagagttaactcgtacagtgcagggaggggccttgtcagtaattatctgatcaataaattaaaagattgcattatgggccaggcgtggttgctcatgcctgtaatcccagcactttaggaggctgaggtgggaggatcacttgagctcagaagtttaagaccagcctgggcaacatggcgaaaccctgtctctactataaacacacacacacatacacacatacacacacgcacacacacacacacaattaaaaaattagctaggtatggtggtatgcgcctgtggtcccagctacttgggaggctgaggcagaaggattgcttgaacccagggaagttgagggtgcagtaagctgtgaccatgccactgcactccagcctgagtgacagagcaagac

SEQ ID NO: 219178 - DNA, 141 bp, Homo sapiens
cggcctctaaaatatatttctgtctctccacctatatgatcatgtcctaattcagatcacccactctgttggattactgcagtggtctcctaactagtcctttgacttccattcttctacccctttaatccgttcttcgta

SEQ ID NO: 219179 - DNA, 265 bp, Homo sapiens
aatcatggcccactgtagctttgaactccttggttcaaagtattcaaggtatgatcgaattaaacttcttccctcaaatcttcccaattccccaagtcagaatttattcattcattcatcaaatactgaacaagcacctattatgtgctaggtactctactaggttgtctgagctacgttgtagttctgataacattatagaacttctcatcccttcctatagtcattaatatttgcatatgcaatttcttccttccttaactgt

SEQ ID NO: 219180 - DNA, 257 bp, Homo sapiens
tagcctgggcaacagagcgagaccttgtttcaaaaaaaaaaaagaagagggtctcactttacacttgcgtgagccaccgtacccagtcccaacagttttttaaaacccagaactataatgcaataatgttagcatttgttttgggagtttgagcctaaatggttgaagtgcagtaaattgttcttaaaatacgttttatgaaagtatttggagtcatcttccttacatttttttctctaggatgaagacaacaccta

SEQ ID NO: 219181 - DNA, 552 bp, Homo sapiens
tcatcttgggcctgtgttatcttatcttgggcctgtgttatcttttttctttttgaaaaaaaaaagagattttgcatattttataatgagcttcattaagcaagtctctagttaccctgttttcacaatcagagtaaatgcctttaccttagcaagcagtactcaccataaataatggctcaaaacaacgatgtttgctatttttttaatcaaaaagaaaaaagataacatgggtatatgataattactattcttctcaaatggagtttttctagcttaaagcttgatatgtgggaattatgctttcaaggtttacactaatgtggtacagaggacatcctgttcttctaaatgtgcctctgcagttcttttagaagttacagcggcttcccagtctagacaatctatgcacagaggttttgataatagcatagtggagtcagactgcctgaatttcaatctcagcttcaccagagattaactgcatgacctcaagcaagttgttttacctttgtgtggctcagtttcctcatctacaaaatgataacaata

SEQ ID NO: 219182 - DNA, 764 bp, Homo sapiens
ctgtgacatctagagtggatatccatccagtattgatacattgcaggaagaaattcttttgcatatggagccaggagtttaattaccataaacttagttctgttgttgggaagctccattatagagttatcaagaattggcagcctatttcaacttgcaaagttgttttactctcagcagtactttttcatgtacttcttgaactatatagtgccctctggagatgtgaattgatcgatggtgtgttgaactgattttcagaggaggaaaaaaaaaagagattttgcatattttataatgagcttcattaagcaagtctctagttaccctgttttcacaatcagagtaaatgcctttaccttagcaagcagtactcaccataaataatggctcaaaacaacgatgtttgctatttttttaatcaaaaagaaaaaagataacatgggtatatgataattactattcttctcaaatggagtttttctagcttaaagcttgatatgtgggaattatgctttcaaggtttacactaatgtggtacagaggacatcctgttcttctaaatgtgcctctgcagttcttttagaagttacagcggcttcccagtctagacaatctatgcacagaggttttgataatagcatagtggagtcagactgcctgaatttcaatctcagcttcaccagagattaactgcatgacctcaagcaagttgttttacctttgtgtggctcagtttcctcatctacaaaatgataacaata

SEQ ID NO: 219183 - DNA, 417 bp, Homo sapiens
tatagtggatctcttactctacatcagagaattcatactggagaaagaccctatgaatgtaaagattgcaggaaatctttcaggcagcgtgcacatcttgctcatcatgagagaattcatactatggagtcattcttgactctttcctctccctcaccctccacatcaaatcagttgccaagacctgtaggtttcatctcctgaatatttctggaatccacctcttgaatccatttccatcccatcatccttgtccaatgcacattaatatatttgacatgggatactcgagtagctttctaattggtctccttgtactcaccattgtctctgtcagatgtccacattgcaaccaaatttgtatttttaaaaatatgtttaatctcatttctccctcattaaaatccctcagtggca

SEQ ID NO: 219184 - DNA, 694 bp, Homo sapiens
aaacactatattgtttatggccgggcacggtggctcatgcctgtaatcccagcactttgggaagccaaggcaggcagatcacctgaggtcgggagttcgagaccagccagaccaacatgcagaaaccccgtctctactaaaaatacaaaaaattagctgggcatggtggtgcatgcctgtaatcccagctactcgggaggctgaggccggagaattgcttgaacccgggagacagaggttgcagtgagccgagatcgtgcgattgcaccccagcctgggcgacaagagcaaaactctgtctcaaaaaacaaaagaaaagaaaaagaaaacagtatattgtttagagatatgaacgtatatgggagaaatcataaaagcgaggaaaagatgaacacaaaatcgggatactggctaccatctctgagggccagggagagaaggaaattggggttgggcccacaggtgcttctgaggtttgatcagcttctggttgttagggtgggcggcagatacgacaggtggtcactttagtctttaaaatgtgcgtatacaagtgtgttatcggcttgggatgccggcggggttaaacaactggtaaatcccaggaacttttggggaaggggccggcggggtcaggaatcactttggagggtccggcaagttttggaaccccccgggcccaggcccacttggg

SEQ ID NO: 219185 - DNA, 542 bp, Homo sapiens
ctgacccatgctgcctggttcagcctcactcactcagggccagtccacacgtagaagcagggaaccaggatgctagcctagggagaggtggggtgagcaaatccatcttagtccctttgctgcttagggactttttgttggaaaacaaaaatttgtttttaacagccccatcagtggcatatgagattatgcaattccccatatactcattaactttgagtattaatcagattttacacatacacacatggatgatgttaattttataattattaactatgcctaactaaatcatagtgcaaattcagtagggctgtctattctcacccatttttctaaagttttctctgatttgtgcccttaaaatttataatcatgttactatgcattgaatcgtaacctgttccctttaggctgaagcagcatttatttgaggaaactgaactcccacaaaacaaaccactgattattgcttcttgctaaaggtgttgccttcccttctgagaaatatttacattctctgagaaacaaggatcggagta

SEQ ID NO: 219186 - DNA, 454 bp, Homo sapiens
aagatgaatgctaataataaaaccttgactttaatttgtgcataccagagcaaggggaattagtacataattttaatgtccggctctgaaagtctggcgcattcatctttaagtaaatgagccatctgttacatgaaccagccggcattcatttagtaggttgcttactgcccccaccaaatgatttctaataacttctaatagtaatggcttcagataggtacatttcagttccagaccattggttaaattctcttctgacagggtgcagtgaaattaattttttaaaacaatttttatttttctcattttcagtattcaaaaagtgaatttcattttaacaaactctatattaggttaaggcctcagtattttaggttacagacaggttaatgtaggcataacccatttttctgaagatgtaacttagtcaccttgtgaaaccgttatgtat

SEQ ID NO: 219187 - DNA, 762 bp, Homo sapiens
gagcatctccctgtaccccagcctgcttgctctgacgccgtcaaatccattgagagatgctgtcagacactctgcctgtgctaggaatgcaaagaatgaaaagccagagctcctgcctttggagcagatatcgacagaccagtgtcaataaagccctgatggtggtctgggccacacgaagcctcttgaggtagctccgcaggatggcaggatgtctttctctctcctggtggagaacgaggacgatgtccaggtcacaggttctcaactctggctgctcattggaataaccagtggcggtttgaaaactctttcacccacattctgacactgagctggtctcaacagggacacaggcacgagtaggtatttctggaagcttccaggtgttttcagggtgcagccagggctgagaactgttgcactagcggaaggactcagattggagtcctatttggagaactgttaaagaaaaaataaaatggccaggcatggtggttcatgcctgaaatcctagcagtttgagaggctgaggtgggcagatcccttgaggacaggagtttgagaccagcttggacaacagagcaaaactctttgtctccaaaaaaaattagctgggtgttgtagcgcatacctgcagccccagttgctcaggaagctgagccagaaggatcacttgagccgaggaggttgaggctacagtaagccgtgattgggccactgcactccagcctgggtgacagagcaaaaccctgtctccga

SEQ ID NO: 219188 - DNA, 494 bp, Homo sapiens
ctctgctgagaaacggctgaaacaagtgcgtgagaaccacaggaagtaatacagatctcagctggtgtcagcggagtctagaaaaaggcagaattccctctcaggacggcgtggctctcgcaggcattgccactacttctctccatgtttctaaaacaaagtcttacgtgggcttcgaagggactcctcgaaggctctatcaatttctccgtctttcctggctactgagtgacaccgccaagttcaagtcaagaagtacccattctggtgtttttgacacagtcaccctactaggaagtgaagaggtgataataaaaaaacactccagcctttcgatttaaaataaaagtagtcttgggtggacactttataaaggcagcctaccaacaggtatccctaaaataattcttacgaagcactaaatcctaagtccctcagcctctgaaattaaaagtaattttaaaaaatcattctgctttatatgagaaacccaa

SEQ ID NO: 219189 - DNA, 454 bp, Homo sapiens
tactttctttccctaaagctctttcttaacccagccccaaaaggcatgatcattaggactttatcttctggagctttttgaggaagaaagctaggttggaacttttcaagttgacacccatttttttttctcaacttttcatggtgggaaaaggtaaaaaagaaaatatttacaatatttggctgtgcatgtgaaacagatttcagtggtctagagggttgcttcctgtctttgtataccaacctccacacatgatggattcaatgacagctcgtatccagttgcctttaaccatgtcatatgactaagtatacctatgcctttgaccacttttaaccgcactaccgttactagcaatatgcccctctttctgacttactggacttgtatagcaaatcactctcttagcatttagagatttggcagtgaaaaaatttgaccatttacattcttt

SEQ ID NO: 219190 - DNA, 344 bp, Homo sapiens
tactgcctgctgaacatcttgccctgcagtgcgcaccagactttctcactcaacattccaaactgaactcagcatcttatcactataactagtttcttatttcaattttcataattctagcagcactgccattctcccagatgcctacatttgaaaactaactttgtgcctctgtttcttctctgtccttccctccccgtattgtatgtcccaaatctatcaaaagtgcacttagagtaagcttggcatgtgtattcttatgatacctatcttattctcttgggaattacacagatgtgaccgttttaaggaaaatccataaaaagaaatgaaatttaaatagt

SEQ ID NO: 219191 - DNA, 321 bp, Homo sapiens
aagagggttccattttgaaagtggcaaccttctcctttccacttgattacagatccaattgaaagataagcataaaaatcagataaaaattatcacttaagtctttgggcaaatcggcttgttaaaattctgaattaaaaaattccctgaaactgcaggccactccgcagtgacagatccagctcatctgtgcttgtgacatggctacaaaatggtgagaaggatttgagttgtgttcatttcattcttcctgctcaccagtcaaggaaaggcactgctcatcagcccaaatgcccatcaatcaatgagtgtataaagaaa

SEQ ID NO: 219192 - DNA, 504 bp, Homo sapiens
ggtaagtcactttccctctctgacttcagtttcctcatctgcaaaatggtagtagtaaaaatgatggtgatggtgataatgatcatgatgatgaggaggaggaggaggaggaacagaagtaggaataggaggaagaggatttctctatctagggttgtaaaatttagataagaaaatctagaaaactctgcatatagaagatgtacaatgtgagtcatattcctttctactttccctaagaacaaaccatgttagtacttaacatttcgcttttaccaagcttttagcggtcgtttctttgctattcaatgagaactgaagttttgctgaaatatgggaaaagtaaccaaacatctctaaaaaacaaaacaaagcaaaacaaacaaaaatacaaggagtaagaaatatgccatattttctagacacattttatttcagttttttcccctgggtgtagagttagggtgcaaaatctatcaaattcttctattaattttaaattaa

SEQ ID NO: 219193 - DNA, 335 bp, Homo sapiens
aggatttgaatgaaaagtcttctaaatatggctctgaggccaggcatggtggcgcctatctgtaatcccagcactttgggaggccaagacaggagaatcacttgggctcgggagttcaagaccagtctggacaacatagcaagactttttctgtactaaaaataaaaataaattaagaaaaaaattagccaggcactgtggtatgtgcctgtctgtagtctcagctacttgggaagccgagacagaaggattgcttgagcctgggagattgaggctgcaatgagctaggatcaccccactgcacttcagcctggccaaaagtgagaccctgtctc

SEQ ID NO: 219194 - DNA, 450 bp, Homo sapiens
ccttgaataattaatgtgaatgggacaggagaacttgaggaaggatgtgcagagaaacggctgaattgctgagcaacagagagaaacgtttttgtgtagttttacctggtctaaattaactaactagataatgccctattttaacataaacatttaatgatgcataacacacttcatttcatactgttccctatagctgggcaatgattactccaaggtgtaatggaaaacatgaattaattagagatttcgggtacgaacgtgacatgaatgtaaaatatacagatcattaaaatcatgtctataaaatagaaattaaaatatgagttttgtaatgtatttgacaaccagataatttgtctatccacataaatcaaactaaccagattattgccatatttcagctttactatgaactgtgttaataaatatcatgactaaatactatct

SEQ ID NO: 219195 - DNA, 659 bp, Homo sapiens
agagacagaaggtcagcagaaaaaaataactacagcttctgtttgaaataacctggttatttctgtttgaaaataacctagctgttttgattgggggaagcagagcaactagtgaacatggtggaaaccttagcgtagggatttgagagtcaagtagcaaagtaatgttatctctaatgatgagggggaaaaactgtagaaaaagttttggttgttgaccatattgaaattcatcaggagatcatgtttgagaaagaattttgtggaattatctccacaagtaagtgataaacagaaaggagaatataaaaatgggctatttttaatttttttctaggattatatgtttttgcttatgttataaagccaaacccagactggcttttgtatttttatgtgtttacctttcatctctctctgcaacatggttttagaatatgggtagataactgctgctccacaactaacaacggcagtataaaacttagcttttaccattgcctaatcaatggaactaggtattctgttttcttacagaattatataacctgtccttattgatgggcatttgtttatattatcttagctctttacatcatcagtaagataaacgtctccagtggttagcgacatggtgtgtgttacagtcattgaaatgg

SEQ ID NO: 219196 - DNA, 480 bp, Homo sapiens
atccagctgcttctcctcttctcctctcctcttctctgctggtagagcctggggtttttatgggcacagggtaggggagtggggccatgggtggttttggaaagggcaacattatagtgggaaaacaggaatacatgtcactttgggctgcagttccaggattgagggtggagtcctcgctggggaccatcttcttctgcccagaatttccctgcctcctgtccctatcaaaatgatgtctacatatgctgtgtgatggtatttggaggtggagccttgggaggtaattaggtcatgtgggtggagccctcatgaataggattagtgcccttaagagacatgagagatatgatctctctctctctgctatgtcaggatacagcaagaaggtggccatctgtaaatcagtaagagggccttcaccaataacccaaccatgctgacatcctgatcttgggctttcagcttccagaaatgttc

SEQ ID NO: 219197 - DNA, 375 bp, Homo sapiens
caggcatgtgtcaccatgcccagctaatttttgtatttttagtagagacagggtttcactatgttggccaggctggtcttgaactcctgacctcaggtaatccacctgcctcggcctcccaaagtgctgggattacaggcgtgagccactgcgcctggccatatatatatgcggccacacacatatatatatggaaaaacaaattttcacttgattgtattatattgggttctgagcatttgtaagtctaaatctaaatcaatggttggatctcagctggaggggaggggagtggggaagggttttgtctctcaggaggcatttgacaatgtcgggagacatttttggttatcatgactgggctggtagtgttga

SEQ ID NO: 219198 - DNA, 456 bp, Homo sapiens
ctccaaagccaattttttaacttagagagcacctcactttgacacaagccccctcttcctccttaccatccccttggtactgacaagaagagtcattagcaagtcaggatgtagtggataggaggcgatggggagaagcttcttgaactggaacagtgaaagacatgggacaccatgacagcgaagatcacagcacaaatggtagatggggtggggcgatgcttagggagggagaaacaccaactttgaagttacaattgcccaggttcaaatcccagctccagctcttaatagctgtgtagcctgagcaggttactcgactacttatgatctcttcctcatctataaaatgggggcggtaacaatagacttggtgggggcatgagcgtgataacatttgagaaatactctgcagtgtttgccatagaaaatagtcaataaattgcagtattgttg

SEQ ID NO: 219199 - DNA, 506 bp, Homo sapiens
gcaagaaaaagaagagcaataatattctagttattgtaggccaggggacccacatccacgatatcgtttttttacagctcattactgaatcctcacaataaccccatggggtagatattactgttattacccttttatagatgagaacactggagcttagcgagggtaagtaatggactgcaaggacactctgtctctggcccagaggaacagctggaggatgcaggcaagatgtgtgttaagggggtcctgcagagtgggggtaaactgattctggattactcattaatgtagaactccgaccagtgggtggagggtatgggttcaatagggagctcttcagaaatggaacatgttgagaggccaggagttctccatccctgaaagcattcaaggagaggttgggtggctgtgggaggtattggagaagggattttaacatcgggagggaactggggagattgtgtgtgagtttctgtctgcaaaaaaaaaaaaaaaaaaaaaaa

SEQ ID NO: 219200 - DNA, 111 bp, Homo sapiens
caaattgtcatgaattcgttgaggagcttctggaaagtgcacattctgactcagcaggtattggagtctgcatttctcatgagcactcaggtgatgtttgtgctggtcctt

SEQ ID NO: 219201 - DNA, 408 bp, Homo sapiens
atataataataatttactcatgtgatttataataatcacatctatttgtgtggttcaaccctttaatcataatttgtatgcttttgctttccctgtgttttcttagtcatactcatgatgtttatgtattttattggtgatttaaaaaaaaccaactttttatcactttttaaattacactttaagttctgggttacatgtgcagaatctgcagttttgtttcataggtatacacgtgccatggtggtttgctgcacccatcaacctgtcacctacattaggtatttctcctgatgttatccctcccctagccacccacccactaacaggacccggtgtgatgttcccttccctgtgtccatgtgttctcattgttcaaaaatatatggaatgcttcacgaatttgcg

SEQ ID NO: 219202 - DNA, 639 bp, Homo sapiens
aatctcggctcactgcaagctccgcttcccgggttcacgccattctcctgcctcagcctcccgagtagctgggactacaggcgcccgccaccgcgcccggctaattttttgtatttttagtagagacggggtttcacgttagccaggatggtcttgatctcctgacctcatgatccacccgcctcggcctcccaaagtgctgggattacaggcgtgagccaccgcgcccggccattgtctatctagttcttaattcagtattagggaaggaaggtgaaatgtttttggccctccttggccacccttattccttgccataagataaagaaaggatatttcttctcacagtaggaggatgattgccataagatacagaaagaatatttctcctcacagtagcaggatgattaacctcaagtcctgggtcacactaaaggcagtaagaatgagtaagaaaggaggaggcacatcaagaaaagaatgtacctctttttcccttttcccagagccgtgggtgcaccctattcatttatcttctgtcatttggttaaagataggagtttccagactgaactgttgtctcagcggagaaaattaggataagtttggggttcacagtgaaatgtgagaagtacagga

SEQ ID NO: 219203 - DNA, 638 bp, Homo sapiens
atggtttttgcccaccaagaagtaccggatggcgatgacaccctcccattgcgtgctactcaaaacctgtcattcttggagagttgcgcagctcccttaactcaagtggtgctcagggcccttggccagggcttaacctgggtatgagggagagttgctacagggagcctcacccacagacgttcctctctgctgccctctttcatgctttctaacctggggactaatcccccagactttagattgccctgcatggttgtcaggcctgatgatgacctccgcgtctgacttacctgtgtccccagcatccagtgaagggcctgacctggacacaggtgctcagaaatgtgtaagaggcagctgcctaaagaagtgatcatattttcagctgggcgcggtggcttacacctgtaattccagcactttgggaggccaaggtgggcagatctcctgaggctaagagttcaagaccagcctggccaacatggcgaaactttgtctctactaaaaatacaaaaaatagccaggtagcacgcctgtagtcccagctactgtggaggctgaggcagttggaggctgagacaggagatcttggcagtaagccaagatcgtgccactgcactccagctctgtctcaa

SEQ ID NO: 219204 - DNA, 774 bp, Homo sapiens
ttcgacggtgtctggcatatttcttatatttttaatagagacgagggtcttgctatgttgcccaggcccgcctcaaagtcctgagttcaagcaatcctcttgcctcagcctcccaacgtgctgggatctcaggcgggagccactgcatctggcccaaaaccaagctttcttatcccaagcgctgacctttatcaagttgacctaatcctttatcatctcctaagtgtccctcatgagtgatcacttcacattcctcccacatggagagctcacccactggggcatatttttcccattggaaaagtgtggttattggaagtttcctgttattggaaagaacaggattggaggtgctctctggggtgtcctcctaccaagcagcctgttgaaggcctcgtggtgctcagggagcacgagcgacactcgccgtcgcttcagcttcatcttgaggccacacagcatctccgccacccagatctcctcaggctcaggggcgagcaccttccgtggctcctcctccaacgactcctcagattcgtcccaccactccctcttccttttccagcaaaaggacctatgcggggggctgggatctaccccaggggctgagtaaagaaaccaggccacggtgtaatgcttctgcagttgatcacactagagcccgacccaaaaccccaaaccactctccatcctcctcagcctcgcagactgctggcttctccaagccatctttccttctgtctgtctcctctgctgagttatatgccactccag

SEQ ID NO: 219205 - DNA, 583 bp, Homo sapiens
taagttaggggaaaacatcatttctaaagcaaattgtctcagagcctggtgctaggttccctttgcacggaatagtatccatgagcaggactactagaaaacattttttaaaataaggaatgtagtgtttgatatttcaaaatttattaacatggtcatcataggaaaagtcagaattgtattgggcttcctcttagttttcagtttacaattgttcttattttgaatcacatgttgcagggtctaggggcagggtccttcataatcttttcattgctttggactctaaagaacttcaaatttcctctctgaggtctccctccagcatctgaaaactctcacctcaggaaaaaaaaaaaaaaacagtggagattctgttctttctcagttctgccaatttaagacatgatttcagagaaatctctaagccagggtgtgccttgcttcctgcaataggaaggtggaaagactaaccatttagcaccttatgactggtgagaaatagctggtggttaatgaatcaatgcaaaggatttttcaaatactgttttcattactaatgccccattttcaattggtaaga

SEQ ID NO: 219206 - DNA, 634 bp, Homo sapiens
atctcagactgctgtgctagcaatcagcgagactccgtgggcgtaggaccctccgagccagttctcaccttgatgattttataaatacctgtgcaatcatttaaggatgctgttataacttgctatcacaggattcaggtccaagaaccctctcttaggatctgcactgggacctacccctttttggcaacatgttcttggcaaccacgaagggactatcctgaggagatccctgacccaaaggaaatagactgcagaaccaattggctgactttggcgggtcaaagaatatgtgagattccccacacatttatgccacaggaggagaaaagcctgcctaggggtgttttaacttatgcccagaagtaccacctggaagaggcaacgagactttattcataagaatctaagtggagcattctcccagacaaccagcggcggagcaaggaggggctggccaaacagtgacgttgactggtgcatgagacgaacagaggctcacagaagagcctctgaagagcccacaaaaaatgtccataaggaggtgcgacaggcttcaagccaaggctgtctgacctgagacaaaccaatgatcactctcacacgcattatctaaataaaacttatccactta

SEQ ID NO: 219207 - DNA, 922 bp, Homo sapiens
atctcagactgctgtgctagcaatcagcgagactccgtgggcgtaggaccctccgagccagttctcaccttgatgattttataaatacctgtgcaatcatttaaggatgctgttataacttgctatcacaggattcaggtccaagaaccctctcttaggatctgcactgggacctacccctttttggcaacatgttcttggcaaccacgaagggactatcctgaggagatccctgacccaaaggaaatagactgcagaaccaattggctgactttggcgggtcaaagaatatgtgagattccccacacatttatgccacaggaggagaaaagcctgcctaggggtgttttaacttatgcccagaagtaccacctggaagaggcaacgagactttattcataagaatctaagtggagcattctcccagacaaccagcggcggagcaaggaggggctggccaaacagtgacgttgactggtgcatgagacgaacagaggctcacagaagagcctctgaagagcccacaaaaaatgtccataaggaggtgcgacaggcttcaagccaaggctgtctgacctgagacaaaccaatgatcactctcacacgcattatctaaataaaacttatccacttaatttgaagtgacttttttgtagaaggctggttaacctgctaaagatacaaaaattgctgatggtacttgaatagtagtatttgagtgggtgtttgtggaggagaaatcttttaattagaatctgtgcatccctcacaataaaatgcaggcattagactttgatctcaaaggaaacttatagccctgttatttttaaaatatctactgttcactaatgggattaggttgaggtttgacacacagaaacctggattagtaatttatccttattgtctctccattattcag

SEQ ID NO: 219208 - DNA, 410 bp, Homo sapiens
taaagtgctgggattataggcatgagccaccgcacctgacctctttagtctctttaaagagaataattgtcaggcaagaattttgtatcctgcaaaactaagttccataaatgaaggagaaataaagtcattttcagacaagcaaatgctgaggcaatttgttactactagacaagccctgcaagaatgctaggagttctaaaacttgaaacaaaaggttgatgtgcaccagaatagaatctcttgaaagcgtaaaactcacaggcctataaaacagtaatacaatgagaaaataaagtaggtaacaatcaacatgatgacggagaaagtatctcacatctcgacatgaacattgaatgtaaacggcctaaatgctccacttaagatacagattggcagaatggaccaaa

SEQ ID NO: 219209 - DNA, 286 bp, Homo sapiens
tcacatagaggctcagtgcagaggtagtttcaggtcatgtttagtttaacagtttcttaggccacctccttcactgttcctacagcctacaccttttggaaacacttggtacctcagttgtatttggcagccatttggatggacaagacccaaaactcaggcttgatcgggccacctccaaaatcaagcttttgtacctacgatatcacctccagcacacacagtgcctctagacttaactgcttagttctgagtcctcctggtcctcctgtcccactccagcctg

SEQ ID NO: 219210 - DNA, 474 bp, Homo sapiens
aatctatgtcacttagcctgaatcctctggaaagccgagcctgaagcaatgattatgattctaatagtttattttccagatacaatcacatcacaggatgttgagcctcctcaccccatgtggaggtgaggctttcctcaggtggtcccctgccaaagtggggaagtcagctggattccttatcctactcagtaagaaggtatcaagtgcctacaatgtaccaggatgccattggctctggggatatagcagtgcaagacagaaatgcagctcatggagctggcgttctgatggtgagatgcaagcaccaaacaaaggaaatacgtagatgtcactgctacacgtgttgagaaagaagatcatgctccttgaatcctttcttgtgcaagacctttgattccctcggtaccatccgttctatcccattccctggaccaaatgtttgcaatatataacacttctttaaactttaaa

SEQ ID NO: 219211 - DNA, 472 bp, Homo sapiens
agatggggtctctttatgatttgcccaggctctggtctcgaaccaatggactcaaatgatcttcctgcctcagactcccaaagtgctggtattacaggtgtgagccgccatgcctggctatctttacattttaataaaattattttgggagactccaagcctttctagtgaatgggttgcatttagcaatggaattgcagctctaaggaagagatgattccaggcagtgggacctcccagtttcagataccctaaagtccagaagtgggcacggtgcctgtttaatgcctgcatgaggccattcccagtgctctagaatctgaaattccctgttaggagctctactcattcatctttgttatccggtgatttctcgcctgcaaagtctgctgaggaaagcacagccagctgccatctctttaatatttagaaatctgccttaataaatcctagctcttcctgcgtgttgcta

SEQ ID NO: 219212 - DNA, 221 bp, Homo sapiens
tttaagccaatcccttcagttctatcactaaattacatcttgaatctgcacacttctcatttttaccaccttttagttcaagatcaacttttttcctaggctactgcaaaagcctcctgaactggtcttctgattcaatgcttgcccctctctatattgtagccagagagagcttattggaaattaaacgactctccagctaaataaataaataaatattt

SEQ ID NO: 219213 - DNA, 723 bp, Homo sapiens
aggagagttccgttcacatctgggatgtggctcatttcacttattcattcaacaaccactgatgcttgctgagagccaggctccaagccgggtgctggggacacagcaggcgggacgccagacagagccccacgccgtggagccagcagacggtcagggatggtctgtcccgggcacatggctaggaagtggtgaaccaaggcgctgcccgcaggagtggggctcctgggcctagatgccctgttcccattcgaaaccctctcagaaccagccaagactgagggtccctgtggcccagtctggggctctgcccacaccttgcagaggctgccagtgcttggcaggggagctgggccatgttttcctgggaccttgggcaggtgactttggagagctgctggaatgtgaagtcccaaggtctgaaaactctcacaggcccaataggacgctcatgcccggtggccgcgtggagggaccgcctcctggtccaggcatgggtggggcctcgctggccacgcccttccagccaggtgcctgatggatggggcagggcccactccagggccacgtgggctcggtggccagactgtcaagtactttgttttcattagaaaagtctccttctcccaaaagaaagatcaagcacaggggagggggccgttttattttttaataaaatgccacttgctgtttctgaagcagcactctgtcagctacagcacc

SEQ ID NO: 219214 - DNA, 514 bp, Homo sapiens
cccagaaacaaatccatacatctaaagtgaactcattttcgacaaaggtgccaagaacatgcaacagggaaagggcagtctgttcagtaaataaagctcagacaactccactgcagaagaacgaaactagagccctatctcttgccatatataaatatcaaatcaaagtggattaaagactttaagacctcaaattatgaaactactaaaagaaaacattggggaaattctccaggacattggactggataaaaatttcttaataccctacagaagcacaggcaaccaaggcaaaagtggacaaatggaatcacatcaagttaaaaaccttctgcatagcaaaggaaacaataaagtgaagagacaatccacaggagaaaatatttgcaatctatccctctaacaaggaatttataacaagaatattataaagggctcaaataactaggaaaaaatctaataatctaattaaaaatgggcaaaatatctgaatagacgtttctcaaaaaagaca

SEQ ID NO: 219215 - DNA, 215 bp, Homo sapiens
tgtagtgacgggattttgccatgttgcccaggctagtctcgaactcctgggctcaagtgatccatctgacttggccttccaaagtgctggaattacagacctgagccattaggctcagctgaaatcattttagtatatttggtaatacagtaaataaatgaacgtaaagaattttaaataatttggttttgctttagattcaggggatatatgtg

SEQ ID NO: 219216 - DNA, 439 bp, Homo sapiens
caggtcctggcttgatacctgatccctgtggaagctgacacctcagcatgagagggatcagggcagacaccgctgccgccacgggagcctcaaccgacttcagggagagacgctgaggacactggcctgaaaactgttccctctcactccacactcagagagatgcatgtaaaaattcttatatataataataataatggcaggaaaagaaaaagtttccagttaagtgacttgactgagtttacacagctgggaaactggactcaaaatccaagtcatatgttttcagagtttatacatttaaccttttcttcaacaagccatctccttgtataatcaggtaaatatacttgttcagtgcctggtacatcataggttctccataggaatttgtttaatgaccacatgtaaatatatgtatacctgtgtttgtgtgcga

SEQ ID NO: 219217 - DNA, 398 bp, Homo sapiens
ggcggtctgaatttgaatcccagctccagcattcactggctgtgtgaccttaggcaagttgcttaacctctctgaacctcaatgtcctcatctgtaaaatgggagtaatcattgtgagggttgggggtggccattcatgggaagcgtgtagttgggggcctggtacctaagtgcttgaaaaatcatgcgggaaaccagccatcccggggtctcaaaaccatggccgacctgtgtgggtgagagagtggcctttgaagctggtggatagaccaaccctgcgggctcctgacttttcaagtcctgtgagccctgagtggttgtctgaaaggcggacacagtggtcctcagtgcacagtgtcctcctgggggaatcactgagcaggcaccctgaattgcaa

SEQ ID NO: 219218 - DNA, 421 bp, Homo sapiens
tacaaacttcagttgtaatcaagtcttgctaaagaacacattctgatctcttaaggtaaccttacatttctttacattagaactttatatttcttctaatccatatgcattggttctacagttttagttttgtaattgccaaaaaaatacaggattctcagtcacatcagaatttcagatgaacaatgagtgattttttagtataagcatgtcccataaatttcatgggatatacctacattaaaagtgatttgttgttcatttgaaattctgtttaactaagcaccctgtatttttatttgtaaaacctgaccaccctctctccaagggaaatcctagttccctaatttccaaattggtggaggtggtggtgacctcatgattgctcatgtaacctatccacagtttcaagaagaaaaga

SEQ ID NO: 219219 - DNA, 353 bp, Homo sapiens
agtttttagtgtctcacttttcaatttaaaaagacagctaacgatcaccagatatttgagaaaagtttgaaacatgaaaggcagaaattaaaagagacaacaacagcactagaaactcacaagaaatagagaaaatatagggagcagaagaaaacttcacaaaacctgtaattactagtctaagagagataagagaatatgttgcattaataaaataaaagcaatgtgcaacaaagaggagtttcagagactaagaaagaacttttggaaattaaaagtgtgatagaagaataaatcagtagagggtttggaatatagaattgaagaaaacttacagaaccttgcagaaagtc

SEQ ID NO: 219220 - DNA, 202 bp, Homo sapiens
atttttattagaatatgttgttgagtgtgattcataactattttgtacctttgtcactcctctgataatttaacaaatataaatttaatgtcaaccatgtacaatttgactatgctaaatgctgaggttactgagttttaaaatgaaactagaacatttcttcaacgttaacactaaaaaagacctccagatagataagatt

SEQ ID NO: 219221 - DNA, 390 bp, Homo sapiens
tgggtagatttgtgagagactcagggtgcagaagagagggagaagatgatgctgttttaaaatgatgctttccactggttgtttcctctaaagaagacaacggtgagtccaggggagctgttatttttttgcttagggttggaaggagggaaaagacaacttctttttaaaaatttataaaatgttatgtatttttgtttatgcttaatttatatctgtgacatggaatttgagcaaagtggccacatatttttgtagggaaaaaggaggcatctgatagttttattttccacattttagggactactttccattgcagcttgaggctttcactgattaaaataatggcttttcaaaagttaatgtgttatatagtgagcacataatctc

SEQ ID NO: 219222 - DNA, 298 bp, Homo sapiens
ataagtgggaattgtacaaaagacaaagaaggaatcaccaacgtgttcaaccagtttccaacaaattgagaagtagaattcatgtttcatgaagaggtcttcaataaatccatatctcaaagcactcaagacaagctatacctgttttctctgaactactgctgtgaaatagtgtttctcatgaaatccacaaaacttagttaagataagccaaatgaattcagtggtcctccctaacttgtgcctcattccttatacataaaaaaaatgcttaatattttatatataaatgcaatat

SEQ ID NO: 219223 - DNA, 233 bp, Homo sapiens
gttataatagctaatatgtacatagtgggtcagcatctaacttgctgaattctttacatatactaactcttaattgtctccaaaaacatataaggtatatgtgagctttatccccattagttgagaacactaatgcagggacagattagctaacctgcccaacaccacagaactataaaagtggagccagaactcaagctgggtggcttggctttcacctgcctgccatagga

SEQ ID NO: 219224 - DNA, 593 bp, Homo sapiens
gtactctggcattgctgttcctgatgtacattgataatccgaaaggagcatgccaatcaatgttttttactacagttttaccaaagaagcagggaagaaatctaaattccacatctatgaaattatagtccaattaacatattcctatacacatagatgaatggatattacaaaaagaaaatctgaagaaatttaaaaagatttccaaagagtgcacaatgggcccaaataacataatcaaataacacattctgagcacctgcatgctatggcaattcgctaagggctgcacatgttagagaaagaaaagatgcagcatctgaattagatgaatgtttaccatcggcacatatataaccattctcacacaaacaaacgtgcgttattctgagaaaaataatggtctatcttttattaatcatgcaccaagggtgggacaggtcacctagcatctcttgtcacctagcgcctcaaagcctctctgtcaaataagtgggaataagatctataagatctaccatgtgaggatattatgaaaagaagatggtataaaacatttacagggacctaacacacaacaagcattcaataac

SEQ ID NO: 219225 - DNA, 360 bp, Homo sapiens
ggaacagtggttctcaacctcgtcagaatcaaggtcccttcttcccctttgcagcaaacatgtataaagccctctttactaccctgaaatgaaattcataaacaatgtgacctccctacacacatccttgaaaagcagtatgatggtttgattgaagcgtaagggcgaaatagagaacagtatatgacagatgttgctgtaccattcacatctaggacatactcttgtgctggaagacagtatatactggggtgcttgtgccagcttctaatgagtacatttgtattggttaaaaaaaattaggaggagctatttcaaacaagagcaagcctgggcaatatagcgagatcccacctgtac

SEQ ID NO: 219226 - DNA, 391 bp, Homo sapiens
actaaacactatcttttatacaataaactttccttactttttaattgcctgttttctccagttagactgaggttccataaaggcattgatttttgtctgatttgttcactgctctttctctagtccttaacaagtttggcacatagtagatgcttaatagatatttgttgaaagaaagaatgcattaattaatggaaaactcaggaatctttataagtgacttctgaagctgagtttataacttttcatcatatgtcaatctgacttgttggtagaagactttgtttttttttttttgaggcagggttgccctcttgcccaggctgaagtgcagtgagctgagatcacgccattgctctccagtctgggcaacaagggatgctccgtctca

SEQ ID NO: 219227 - DNA, 176 bp, Homo sapiens
tcttcatcagagcatctgttccctctcacttaaagcttggaatcaaattagattctgtccagaaagggggcaacaagtattctgagagcactggagagtgtatgcgcaccccagatagcatgtgaataaaccatctgtttgctggtgcatgggtttccgagtgagaagcagcccct

SEQ ID NO: 219228 - DNA, 184 bp, Homo sapiens
agagcttactcagggtgtcacttgcttcagaatgccggcctctgcagtgcacacttgtcctcctccttgaatcacaaaattcacccaattttggaaagcagggttaaaaaacaggatttatggggaggccgaggcaggtggatcacttgagatcaggagttcgagaccagcctggccaacatgg

SEQ ID NO: 219229 - DNA, 1071 bp, Homo sapiens
  misc_feature (994)..(994): n is a, c, g, or t
tgtgggggcaacttgtgtggaaggctaagacactctctctaagagatggctacatgggttgtcagttttcacacttgttgaaggcaggtgatcagtgaagggttattaccacctgtaggaatgcgacagctcttcgacccttctggtctctcagagccgacgcctttttcatctctttgaccaacactcctccatacaatgattataatctgtattcttcctaaggcgcatcttacaggaagatgttagattaacaccttctggagggactaaaaccccaatgatatttaagcatacattgaaggtggttattcttcattttagtgataaacttggttcactttccctgtatacagctttgcaatagatagtgaaacaatgtcaacagttattgatcacctactatttgtcaggttctgtattaggagttgacaatgtagtctaacagataaatcagacaaaaatgtaatggaatgtaataaattctatgatgatgataaacacagggtgctcttggaacatacaggagggaactaactcagcctgggaagaagagtagagcatcaagtaaggcttgcaaatacggagaaaataggcaagcacaaaaggagaggaaggtaactctaggtagagggtacagcacagataaagagctgggaagggtttatatggagaagtcatacttttagggaggtaccactcccgtaccagtgtttccctttgtctgctcccagacagctttctcctgcctcccagctctgcatctctcagatcctggctctgatcccacgctgctgttgcttccactcatgtacccattgctaacggcatcatttcttggagtaattcattgcaaagttcatttcccacgataaacgcagtctgtgctcattacagtcaacagggtggcccaaaagagttcagttaagggaaaaaaaatcaaattttcccttgaaaagaagccagtgatatggcttgggtccatcttcctgangtgtgagaactctctgttagtgttagttgctttaaggctggtctgctgctatacatgtgatcttctcctccctattg

SEQ ID NO: 219230 - DNA, 1110 bp, Homo sapiens
  misc_feature (1033)..(1033): n is a, c, g, or t
gaagggctaaaaacactacctcgaagacatggctacatggggtcgtcagtgaatcacatctccgtagactgctgctaagtcaattcaggtttaataccaacgatcacgtaatgcaaaaggatgcttacgcatactctgtctgtatcttcgacaataggcgcgatcgcctctattatgcatcatcctttgtcgagcgccaatgacatccctccgagtacatagtgcactgttactgtatctagtaattgctctgccgtaacatgggcgcatcttacaggaagatgttagattaacaccttctggagggactaaaaccccaatgatatttaagcatacattgaaggtggttattcttcattttagtgataaacttggttcactttccctgtatacagctttgcaatagatagtgaaacaatgtcaacagttattgatcacctactatttgtcaggttctgtattaggagttgacaatgtagtctaacagataaatcagacaaaaatgtaatggaatgtaataaattctatgatgatgataaacacagggtgctcttggaacatacaggagggaactaactcagcctgggaagaagagtagagcatcaagtaaggcttgcaaatacggagaaaataggcaagcacaaaaggagaggaaggtaactctaggtagagggtacagcacagataaagagctgggaagggtttatatggagaagtcatacttttagggaggtaccactcccgtaccagtgtttccctttgtctgctcccagacagctttctcctgcctcccagctctgcatctctcagatcctggctctgatcccacgctgctgttgcttccactcatgtacccattgctaacggcatcatttcttggagtaattcattgcaaagttcatttcccacgataaacgcagtctgtgctcattacagtcaacagggtggcccaaaagagttcagttaagggaaaaaaaatcaaattttcccttgaaaagaagccagtgatatggcttgggtccatcttcctgangtgtgagaactctctgttagtgttagttgctttaaggctggtctgctgctatacatgtgatcttctcctccctattg

SEQ ID NO: 219231 - DNA, 908 bp, Homo sapiens
aactgtggaaagatatcctagcagtcttgccatcattatttatagtttaaaagtttgatgtccaagtagcttctgatagccttcctacaaacaccaaatataaatttcactgggctataaagacagcaaaagcagagaaaagatgatgaatatatctcagtagcactattaatattccacagagacgtatgcaagatggagtctgaacactggctgaaataactctgttttcccaggagggggccactgctcagtaagcaggaaatagcaaaattcagagaagtcctttcaaaacagatattttgtcccaaggatgtgagacagcataagggcttagtatacactaccacatattctctaacatggcattatgttagaattgaaggactgaaagcaaagatgtattctgggattcttttttaaaaaataagattttccccaattaaaaaaaagaagctcaaaatccatttctatggaaatgttgtaattctgctacttttgtttagggtctggatgttttgcttcaacaaaacagcttactggtcatttttagagtaatttttcagtgagataggggaagagcctacgattttgtgatacattttcatttgaatgaacctgaagaggtagttgacagtcttccaaaattaagcatacatgactacaaaagagattacagatactatggtggctttaagataaaacgtaaaagcaggattcctacaggaattttagggctgaggaatgaatgaatatgaagggagggaggtgagtataaatgagcatttaataattgtttttccttggtttgatgtgatggaggggaaaagacaggacaaaaattgcaatgataaatattgaagggactttaaggaaagatgatgaaatggcaattgcatgacaacaat

SEQ ID NO: 219232 - DNA, 417 bp, Homo sapiens
actcctgactactcaagtgattcgcctgcctcggcttcccgaagtgctaagattacaggtgtgagccaacacgcttgtcctgttcttcatttttaatggacatttaataacaccatatgaacacatttatagggtttttttttttttaaggatttaatactttaaattcatgttaagtaatgaacttttttttggagacaaaatctcacctagctgggagtgcagtggcacgatcacggcttaccacacccctgccctcctgggctcaaggtgattctcccaccatagcctcccaagtagctaggactacaggcatacaccaccactcctggctaatttttgtattttttgtagaggcggggttttgccatgttgctcaggctcgtctcaaattcctgagctcaagcagtctgcccg

SEQ ID NO: 219233 - DNA, 233 bp, Homo sapiens
tgggctgacctgcagcggagagtctgcccaccccggagacaccatgagggaatggaccacgtgggagcatctgtgtgcaagtctcatttgggtgtgtttatgctgcgtgttgtatgcctgttttagtcataaagtaggcctgatatttaaaaccttgtctttaagttcaaggctgcagtgagccgattgcaccactgcactccagcctgggcaatagagtaagaccctgtcta

SEQ ID NO: 219234 - DNA, 439 bp, Homo sapiens
ccctgtctctactaaaaaaatacaaaatcagccaggtgtgatggtgcatatctgtaatcccagctacttgggaggctggggcaggagaattgcttgaacccaggaagtggaagttgcagtgagccgtgatcacgccattgtactccagcctgggcaacaagagaaattctgtctcaaaaaaaaaaaaaagaaataacatatttaagatttgctttaaaataatctgaaggcagagttagtgggtgtgataattaatattagatatcaaattgattggattgacagatgcctagatgctgaatcattgtttctaggtgtgtctgtgagggtgtttccggaggagatttacttgtgagtcagtggactgagagggaaggactcaccctgaaggtggacaggcaccatgcaatcagctggcccaactaggacaaagcaggca

SEQ ID NO: 219235 - DNA, 585 bp, Homo sapiens
ttgtctgaaaacagcctatatttactttcatggttgaagaatattctgctggctataaagttctataatagtttttattttctataagaacatggagaatatattcccatttttcctttggtttttatttttgtgctttagaaacataaaatttttttttctggatgctataaagattttttcactttttcttttgttttctgcaatatctcagggtgaatcttggtgtagatttcttttttctttatcctgcatggaattcttaagttctatgagtcagtcctccaaaattctcagtcatttaaccataaaaatttaaatattgtctttgctccatttctctctcttgtaaaactgcaattaaatatatgttagactttttcaagatgtcctccctctcatcctctctgctatattttctatgttttggtctctttgtgctgtaatatggaaagtttattctgacttatttttctgttcaataattctttcttcagctatgtctaatatgcccttaaactcactcaattaattcataatttgtcattatatttccccttttcaaaattatgtcacttttccccc

SEQ ID NO: 219236 - DNA, 519 bp, Homo sapiens
tactaccagtaagatactatgccttcagagctctagagagtatcctgggagggaatacattagagccaaggacttgctttgagagcaccaaattatgtgattcaaaatcttttcaccttgacctgtgaacatggaccacgtgaatgcaaatatcatagaaggaactcattcactgaaagattttgaccacataacactttccacatgtactgtgaggttcttcctacattccctttattaactttaaagacagtggtcaccaggcagtggaatttttgagttttctataatttatgtaacacacaactcttttggggtggtgcctttggttgattagacagtcttcgatatgggagagccacagctggtgcttatgggattatattatctgagcctctgaaaacggttttgttttctttctctcagtttagataggacatatccaacttggtggatcttagcggattctgaccctctgtaggttgttgtttctttaggctcaggccgtggcactgctca

SEQ ID NO: 219237 - DNA, 464 bp, Homo sapiens
agtggttcctacaggtttttatgtttttgagatacatgcctaattttggattattaattcttactggaattttgtctgttaagttaggaagaaacgacttataaagtttcctttggttttccccaggaagatacttttataacatgaaatctttaaaaaaccctttagaaaagtggtctatataattcttagcagggtgttgagatcaagtgcttttcttcttttcattttttacactttgtcagttgaagatgtgcaaagaagtccatttgaaatttccctcgggccacttaattcagcttcattacagtggaagtgggttaaaaatgataatcatacagccccaaagtgctgggattacaggcatgagccatcgtacccggccgagatttcatttttaaaaaacatgaatccaagaagtgacttgagttccaaataaataaatttataaatttacttatgtt

SEQ ID NO: 219238 - DNA, 180 bp, Homo sapiens
ctctgtttcaaatgatgggctggacaatggagtgcttgttgacctgagcttcctattcagcaaagaagtatgggagacagctgggcagtgctggaccccgtgacttccctattaataccccagtgatgagaacagacaccaaccctgatgggggtgactaggggatctcctaatgaaatg

SEQ ID NO: 219239 - DNA, 805 bp, Homo sapiens
ctttgaaatttttctcctgagttgggctgcaagtgtgtgcacgcctccctgcaggcatgttggtcatcatcatagccatcaggccctgggtcctgcagaggagagaaaccacctcttggtgtttctctcgctctgtgtatctaccatctttccttgaccctgaatttggctacatctaattcatctgaatcaattaaaaaatatttttaagcctatgtcacttaagaaatgtctcttctgacatcctttttcttttattacctttcccttccattttccttttccgtttccctttctttctggcttgccttctttctttttttgtgttgagtgcattaagtaacatcacgatattgttatgttcagtggtgtgctgataaaccaactctctaggaagaaaaaggccctggtttgtagcatctgcccatttttgtggcatgaatattcccaccggggcttatttcaagctaaccaacatgatgtcactggatgtggaattgggaagaattgaggacagtttgttaaataacactaattaatttagccaagagggctttagtaccccaaacacccactccctcctttggcatagatgaaaaactacaaatcaatttacttgccagcattccagcaagtcatcttcttataaatctttcaagatccttcattccctcataacgcttaaaaaaattatatactgcctcacatcattttaactgaaattaggtgtttaagccaaaaagagtgaaactcagttttggactccgtcagaggtataattgtacaaagaatgcccacatgacag

SEQ ID NO: 219240 - DNA, 295 bp, Homo sapiens
aaacccgtaggacttgtgaatgaaggccatggagattctgttgcaactgcccgaccctgctgctgtagtgcagaagcagccatagacaatacagaaacaaacaggcctggctgtgttccaataaaactttatttacaaagacaggaggcaggctggaattgacccatgtgcagtttaccaccccatgattgatgtcatttgtcattcttttttttttttttttttgagactgagtctcaccctccagcctgggcaatagagtgacaccctgtctcgaaaaaataaataaatcaat

SEQ ID NO: 219241 - DNA, 409 bp, Homo sapiens
agaacattgtctgacttctacatgctacaaatagggatatttccagaactctcaagaagatggtttgaaaatagcatctaataagagaagacggagtgcctcctaacctcatgaacagcattacaagaaaaatatgtcatctgggcccggtggtacacacctgtaatcccagcactttgggaggccaaagtgggtggatcgcttaagcccagtatgggcaacatggcaaaaccctatccccacaaagaatacaaaaattaaccaggcatggtggtgcacacctgtaatcatagctactcaggaggctgaggtgggaggactgattgaactcaggaggttgaggttgcagtgagctgtgatcgtgccactgcactccaacctgggtgacaaagcaaggccctgtctcaaa

SEQ ID NO: 219242 - DNA, 527 bp, Homo sapiens
ggccattgtgggttataggagtggaatcagaggagtggaccagctccatactcttactagaatgggtgatttcaagaaatgaatggagttcttctcatagtcaacatgataaatgagccaagatcaagaactgacaggatcagattattttcctaagcatttcttgtgaagatgcttcttttattttccaggtacttgccttccaggttgtgctactttgtcttaaaagtgcacatcaacacctgataccaacattgctctaagattccttcctgtcaaggaagctaaacttatttagctctatcctgggcatccttcttgctcctaaatcatacttctctcattctgtttcctcattgacttcagcttataagactaggctttttctgtaaaccctttccttttgttcaaattgattaactctgcaatattcagtttcccatggagaatgagatccttactctgatcccagtgcagtggctgggctcccagcaaccagtttcacttatgccaagtttgttttcaga

SEQ ID NO: 219243 - DNA, 263 bp, Homo sapiens
tgtagttagcttgaaaatttgggcaaagaattcttgcatgttgtgcatgaattatccgtacatttttttcggttagttgagtgtgttgggatggggagaggagaggcgagttagtggtagctatggttattagagaagggaagcaattttcagatcagtatctaatttctcagttttagtttttgaatgtgatgatgtttctgtttaggttttccaaaacttgattctttctgtttgtcaacacctggactcatggggctatc

SEQ ID NO: 219244 - DNA, 194 bp, Homo sapiens
ccctgtctcagaaaaaaaaaagaaagaaagaaaaaagagacttaggatacagatcagcgacagccattgtgggcccttaatggatcctgattcaaaccaagtcaccccagaaaagatacatcagagatcatctgggacatctaaatatagagtgcaatgaaataaaggatgaccattaacttggccacgcggga

SEQ ID NO: 219245 - DNA, 461 bp, Homo sapiens
tcggcggtgccccagaacacggagatttccttctgcccagctgcatgaggcacacatatcctgggatggcattaggaagatggccactttcacatcaacttatgtactctggcaccaacctctcttctccctacccagcccaacttcccacccactgctattgggatgatatgtgctcttgggtaaggaatgcatatccaaatgctacctcagatcagggaggtaatacctggcctcaattctctgcccttaaagaatcttgcagccaaattgggtaaagagtcaagacccatcggtgtgctttattcaggagacccatctcacgtgcaaagacacacatgggcccaaaataaagggatggagtaatatttaccaaggaaatggaaagcacacacacacaaaaaaaagcagaggttgcaatcctagcctctgataaaacagactttaaaccaacaaagatc

SEQ ID NO: 219246 - DNA, 392 bp, Homo sapiens
ctggtatcttttagtgtttgtcaagttggtataaagaaactgctggtttattaatccgtaaggttgtgtaaactctacatgacttaacattttagtgacatagaaaagtgggatttctggttggtgtacagatctttcttcacatcgtgcaggtaacgtatgagcattgtctgatggatccttacaacattcctgtatgcttttggaaagtatgatctttgtttaacaaaatgggaaacagaggcacatgctatacccagctatcacagaaaacaatagttagaatccagaaaacatactcatctggtttagtgtgttgcccaatagatgcaattagtattctgttttatcttatttgtttgccttataattattaaacattgttttttaaa

SEQ ID NO: 219247 - DNA, 438 bp, Homo sapiens
cggcaaagagggaaagggacgtgacaggacgctctttattaaaacttgcatatgattataacttgccaggtcttcatttatttcttcccccctcattactctggtcatcagggcgagtcctaaaacgcatacctttaatgtaacatttcaggatgatagggaataggattgtatcgcaaaatgagcactattcccacaaacaggaggcacctgactccaaaaagtagaagagggcagagaagttttgtctaacaatttatgtgtaagtgttcagaagtcttgcacttgctcaagacagagccactgcacagcccaattctgtaatggcagcatggaagtgggggactcattacagatggagggaggtcatattactcgccagggacacagctggtttgtggcaggcccagattggaacctccagtgtccatccttcac

SEQ ID NO: 219248 - DNA, 489 bp, Homo sapiens
atctagaggatccctgtcttgatgactgcaaaacacccaaacacctcccattaggcccacctccaacactggaggtcacatttcaacatgagatttggaagggacacacatctaaactataccagctgtagattctagcctgtagttaaatacactaccataccttttcctaactccatcctgcagacccagctaattgatgtcatggtaaaaggggaggcaacatgatatgaggcttgatgttatggacctccttattgagctgtcttgaataagacttaatactggagggggagggaaaagtaagaatcattcagaagaaaagtaactaaaaataaaagagatgagatagcctggcgcggtggctcatgcctgtaatcccagcactttgggagggtgaggtgggcagatcacccgaggtcaggagttggagaccagcccgaacaacacggtaaaaccccatctctactaaaaatacaaaaaaattag

SEQ ID NO: 219249 - DNA, 466 bp, Homo sapiens
atactcttcaaaagtgtcaagttcatgagtaacaagggaagacagcgacgctgtcacggattggcagagactaagaagacataacagatgaatgcaacgtggtattctggattggatccttgaataggaaaagggtattattggaaaaactggcaaaaagacaaataaagtccatagtttagtcaatagtgtagcaatgttgatttcttagttttgataaatgtgtcatggttatataacacgctacaattaggggagactgggtggaaggcttactggaaccctttatactatccttacaacttttctataaatcttagtatttcaaagttaactaaaagtgaaaaattgtaaagtcccttctttcttaaaacaaatctaggatgcttgttatgtgttaacaattcttgtaaatgcaaatcactttgaagagcaataaatattacccagaaaaactgaaaaaaaa

SEQ ID NO: 219250 - DNA, 614 bp, Homo sapiens
ctcgtagtgactgtggggctggctctccaggacaagcccctccagtggagccaggaaccaggatggaaggttgggtttgggggtggactgatggcctggagttcactgccacctattttcttttcctctttttccatctcacccagagctgtgggaagaggccttgacaacaggtgagatttggggcacctgactgtgacttcaacccagcaggtggggttggcccaaagcagttccccagcttgtcctctcaggtcctctggacacccttccccaccacacataaccctggaccttcacagctcccacaccaccatccacacctaggaaaggacatcggactggaggtcaggggcctaggattcaagtcccagctctgccgacagctaccagtgtattcttgggcaagtcactgaacctctgtgggtcctgattcccttacctgtaagagagtgataatcataaggccctctgcattgctctaaggatcaagataatgcttgtgaaagtcttcactgtactctaaagtgtgattaatatatattctttatcctggaatctcctatctcctttgagtcctgttaaataaaccatgatgtgaatggttaaaaaaa

SEQ ID NO: 219251 - DNA, 554 bp, Homo sapiens
atcttctgccggccacccccaatcatagctcaaattaggggtgacatttgtgaactagggaaattaactttaagaaggcaaatgcaggccttaaagacagccatgcaagtggtccatggctgagtatgggaaaaactgcccataagcctagcaaaaccagcatactcctttagacctggggcttctgtgcacataagaaataaaatccaaccactttaggacccacatgggatgggccctatactctaaccttgtccacttccacggcagttaaagttgcagaaactgtgcgctggatcctccacagtcagttaaaactggcagccaacatgacccagatcactggagccagttaatcctgtgacaggaccaagttgccatgagaaatgatgacagccctgctctggtcactccaaaagctgaccagtctctgctcagctaaaatctgaggagtcaacagccctgctctagtcatcctggaagttgactagtctacgtacggtcaaagctggagtaaaataataataaaataatgattaaaatcttaaatcaaa

SEQ ID NO: 219252 - DNA, 610 bp, Homo sapiens
ccaccaccgtcacttcataaaagaaaggacatttcaaaatcaggccagtaacaggacatgtctcagaccacagtctgagtgcagtcctcagaccacgagactcgtgtgtcttgttcagcctactaggttttgaattccccagggaatgtgtctcattcatatttaaatgcccagctcctaggtgggtgttcttgtataaagtcagcgctcagtcaacgggcgcagtagctcacgcctgtaatcccagcactttgggaggccgaggcgggtagatcacttgaggtcaggagttcgagaccaacctgacaaacatggtgaaaccccgtctctactaaaaatacaaaaatttgctgggcatggtggcacacacctgtaattccagctactcaggaagctgaggcaggagaattgcttgaacctgggaggcagaggtttcagtgagctgaaatccgtgtactccagcctgggcaagagagcaagactccatctcaaaaaataaataagtaaataaagtcagtgctcagtcggtgctatctgaaatatgtgaactgaccaaaaaagagccagtatttgatgtggtattaacggaaacagccaaccctcatctcct

SEQ ID NO: 219253 - DNA, 452 bp, Homo sapiens
aatatcagagcagttctttgtttagaaatatttttgccatattttaaatgaattggtgcaataaaaggacttcagttaagatgctctcataataactcaagagaaaagtaatgaggacctgaactgggacataggcaatgagattggagataagaaggtgaatgaaggaaatattaaaaatgtagattcaaaagtactaagaaagtggttggatcagaatgtggggtacatggagcaagagaaataaaacaatcattgagagtgctgaagtttcaaatccaggaaaaatgttcacaccttggacagaaacagtggtgactgggtctgcatgaaaaaacagtagtttccattttggctcattggattttaggtgtaagtagaatagccaagtagttgtatttagcagacaattagaaatatgaggcaaaaatttaaaagagaagtcgaatctg

SEQ ID NO: 219254 - DNA, 301 bp, Homo sapiens
aggtaagagagagacagtagaacttactgaagaaattaattttaggtaagggaattatgtagataattggggtggtagttgcccagtaggcagctgagtaaaaatttagtcttgagtttaatgtctttccttattttgtttcttttttttttttaaacatttttttatcacacccctcaccctcacccccatgatcctttatggttagaagattgcagactttatctaagttggataatgatttatgtttagaaaacctttttaagtattaagaaccattgatactttaggattgtaattg

SEQ ID NO: 219255 - DNA, 533 bp, Homo sapiens
cgtccttcatcatacctacctaagaattaactggggcctggctcactggcttatgtctgtaatcccaacactttggggaggccaaggcaggaggatcacttaagcccaggagatcaaggttgccatgagctatgatcatgccactgcactccagcatgggcaacagagtgagaccatgtcaaaaagaaagaaagaaagaattaactgaattcccctccaattctgttctagagagtcaagtctagatgagccaagagagatgaagtatatccctttcttttccactgctgtctttgttttactgatggggaaactgatgacagactctgtcagggaaaccaatggcccaagaccacatagtgagttggtggcagatttggggctgggacccaggtctgcagactcccagtcaaccctgcagctctttcagggtgctgggaatcacatggtgtgtacctaggcatgtgctgtgctaagcccttgacatactttgcctcatttggttttcccaatggtaggtagatgaaggacgt

SEQ ID NO: 219256 - DNA, 534 bp, Homo sapiens
cgctatacatttagactagctatagaattaactggggcctggctcactggcttatgtctgtaatcccaacactttggggaggccaaggcaggaggatcacttaagcccaggagatcaaggttgccatgagctatgatcatgccactgcactccagcatgggcaacagagtgagaccatgtcaaaaagaaagaaagaaagaattaactgaattcccctccaattctgttctagagagtcaagtctagatgagccaagagagatgaagtatatccctttcttttccactgctgtctttgttttactgatggggaaactgatgacagactctgtcagggaaaccaatggcccaagaccacatagtgagttggtggcagatttggggctgggacccaggtctgcagactcccagtcaaccctgcagctctttcagggtgctgggaatcacatggtgtgtacctaggcatgtgctgtgctaagcccttgacatactttgcctcatttggttttcccaatggtaggtagatgaaggacgt

SEQ ID NO: 219257 - DNA, 387 bp, Homo sapiens
tcttttcttcagcccaaaccataaggtccatctcaccttcactgcaacaaagaagggttgttaaagctggacacagatttgcttggcttcaccctctgatgtgttccacaccacttcacgccacttttcaaaaagatgataaaacgtcaggctgagtagaacagaactgggtgcaaataaatctctctgaagctaacttgcctctctctacccctacttccctctgcacgtgcctttgctttattcccctgcatgagagaagcagtcaaatctttcccattttcatacctggattgctgctcaacagcctcaacaactgagacctgaatgtatccccattttaaagaacctaacagaacattaaaattgtttcctgagccttctgat

SEQ ID NO: 219258 - DNA, 473 bp, Homo sapiens
aggcctgccctcaggagaaactaatttaccagagcttaaattacttaggtttttctcacagcctaactgacctaagggtagggggatacccagctctagccactctagctgttccacctaaggggagggaagggatagactaagaagcacttgtgaagttcacagtccaagggcccaggctcaccaaaactactaagacttaataataacctacccaaatgagaaggaaccagaaaaccaactctggtaattaatatgacaaaacaaggctctttgacactccccaaaaaatcacactagctcaccagcaatggatccaaaccaagaaaaaaatccctgattaacctgaaaaagaattcaggaggttagttattaagctaattagggaggcaccagagaaaggtgaagcccaatgcaaggaaatccaaaaatcaatacaagaagtgaagggagaaatattcaaggaaatagat

SEQ ID NO: 219259 - DNA, 956 bp, Homo sapiens
gtaagttattgagcaagaaccattattttagattagaaaaagtaatggtcatgcaaattacggggtaaaatgttctcagatctttcagcaattgtggtattttggtatttaaaatcagtgctgtaggagtgaggaggctgagctttgctctgctctgccactttgggtgtataaatgctttctcaattaagtctgttaacctctgagcctgaattttcccacagctagaagcagtagagcaaagatttcaatctgagttgtctgactcctgatctactttttgtccagttgtcatgtggctcagatgagttccatattaataaataaaaatactgctggagatagaagtcactcaagtgctgtatcttccttctgcatttaagaaacttattatccaaatttaagacactttgaatttattttttgtccctctctgtgaaaagtaaaaatgccattctatgatatattccaacaaagaagaaatgagggtaacatttgttttaaaaggtttttaaaatttatctctacctcaatttttaaatctttcctattgtgtattactttctccctaaaataagggagttatacttaagtatttcctaatgggctttttacatacctcgtaacttttcttgtacttggttttgattttccagcagaggtggtattagatgtgaaccttgaagcagagggcattggtgggaactgggattggaaaagaaggttatagccagacattgaagggcctttataccaagctaaagtttggatgttaacttcagaatatcagagagctaatagaggctttaagtcaagagtgtaacatatttttaaagattgtaattaataaaaattttattataaaatatttccacatataaggaattccaaagagtaatataatatacccctatgtatctatcacccagcaaaaaaaaaaaaaacaaaaaaaaaca

SEQ ID NO: 219260 - DNA, 332 bp, Homo sapiens
  misc_feature (16)..(17): n is a, c, g, or t
  misc_feature (26)..(26): n is a, c, g, or t
tgcatgctgtaccccnncgatgttantggatatcgtcgtaccacgcgctccggaacttgaagcagagggcattggtgggaactgggattggaaaagaaggttatagccagacattgaagggcctttataccaagctaaagtttggatgttaacttcagaatatcagagagctaatagaggctttaagtcaagagtgtaacatatttttaaagattgtaattaataaaaattttattataaaatatttccacatataaggaattccaaagagtaatataatatacccctatgtatctatcacccagcaaaaaaaaaaaaaacaaaaaaaaaca

SEQ ID NO: 219261 - DNA, 217 bp, Homo sapiens
ggatggcgtgcttcagaactcccccataccataagcagtagattggatgatgctagccttgaatcagcagtcgtcttttttgctctccatgggtaagaagtaaaattatcgcctttgaaaataatatatgcacatagcagcgaaatcttagaaacacccgaatgtgaaattgactttctgctgaataagtagcagattgtggagagagtagtgggga

SEQ ID NO: 219262 - DNA, 700 bp, Homo sapiens
gagagaccaggagagtgtgttggatctccagttaataccctggtctgtgccacagcattgggaggtctgtcacagcgcatgaatgtgggcactggcctagccatcagcatagttcttgcagggtcaataaaacctccagagcaggttttgggtgttcttttttttttttttttttaaactgcggtattcccagctctgtgggtgggtttctgattaaacaagatacctgtttgtacttgcatctctaccagggcaggagatggtgacatgctaggggacccagcaaagggtggcattgctcactcgcccttgggtatctgtgctgtgaccatagcctttcgttgagccaagaaggtgctagacagatagcccttgcagaatggtcttcttattagagacttctcttagagattcgactggcatctgcagccccacagcaggctggaccatcagggaagtccctgctcaaagccctggcctgttccttgagagaaggctggctatgacttgataggaaccctgctgctccctatgacacctgcctgcccatggtccatattaagtaaatttggactctgatttttctgacttacagattcagctgaaccatttctctgagtggggccagatgaagatttgccactttagaagttcttctgtcacaaaagggagctataatttgttgagagtctattaggtt

SEQ ID NO: 219263 - DNA, 349 bp, Homo sapiens
gatgtgtcttctaggggcatgagagatggagaaagaaagcctcagctaccatgagactttgttcagtgctatgatctgaatgtgtttctgccaaattcctatgctgaaatcctaactcccaagaagatggtactacaagatgattggaaggtgattaggtcatgaaggctctgcccttatgggattagtgccctcataaaaggggcaccagagagctaactgccttaccctttctccatgtgaggacggaatgagagggcgccctcatccaaacactgaatctgctggtgccttgattttggactctacagccttcagaactgtgataaataaatttctgttttttata

SEQ ID NO: 219264 - DNA, 343 bp, Homo sapiens
aattttcattggctctctggcatttttaagggcccaggggaacaaagctcaaatggatgcatttcagaggtggtgacgggttgaaatggaaattattgggaaaaggggagaccaagaagtgtccctaaaattatgtcacatcaggtgctacctccttcatgtcctccctgtgctctctctcccacctttgactgtcacttgcccactctccttcttttctttctttctttccttttttttttttttgagacggagtctcgctctatcacccagggtggagttgcagtgagctgagatcgcaccactgcgttccagcctgggggacagagcaagactctctcta

SEQ ID NO: 219265 - DNA, 110 bp, Homo sapiens
tgtgtcacactggctccctagatgctcagcaatttaataccagccttttgagagaagaaaagaaacattacattaaagatgtacaaaacctctaatatgcatcccagttc

SEQ ID NO: 219266 - DNA, 352 bp, Homo sapiens
ccgtggtttgttgaatgaggatgcggaactcatggatgcagaagaccagctgtgcttagaaaacatgcctcatggccgggtgcagtggcttacacctgtaatcccagcactttgggaggccgaggtgggcggatcacaagatcaggagatcaagaccatcctggccatctggtgaaaccccgtctctactcaaaatacaaaaattagctgggcgtggtggtgcaagcctgtagtcccagctactcgggaggctgaggcaagagaatcgcttgaacccagaaggcggaggttgcagtgagccgagatcatgccactgcactccagcctggcgacaaagcgagcctccgtctca

SEQ ID NO: 219267 - DNA, 501 bp, Homo sapiens
gtaggcaaagtgctggaagctaagctgaaataaaattctagcaagtggatggtcaggaaatgcttggcaagtgattcatgaggaaaggctgtaacgtttggcaaccaagggataggttaccagtgttatctaaaaatgcaattttgtttattgggatccataatgtggtgacatgaacactgagcttgcactggatgacctaagtgggagttgggatcctgtcactttgccctgtatcctatagagcaaaccactcaccatctcagcctcaggttccttatcagaaaatcaggaaatgtacctctttgcaagtgtttttgaacatcagctaagatataatgtgtttggaatggtttatgagttctgaagcattatgcaaacattatgtaaatattagaatatattctatctaatatttaaaagatattagaatatattccatctaatatttaaaagatattagaatttatattctagttaatacttataaaagctaggttg

SEQ ID NO: 219268 - DNA, 494 bp, Homo sapiens
ttcatgtgagctataccatgtatgtttgtactttcacttattattggacatttctatcattccgcgtttgggctattatgaagaaactatcatgagcatccatacgtagcaggccaggtctcactaacacaggcctccctaacaactgtttcagtagcgactgagtggttcaattaaatattaagaggaaaaaaaaaaaagaagccagtgcccttatacaaaggctggaatgtaacaaaagcccaccaagagttttgcctaggttttccctgggccttaaagcatgacgaaataacgaaggcattcttaacaggagccatttagtattaaacgagttttacggggggtctgaagaaactccccaggcctccacaaacaagtttatgggagatctgaagggactctccaaacctctgtgatttagcaggagacaagataagggcccccagcacctagacccatttagattaactgaatttaactgaggttccaga

SEQ ID NO: 219269 - DNA, 243 bp, Homo sapiens
aaagtttgtgcatgttcctatccctaatagtaaaccttggttcttagaacccctcagctcaacttcagtcgagtgagtatttttccctttctttagtctttagttttcggtttccagttgctttactgagacaaagaccctagaagttgaagagtccagggtttactgcactttccctgtcattccccctgtactttgtattccaaattactttcatcacggaaaggtgaaagtctaagtctt

SEQ ID NO: 219270 - DNA, 291 bp, Homo sapiens
ggcacccccgcccagggcctgacagcgcccgcggcccgctttctgcctcgcgttgcgcccagagcacggatgcgagcgagcacacacgcgcgcgcggacacacacacacacacacacagggttacacgagccacgagcaggcgcgcaaggctcggcggacccactgagactcggacgcaaacggggcgctttgcctctccctggcttgtgcacaaacttacaaacacactttgcactttaaagttgttccaaacccccatcctagggtaggctaataaaaatgggtgtgca

SEQ ID NO: 219271 - DNA, 330 bp, Homo sapiens
tgtctatggcttcctcgggccagacttctgcttcttgcatgtatttatgctgtcacccaaatgtgtacacttacttttatagacagcatcatcatttccccaaagataatttagaattgcggtagccactatgaggaatttctgatatgcacaaaagtattcactttagaatgcaaagtgaacacaattccaaacatccagtggtcttcttttttttcattagcatgagcaagcatacaaaagaaacaggatcccaaatttttttttttttttttggagacagtctcagtctccaggctggagtacagagcgagatctcagtctcaaaaa

SEQ ID NO: 219272 - DNA, 460 bp, Homo sapiens
tacttcccccggccaggaggctgtgttagtgggactgggctagaatggtcagaactgggcctgggctcagaggggagcatcaggggatgaaagaccctcctctgaagtttccagtaagtggagccttggacagaaagtcctccagcatgaccctgagagggctgctggaggaaggctgtcctcgtacccagaggcatgtggacggtggtgatcacatctggtctgatttctaaacagagtacagctcatttctcttgagacccccacttgagcgctccctcctcactcccaccccagccaggactggtccagggatcagcatgggaggccacgccagcactgcgagatgatggggtaggcctttgaagggccagacacggcaataagaaacctgaaccaggagggcagcaggggtgttggggttggaaaaacattttcaggcgtatttctgctataagag

SEQ ID NO: 219273 - DNA, 455 bp, Homo sapiens
agaccttaaaaaggagactgatggatatgttgactggctttgctgttttcaccaggaaaacagatctgaccaccagagtccagagcagatcaccgtgcctgtcctgccttcattctggttgtctggtgggccaaccagtcttatctaaaagagtgatgaagagattgtagcccacactttgcagatttgctcttgtgcttttaactttcataaggagattttagtagagtggggagagtatgacataactggtgaagccatgggctttggcttcacagaaactgagatttgaatcctagttgtgacttgaccaagtgacttactctctctaagcctcaattatttctaaaatggggatgttagtatctatttcaagggtattttcctgactatatgagataatgtatatatataagccctgtgtctggcacaaaacagtagtccagtgaattgtt

SEQ ID NO: 219274 - DNA, 374 bp, Homo sapiens
gaagcttcagactagcagagctgtgggatcttcccattcgtttcctatcaaatttgctcattttactggcaacactgctgagtgtgggcttttgcccgctgcctcaaatcaggtctgtcccctctggaagtgaaactgctggcttttgcagccttcaccctgtaccaactgagctatgtgaagggacattcgaacagtcccagacagtgaagctgctatctcctactttcttagctaacatatagcagctgttcatagatcagtacttctcactttgtttgcctttggttcatttccagatttccaccaaaatgattgtttttgacaatgttgttcagttttatagtagctttttgagagaggattttctgacc

SEQ ID NO: 219275 - DNA, 453 bp, Homo sapiens
cttcagcgatcctcttgttgacgctttaacagaggaggagtacagcctcctgagtagccgagtaggtctgggctaacttgcctggctcgaaacccaaatcttaagtaggactagggaaatagaaccagagagggatggagacctcttttgggtgtcagaagcgctaagttttacttttagctcctctgatgacttgctatctaaacttgggaaaaaccactgccatttacagggtctcaatattttcatctgtaaaataccctcccctttactctgccacagaaaccttgtcatgatttgtgcctagctggatttagatgtttaagagatacggatcacaaggttccttcagtcttcggactaagcaatgctcccaggggcctagaaggccctatccacagtgttcaacatcctcttccctatatcccatcccctatccttgaaagaaaaaaa

SEQ ID NO: 219276 - DNA, 377 bp, Homo sapiens
agtattttgaaaatgcgaggaatggcggtagcttggggtcatacattgactcatggcctctacccgctgagtacaggaccattttgtagatgaactaaagtggtggtgtagctggcactgccatggttctcaccttctgctgcagagcaggcacacctacagctgcagggtcaggacagtcctcattcacgcggtcatctcatagcttctttgggtgggtcaacctcttttgttcagtatgtgtcagtggtagagaccttgttgcattggacctccgaccgtagccccaaatgagggatccgtagtgtttttactatacctcagcatggaatgtgcattcgaccttaataattcccccgtgaattatgaattaaaaa

SEQ ID NO: 219277 - DNA, 476 bp, Homo sapiens
ctacaaaaggaattaatccctgaaaagcaagatggtatcacattgatttttaggaattctcataatccagtggttctgcaaatatttcttataattcttcatcctttctctcttccactctctcatagatttttctcccttctctgatatgcatgtgccttctagttgacttttgtaaagtagaaagaaataataaattcttggatcacgcctgaaatcccaacactttgggaggccaaggcaggtggatcacctgaggtcaggaggtcaagatcagcctggccaacgtggtgaaaccgcatctctactaaaaatacaaaaaaaaaaaaaaattagccaggcgtggtggcacacacctgtagtcccagctactcatgaggctgaagcaagagaatcgcttaaaccctggaggcagaggttgcagtaagccaagattgcaccactgcactccagcctaggtgacagagtgagactcc

SEQ ID NO: 219278 - DNA, 447 bp, Homo sapiens
ggctggcgtgcgctccggccaggctgcctctcaggtccacgctggagaaggagtggtgaggtgcgctcgccccggctgcgtgcggtgattcgggaaatccccgcacttcgctggagaaatagcgacgctctcggaagtgtgagtcggtcactgcttggggtccgtaccctttgggcagacgtggaccgcgccccggcgacctgggttgagtggacagacgggacccggcttacccatgggccaagccctgccacttaccgaggcctgccctgctgtgctttccagggcggcaaccttgagcttgggggtggggagaacggggcctgacttctagaattgcccctggggaggtgggaagcggaggtttggcccggtggcgcaggaagcccctgttcctctcccaaacaccatttcattaaagatggatctttgtggatgtgttcccaa

SEQ ID NO: 219279 - DNA, 424 bp, Homo sapiens
actgttttatgatcctcagcagactgttatattattttatagccataccttttatttgctgagtaattgtactcaataattgtttgtaattgaatgaaacaattcatcagatgttgggcactgaatggctttggattatttccaaaaatttaaaggataaagatttgctgccttcaaagctatgtacaaaaatatgatagaatgctagcgggatatttgtttaaaatacaacctttattacattggggcctgctcataatatatatgtggcacattttatttaaaatattaaagttcctggtgggacatgtccccataatcccagcactttgggaggccgaggtgggggtgggaggatcactagaggccaagagtttgagaccagcctgggcaacatagtgagataccatttctacaaaacata

SEQ ID NO: 219280 - DNA, 733 bp, Homo sapiens
tatttttattgcttcggtgaagatcttcttggccatgtgtacagaccaagagttgtagtaataggtattgtttgttgcaatatttattatcatctgtttttatcaacctccatttttctctatgattttttttttccaaaatagtttctaaaacttgctttgtatgttttacagaattaatacacctttaaaagctggagctctacaaagtgcttgtatcttaatttagtgttgattcctcccaaatacttttaatctccctatgtttgtatcagtgtagcacataatttgtttacataaaactttgtgtttacaaaacactttcacgtttgttgcagtatttggtccttacaacagctgtaaagaggatatgagtgggttttattgtcctcaattttcagaggaggcagctggaagctgaggaagctctgtgactgggcccaggccacagaactaccacatgcacgagctgggtagaatccatgcctttcaagtcccagcccagaactctctgtgctctgcaacactgtctcatacacagtgaggggcacgcactttgggaagagaccttgtcgatgctgcccacgtgtgcccagcccctctcactgtccctccctggggaagactataccaagacctctgcccagcagagagaatctcagcttctgatggaatcaatctagctctctagctctgtctctctctctctccccttttttttttttttccagat

SEQ ID NO: 219281 - DNA, 385 bp, Homo sapiens
ctgaggcaggagaatggcttgaacccgggaggcagaggttgccgtgagccaagataatgccattgcactccagcctgggcaacaagagcgaaactccgtctcaaaaaaaaaaaaaaaaaagaagaagaatgctgcctccatgacacaaacacagaagaagacataccgatgcatacatcaagaatacaaagaagaaaatcatcagatccaggaaaatgcaattcaggaagcagaaaatagaaaattgatgctgtgaatttttatccaggagagttttacctccttgcttgaaacatttgtccgtgcatccactttgccctaaaatgatagtcatgtaataatgtgtgtgttatcttttgaacaaataaaatcagtgcaatttgga

SEQ ID NO: 219282 - DNA, 434 bp, Homo sapiens
ctaagtaacaaaatccagcagctaccctaatgtcagagtagatacccgtaagaggaggcagcatcttacagggcaggccctggacaaatgagtttgttaccaagcacttaagagagaatgtgcatcaaagaagcatgcattgcatcagaacagaccatggtgtatttcacctttcagtatcttttgactcatgagttatttagaatattttaaaacacttcaacactaaggagttttttctctttcatgaggtgatctttgtcatcaatttatagttttgcttctgcttgagaagataatgaaagctgcagagttctttttctatcagtaggttgagaagaaaggtaacttttctcagggacattatgagtgtgatgtgttggtgcagcccctgaagggaaatggtgtggaggatgtttggaccacagcctggg

SEQ ID NO: 219283 - DNA, 501 bp, Homo sapiens
accaaaattacactaaggctatggagcagaggatgggctgcaatgaaggattatagtatttatattttctatgctatacaatctattactatgtttttaaactaacaggcactactttttaaaatttaagtttaaatataattccaacaaaaacagatgtatatattattgcctattatgggaaattacccttactatagtaacttaccacacacaaaaaaaatttattctgaaccaaaaaagacatcacatacagaaaccccaactccaccccttttccccaagctcctagaaccatcaactgttcatggtaagagactttgctgtttcagcaggttcctttaaaagcatatgatgtttagcctgggcaacaaactgaggccctgcctgtataaaaaaaaattagccagctacattggaggctgaggcaggaggagcacttgagcccaggaggtcaaggctgcagtgacccgaaatcgtagcactgtactccagcgtgag

SEQ ID NO: 219284 - DNA, 136 bp, Homo sapiens
  misc_feature (10)..(10): n is a, c, g, or t
  misc_feature (12)..(12): n is a, c, g, or t
gagcggccgncngggcaggtacgcgggcatgcccagtcacaagtataattctattctagaaatgaactatttaatgtcaggaaatctagcaacataacccattaaataacaattaaatagaaaaatattttggtta

SEQ ID NO: 219285 - DNA, 115 bp, Homo sapiens
tctcggggagtgacatccctcccatccaaacagcatcatgttacatccagcttgctgtcagcatttgttgagcttctcaagggccaagatccttccagattatacaagtatatat

SEQ ID NO: 219286 - DNA, 516 bp, Homo sapiens
ggaggccaaggtgggtggatcacttgaggtcaggagttagagaccagcctggctaacatggtgaaacccctgtctctattaaaaatacaaaaattagccaggtatggtggcacatgtctgtaatacaagccactcaggaggctgaggcatgaaaatcacttgaattgaggaggcaaaggttgtagtgagctgagatcatgccactgtactccagcctcggtgacagagcgagactccatctcaaaaaaaattacaaattcttgggctccacccctgtgtctactgtatcagaatctgtattagtgaaatctccaggtgattttatatacatattgaggtttgaaaaacactgctgtaaaaccttaaatgccaggctaagatgttaagcctttattctgtggtccatgtgtgttatagatctggtttctagaaagtaaatctaatagcagcaccaaccaacagattggaaagtggaaagcagaaagcagggggctagataatagatgctttccacaa

SEQ ID NO: 219287 - DNA, 319 bp, Homo sapiens
tatgaaagcctgcttctacaaattcatctcttgttctcctttaaaatattaaagccaaagcaaccttttcagcaagcagatctcctgccaattccaaaggctctacttctaactttcaaactagcaaggttggcagcctcatcctctacttccaattccctgaacccaccaacaacagaacagcatctagtcctggctggagtgcagtggcacaatcatggtttactgcagtctcaacctcctgggctcaagtgatcctcctgcctcagcctcccgagtagctgggactacaggcatgcaccaccatgcccagctaatt

SEQ ID NO: 219288 - DNA, 475 bp, Homo sapiens
tgagagctggccatagagtgcattagctgagagatcctggctcctcggagtgtggcccacagagcagcagcctcacagcacctgggcaccagcccacatctactgagtcagaatctgaactttaacaagaccctgactccaggggcacatgttagagtccaagatgcccttttgaggcccacgtttgaactccagcttcaaatcctggcttggccatttagtggctgtgatttcggctgttacttaattactctgtcaagaatcgattcaggttttgtgggcctaaatcttatacaatctggagtattttccttaagaaaagaaggatataaaattacaaatacaaaattaggtacaaaagtgatgtttagaatgtaaatacttcacggcaaattacaaatattgaagagctggaaagtaccgcaaaaacagtaaacaataaagaaaaatcatttcatgtttttatcaaccaata

SEQ ID NO: 219289 - DNA, 544 bp, Homo sapiens
tgagatggagttttacttttgtcgcccaggctggattgcaatggcatgatctcagctcactgcaacctctgcctcctgggttcaagcgattctcctgcctcagctgcctgagtagctgggactacaggcttgcaccaccaccccttgataatttttatatttttagtagagaaaggattttgtcatgttggccaggctggtctcgaactcctgacctcaggtgatctgcccaactcggcctcccaaagtgccaggattacaagcatgagccacagtgcccggcctgtgcacttcttttcacatttcacttttgggcaaactcaatgaagaagtagctcatgggctattttcttcttgtaggagttgtgcatatttccagcattttcctggctttgcagagaagccagaagcagcggtgcacacaggatgagttgctcctcaagccgcccttgcctgggctgatttgtgttccctctcgcatacaccaaggctagtgaggcggaggatggcaattgctggctgtgctgcttggggaagcatccca

SEQ ID NO: 219290 - DNA, 582 bp, Homo sapiens
gtccagagtcacataattcatatatagaaaaaccttaagactccacccaaaacttttagtactgataaatatattcagataaagttgcagaatacaaaatcaacaaacacaaatccatagcatttctatgcaacaataacaaactacctaaaaaagaaattaagaaagcattcccattcacaatagctacaaacctccacccctaggaatacagctaaaaaaggacatgaaagacctcttcgatgagaactaaaaaccacacagggtggggaaagacaaacaccgtggcctttcagggggtggaggctaaggggagggagagcattgggacaaatacctaaagcatgcaggatttaaaacctagatgatgggttgataggtgcagcaaaccaccatggcacatgtatacctatgtaacaaacctgaacgctctgcacatgcatcccggaatttaaagtcaaataaaattaaaaaacaaacaaacaaaaacaagctgccatgtatttcaaccaacaaaaagtcattatgcttaactgggaaaaatatatttcttccaaaattttaaagcaaatttatcaagct

SEQ ID NO: 219291 - DNA, 189 bp, Homo sapiens
gggtggtcttgaactcctaagctcaggcgatccgcccactttagcctcccaaagtgctaggattacaggcataagccaccacacccggcccaggaaatatttacaaaattcgtggtagtaatcttcataatcttcccagttgggtttgagtaagaattcattacctaggtgttgcaacagatactctaa

SEQ ID NO: 219292 - DNA, 307 bp, Homo sapiens
ggtcaaaaaactaacatctactgcattaattatattagaacatgaatttaaactttattaatcataatggtatctacatagaagtgaaaaatagaggtacatatatagtcagaagtagtgttatctggtccatgtttggcaagggttaggaaacgtttttggaaaagggccacataggcaatattttaggcttttcaagccatatgctctgttgtaactattcaactctgcccttgtagcacaaaagcagctgatagtctgtaaacaaataagcatgattgcactccaagaaaactttatggacaca

SEQ ID NO: 219293 - DNA, 834 bp, Homo sapiens
ctcgaggccttttctccaggggcacctgttcagtgccacctttctcagaacattcgtttctcagcccgttcatggctagtattcttttcaaacctgagaaaccaaaccccagatctagagggagccaatttttaaatccatagctttctaacttttctgggctatatcttcacagcaagaaacacatgcatataaatatttatatgaaaggaaataaatttggggaccagaatttattcttaaacatgatgaagttgggtttgtcttctattctttaagaaagttgctagtcagaacctgctaaatgtttttcactttgcagtttgaaagccactgccttaaatgatccttggcccagtttgattctagatgagcatttcctttcttgctggcacgaaatatgtagtttcaggacagtgtggggtgagaggtgagaatcagaattataggttcaaatgggtttgaattcaagctgtgtgcttcagagcgatttatgatgtgatcctctatttcctcatttgtgaaaaggggaaacttcagggggatcggttttctgagaattaagggagaatcagatatgtgactttctcacatgtgttacaaacactcctgcagccacaaaccaccactgcaaaaggcactctcattgccaaatttactaagaaaaggtgtgtaagactcccaggttttaattttggaagattggcatcaagggagcaggtgtgagggttcatccccatcaccaggggccctgcattttggagtgaagaccaggccccagctcttataccagctccaattatctaattgtaatcaaagtcctattagaaaatg

SEQ ID NO: 219294 - DNA, 318 bp, Homo sapiens
gtatcttttacccattttcccttagtgttaacatcttgcaaaaactataatacagtatcacaaccgggatattgagatttttaaggtcaagatgtgcagcatttccatcaccacacttatgcactttatttctattattgttacattgtaatatataatgaaataattgtacaactcaccataatgtagaatcagtgggagccctgagcttgttttcctgcaactagatggtcccagctgggggtgacgggagacggtgacagatcatcaggcattagattctcatgaggagcatgcaacctagatccctcacatgcg

SEQ ID NO: 219295 - DNA, 421 bp, Homo sapiens
ggtgacataattctccgagcaaagagggctgctctccttaaccccacagaggcgttcttttagcctaaacaaatacgactgctgaaattgtaaataaaccaagaccattacgggaaattatatagacttttgccgatgaatacacaaaggcagaatatcaaacagacatcccttcttaaaaaatgtgaataaaacctgcccgattgtcatgcacttaaagaagaagtactgtggtaattgggagggttgatgtttgaagcagaaaattaaatgacccttttagtttgagatcaaaatggtgggtgcaagatgaagaaaagggggggcttattttgaaaactgctctgtatcaacagtgagaaacatgaatggataaaaaaaattacacagatttaaataaacttcagtatggcttaggtta

SEQ ID NO: 219296 - DNA, 311 bp, Homo sapiens
taagcccaaagctagctttgctcacctgattgctaattagggtaaaggccttgtttcataaaccaaatttcccattgtgactattatgagctataataatgattgataacaggatgtgacgtaaacctacactcttaaacacaggaacaaagaaacacacctaagtaatcacagggagataattagtgcaacgaaggctcccttggaagcttctgacccaataagaatgagtttgagatgacttttctgtctaacccagtggtttatgcactttcattctcccttcctcaggctttcaatcagactacttt

SEQ ID NO: 219297 - DNA, 445 bp, Homo sapiens
agtgagactgtctccaaaaaaaaaaaaaaaatgatggaacacaggttcttgtcctggaaaatctgcctttcctctgctcgggatggctgggttcagacgcgagggtgcctgtggtccctggcagcctgctgagtgcctgccgtgtacgggccccacaccctgcggctcacgcgcatcccaggtcccctctcatccactctgagacgcaggcggaggacaccgacaaggtgttcagatgagggagcagcggggctggggctgggacagggggtggggggctggcctccaggtggcagctactgatggggcagctaccggagtcaagccctttgaaatgaggtctttgtgtgggggagctgcagctgggacccccggaccccgccgccccccggggcgccccgacgaggacgagcaactctgcgcctgggtgtgacccggcggccgc

SEQ ID NO: 219298 - DNA, 406 bp, Homo sapiens
gacagtcggtagggcctgctgagggccaggcacagtgcaggggcgagcgcccaaaggtagggatcagccgctggtctctgtgcccaggggttcaaggcctgggaggagacaggctttgaagacttataaaacagttgtgggtgctaatttagacatattccagacatagtcacagggcagtcccgaccagaggagtttaagtcagtgttgttacaatgctttatttaattaatattatttttggaaggctgtgtgcacctggaggaggccagcggctgtgtctgttttgttcactgctctatcactcccacctgggataactcttggcaaatatgatgacagcacccattgacgaggtgcttaagatatataaggttggtgcaaagtatttatacggtgcaccata

SEQ ID NO: 219299 - DNA, 365 bp, Homo sapiens
tcagctgagatgccctctcccagagccaaactggcttccctcattctcacagggcctgaaaatcctcctgcagcaggacagaagggtccgcaagtgggagccctgagcttgagtctcacagtaaagggaagagggttgctgaggcccaagacagttctgggtcctgaggtctgctaagacatggcagggagctttgccccaggtaccggacttgctaagaaaaaatggggcaggcttctttgttgctaagcaggaaagctaagaaagcttataaagacctacacataaaatcaactttggtaaatgctttcagaaattgtcctatttagtgagaccctatctgataaagaaaggaaggaaagaaa

SEQ ID NO: 219300 - DNA, 548 bp, Homo sapiens
agtaggatagagtcatccagtacccctgggccacttagaaagcttaagaaatggttttggaaaggaacttcagtattttacaagaagtagagggattgggtgccggatggaccaaaatagcagtgcccactgcacatggcctaagtgtgtagcccacatatggttctgttattccaatgaataatagagtcattctttacttcacttatgcttctggcttgagtggcagtggcagaagctgtggtgtggcagggaaggggttatctcaccttcagattggaggagatatggattgtttgaatttgaaccttcagtgaagagttgactaaaatggtcctttttatgtggctttggatcctacagagtgagacacttggttctctggttttcacttgaatgacatttgacatttgtaggacagaaaactttatttcattagtataaatgagaaattatgatccactcagagtgatccaggctatttttatctatagtctccagaatggaaacttggcttattcagcactggctatctctgatggttaatg

SEQ ID NO: 219301 - DNA, 357 bp, Homo sapiens
ctcctcctggagtggcaggaatgactagtgacctccaccgacttcctccctgtcgcttgcatgattcctctgcttctacaccttcccctgtctactcaaactccggtttatctagaagattatgagtgcttttaaaaagatccaagataaaacttcaaaagaagtggcccataaaatctatacttttctcttccaaaaggtgatggcatctctcctacaaaagaggatgtaattcactcagatgtacaagatgaactggttcattctgcttgttacgtatgcatctaattagtttgaatctatgcagtaccaccaccttaagatgtttccaaaggacaactctaaactcttactatt

SEQ ID NO: 219302 - DNA, 384 bp, Homo sapiens
gggggaaaataaaacagaagatagaaagtggatgggacgagggttagggtcataactttagctctgagaaggtggcttttgggagacatggatggtgatctagggggacagctttgtggacagagaggactgcaagaatgatcaacccagaggggctggagtgtggttagtgatgaatcagcaggggccaaatttgtggctgtggttaggagtttggattttacttttgaattctgaacagtgggaagtcactgcatgggaacttttcctggggtctaggagaatatttgagtccacactaaaagacagaacaggacattacgaagagcggctggaataggctctccttgtcctgggaggtttttgaggccagccagagtattg

SEQ ID NO: 219303 - DNA, 461 bp, Homo sapiens
cactattttggtggtaaatgtgtctctgaattactctcccttgattcctgagggaataactctccatggttctcttgttgggtttgagaaaaaatgattgttctagaaggatgtgttctttttagcagacattgaagttgggtaagctatagagaggatatcctatagtcatagaacaaagaaagatatattcttgatagggaaatgtgcactggattgaaatttgaaaggcgttcattaagctggcattgattttacagctgtttttcaaccagtgttagttagccaccacttatatactgagtcattgagagaggtgctgtgtattcagagtgaattatacatggcccctcctttcaagagggttacagtataagaccagaggtaagatatgcccatagcaatgatacaaaataaaaagtcttagattctaagaaaagcaaaattactaaaggaatttg

SEQ ID NO: 219304 - DNA, 230 bp, Homo sapiens
actggtcatgtaggcttttttatagttctaaactaaatactacatagaactttgtgactgccctgtttatttagctttagaacttcatgtgctagttcagtctgtgaagattcattattgatcagatatatacaatctgtaatttggaatattcattcatatttagttgaactttaacaagtcacaagttgttctccatagcaaaccgtaaaagaataaaattaaagtta

SEQ ID NO: 219305 - DNA, 398 bp, Homo sapiens
aacagaaagatgactatttttagcttttctttctgctggtgaggtggaatagcaaatatttttagagcaattgaaagtacagcctcttagattagctcagtgtttctgtcatcagaatctcaattattttatgtatctagattttttttttacttccaatgttttgagtttatgtaaattgcaacatgattcgtctttttatttttgatctagttcgtttctctgtggaacaatataaaagatgaaatttctaaaaccttaacttttctttctgcactttttatgtattttgagttgtaattatattctgcttattgtgggcagttctcttctttcttggagatgaaactttgataattaatacttacggggagatggtgttacaaatcttctctcat

SEQ ID NO: 219306 - DNA, 341 bp, Homo sapiens
atttgtaaggctgcagtgcatgccgagtgtggtgcgtatgtaagtgttgtgtgtggtgtgtatgtatgtgttgtgtgtggtgtgttgtgtcttgtgtatgtatgtgttgtgtgtgtatgtgactactataattgaacctctactgtctcaggcacagcgctaggagttacatgtggcttcattccacttccacctccaccctccgaggcaggcaatgtttattttttacagatgggaaaactgaggctcagggaggatgaaaactatctcaacctaagtcgcaagtgtcgatcactgaaagaacttgggtgcactgcagcctgcctggctgaaagctcgtg

SEQ ID NO: 219307 - DNA, 548 bp, Homo sapiens
cagtccagcccccatcacgtgctccgttagcaccctgtacacctctttcctgcacaaatcccaggaatagataaataattatctgctagaacacacgtttcacaggacagggatgtatggggtgcctggtcagcacttgcagcagagtgggtgctgtatgttgctggaatgaatgaatggaatgaattgagtaaaattttgtcatggctggtcctgtggggtcaggagatcgctgtttccattttatagttaagaaacttcatttccacctctttacccatttctacttgcctttcaggctactgccaaaatgttattcccttaggaaggcaaggactaaagctttagattgggtcagctactccccacctccaccatggttaaacccccatgtttccaagatttgctctgattcccttgtagatatattcatctgctgggcactgttaatttggatttatgacctcttaactcctaacaccaccacttacataatgtgcagggcccagtgcaaaatggaaataaaataaaattttgtttaaaaagta

SEQ ID NO: 219308 - DNA, 473 bp, Homo sapiens
ttccacaccaattttttcaacaaaagaaactacggttggtgagaatgtggagaaattggaactgttgcgcactgttggtgggaatgtgaaatgatgcagccatgtggaaaacagtatggagagtcctccaaaaattaaaactagaactaccatttgatcaagtatgctaaagagttgtaagcagggtctcaaaaagatagtagcacattactcacaatagccaagtagtaaaaggagcccaaatgttcacccacaaacaggtaaacagaatgtggtgtgtatactcacaatggaatatttttggttttttccttttttaaaaatcaatggaagtgctaaccaaacaatggaatattatatagtgtttaaaaagaaggaagttctaacacttggtacacatgaatggatgtcaaggacattatgcttagtgaaatgaaccagccataaaaggacatatactgtatgatcccatt

SEQ ID NO: 219309 - DNA, 468 bp, Homo sapiens
ttgggtagaggaattattcagtttaggatctggtctagagatatacagatttacatttactgtttggccttttttacatggttgaataccatatgaattttaaatattagtaaaatatccaaaattacttttgatagaggaaaatgtattgcactatatattcttctttgaatagagaactttgtcaagtaagagaataaaaaatacaggatgatttctattaaacatacagtattcaaaagctatgtgagggaatccagctagtgtgattatgtcaaaagggaagatagctggtctgaaggtaatgagttatctcaactgattggtcatggccaattacagacagaactccttattttacttccccaccccccgactactgcacttgactagtcaaaaaataaaacaaacaccaaaaccaaactaaagggaagacagtcttttcctagcttggcattagttggatgg

SEQ ID NO: 219310 - DNA, 316 bp, Homo sapiens
tgacatgtgtctgtagtttcagctactcaggaggctgagattggaggattttttgagcttgggaggcatgggttgcagtgagctaagatcatgccactgcactccagcctgggtgacaagagtgagaccctgtctcaaaaaaactccaaaaattatctgggcatggtggcacatgccgggagtcctagctacttgattggctgaagtggaaggttggcttgagcccaggagttggaggctgcagtgagctatgactgtgtcattgcattccagcccaggtgacagagcaagactctgcctgtctctaaaaaaaaaa

SEQ ID NO: 219311 - DNA, 376 bp, Homo sapiens
accaccccctccctgctgtaacagctttacccgcagaaactgttcttccctgcgctcttctaattagctaattacatttagcttagactgtgcggccgaccccaaccaataggggaatgaaacagcaactaaggccaacagggttagggattaaaaaccctctccattaaaaatgctctccattgtgtgatgtgctctcgccattgctccacccacaagatacactcttctatacaagtaaatttgcctagctgagaaaacttatattcaaatgctatttcttttgtggcactaaaaatttgttccaacaatagatttctgtggttttaacctcacttatttaaaattaaatggatttgtaagccatttggtctgt

SEQ ID NO: 219312 - DNA, 527 bp, Homo sapiens
taaaatgactaccttcggtccagaaaaattgatagaaagaaaatgcaaaaatcaattacaatctgaaagtactaaataaaaaagtaaaagaacaaattgaaaaacacaaaagaaaaaaactgaaactgataccaattatgttaaaaataatgtaaagcagtgaaaataaaaaatgaaaaacaaaaaaaaagacaaaagaatcagactgagaagaagcaatgacaatgaacgggagtggcaaagagacaccagtgacatccccgtgaaaaaacacacaaccaagaagctttgtgatgatgggatcctttccgagtgtaagtttttaagcagtttgaccaagaaagctccagtttcacaccaactgctggggcctatctgataacagacttcctgcattcattctcaaaggaacgcccaagttacccaatcaatggcatgatgacccaggcctggagacaaaaaagcatgcccatcgcaagtggtgattcagagcctgtatgggagagtttgtgggcagtgttatgcct

SEQ ID NO: 219313 - DNA, 790 bp, Homo sapiens
ctccttgctcgcctgatatagctgagcacacagagaaccagatggccctcaggcccggacagtgaggctggggtacctcttaggcacttttgcctcctcagcctgtggctgatgaacattagagggactgtcagccctttgaataccaggtcaaagcagaaattttattatcctaaactcctcccatgttattttggggctagactttttcaatttaatgaagcatagcttatatctcttgtgtcaaggtcagtcatctcaaagtgaattttccaagtgagctgtatctgtactgatgtcaatgtgacaaaggcagtgctttctgacaggaacttactaacttgctaataagtactaacttgctagctaatcaggaccagaagtcagctcactggtttctcatccataaagagtcagcattcccattccataaaaagtcagcatttcttttgaaggtcaggacctcctcccttaccagaggtgctttctgagcatggggctgagaaccagcagtctagcctgagatgctttccaatgtcaaaagaggcagaaagctccctaatggtacctgggcccacgaactggtgactccacctaccgcctctttgctactgctgctcacagagcctgccatgccatctgtggtctctcattcccacattttctcaaacctgtcactttccattttgggacttggactttgaggagatgtacatgctagggcacatcttctcattgaatgataagatttgggcgcaagtggcttcctttaagcatgctcaccctggct

SEQ ID NO: 219314 - DNA, 302 bp, Homo sapiens
caaggagacttattcccccgcccctttttttctcacagatttcttgtatgtctccctcgccccgcccgcaccccgtccccccgcccccggacaattaattgtaggaggaaacaagaactaagatgtctattcgagtgattttttatatctttcttaaggagaaaaagactgacatttgacactgtgctcttgttttgtcttgctgataataactgacagcaatgtttacttttcttacaaatgaaactatcagggtacgtacttttaagctctttaatacaatgggtttcatccttccaaaa

SEQ ID NO: 219315 - DNA, 430 bp, Homo sapiens
aacatgagacaggaaggtaggaggagaggggagtgccctgggtgactggggtggctgctgtgtgctgctgtgatacctgtttgctagggagacatgtatgcaatgcctggccgtgaggccctgagggtgccgggagcctgggcttgctacttgagggaatcttgtagtgaaaagaagtttttatctctaactcctttatccaggcttcttcttggatgtctaggaactttctttatatctccagtttagtgcttggcatgtggtgggcacttaaagttggctgaaagaaccattgatttaaagtaaacttgggttagtgcaatggctcacacctgtaatcccagtgctttgggaggctgaggtgggaggatcacttgagcccaggagtttgagaccagactaggcaacatattgagacccccatttctgg

SEQ ID NO: 219316 - DNA, 634 bp, Homo sapiens
aattggtggctgaatacgggatttgaggggaggggcaacgactcaggttttgcattgtggtgacttgaggatcacgtcccttaacattgctttattctttcagtgatttatttacaaaatactttgagtgcttacaagggcagggcactgtataggtgctgagattgctaaaaacaaaaatgctgttaaactagactcataaattaaagtaacaatgaggaaaactttgagttaatgtagagttagagtgtagacaatgaatgccctaatgtagacatgaaaaaaatgaatgaggctgggctgggaaggcctgttggaggaggtagcatttgagcagcgtcttgcctatggttagggattccacagggaatgagaaagtgtcactttagaaagaaagaaggcaagaaattaagttggtggaggttgaggaggacatgaattctattttagatggactaagtacaaagtgagaatggcacaccatggtggaaatgtccagcacatggctggaagatggaactgggattttgcaggacagtcagtgctggaggtcaagatttgagaatcatcggctttggggagaatttctgaacctggaagagcagatgcgactttgaagggagatgactgagtc

SEQ ID NO: 219317 - DNA, 446 bp, Homo sapiens
gctgcaaaacccgtttctctagagataagctgcatgtcctgggcaggtggctccttctctccctgccttgctcccgccctccccccggatccgcgtcaaaccgttgccgctaatctagttgcaattcccgcagaggactagttttatgttggggctgccgtgagttagattatgaaaatgtgcaatatctaaaattttacaagaatggcaatccaggagaaattcaggatagtttattttgtatttgaatgtattccttcttgtctcaaaactcccacgaaatatctttgttttcatcttaactcccaaagctcttgtatacattttcgaatttaattttttattgaagagggtgtctcaagaattccctttgagatacattataagtaattgtttcaaaaatgaggatatttagtttcgttttgtattttaattagaacccactc

SEQ ID NO: 219318 - DNA, 324 bp, Homo sapiens
cttgtgaaataccccagtctctttctgcttgtggaccagtggatttatcatacgcacaatttgttactaaatttgaattgttgagttaggagtgcttgagaaatatgtgactgcagaccaggactgtgtcacctacttggcctcggtgtcattttcccgtaagaatcaggaaaagattattttttctgtttctatgaagaatgtcactcgtatacgaatggtcaataggtacatgaaaaaatgcccaatgtcatcaatcttcagggaaatgcaaatcaaaaccagatgggataccacttcacacccgctagaagggctattatg

SEQ ID NO: 219319 - DNA, 417 bp, Homo sapiens
aataaatacctccatacctcttgttttacacacatgtgcactcacacatttttaaaaaatcaaactttagtcttctgaggtaccatgtagtggctgattaaaggaagttcttataagcacctcaccagtcttcctctctccaatatgtacttgaaaatgacaattcctggagtcatggtgagagcacagactttggagtctggtactaatctcagctctgccaatttgttaactgtgtcagtctgggcaagttatttatcagttgcgattcttagtttctttacccataatatgagcattataacagctagctcaagagtttttagaattgaagtgtaatcaaaatgtattaagacatatgtaaagcacctagcatgatactcggaaaataatcttcaataaagggtcattataata

SEQ ID NO: 219320 - DNA, 660 bp, Homo sapiens
tagactagggatataccataactcaagagttgttataaagttcctacctcagtgggaacatggaggaggggatcaacccccatcctactccctgtttctatggttacaggagggctgttctaggaagtgaagagtcccctctacacagatggcgggctgagggaatgcaaataattcagtgctgtgtgatttttacagtatgctggtataaaacacagttgaaagctctgagaaagaacaggagagcatgtgctctgagtgtatatgcaggtgtatgtgtgtgcgggggtgtgtgagatgtaggggtgagtgtgtgggacgaatgtctgttttgcctctttgcccaccatggtggctctaaatcatctcttccaaaccctacagctccggagaacatcatgtgagggccactggtctattcctgcctgtcttttgtctcatacggggcaaatctccagaaggtgtgatggtactagaaaataagtcagtggggccgggcgctgtggctcacacctgtgatcccagcactttggaaggccaaagcaggtggatcacctgaggtcaggagttcaagaacagcctggccaacacggtaaaaccccatctctgctaaaaatacaaaaattaggtgggtgtggtggcaggcgcctgttatcccag

SEQ ID NO: 219321 - DNA, 473 bp, Homo sapiens
aagttgggggaagtgcactgagcgagtggcggccgggggacagtacctgcttgccttattgggcaaatacagccttccaaggtggagtctaacgccgtggtgtgaactggccacccgaacagggagtaaatagtgctttgtatctttaaggaagcccttttttaaatttaaaaaaaaagtcttaattataagactctttaaatgcccaactgcatacttggagctttgggactgaatttggaactttcctgtcaagcgacctcccacgactttactgctgagcctgtgcacgtgtgtgtaaggggagaaatccaggcatctagatgcagacttgtacccagttacttggggtcgcgtgcgctcagctgggacctgggctcgtgcgcttagtccggagccctgatctgcgaacaggatattaaaacttttagtacaattgattggactacttgaaccatcgggatttggggagg

SEQ ID NO: 219322 - DNA, 234 bp, Homo sapiens
gctcattaccaaggggagggcactaagccattcataagggatctgccctcatgacacaagcacctctcactaggcttcactaccaacattggggatcacattttaatacaaaattttgaggggacaaatatccaaactatatcaccttcatttagtccatttcttgcactctttgtttctttgcatagattcaattttctacctggtatcatattccatgtttctgaaaaattt

SEQ ID NO: 219323 - DNA, 337 bp, Homo sapiens
ctgggctagtctggcaggggcctgcgggaaatggcgtggaacaacctcagagttgtctccctgaactccgtgatcatttgcaaagagctgctgagctatggggcatcagctccctcttatctctagcctgccccgtgcaggacccaagagacagccatgggaccgacagctgcaggtgacaaggagggacctcaggtgtgattaggaacagcaagcatctagaggctgaaggccagcaccaaagcatcggcaccctgcagttcatgcattttatagcaagtagaaaggttaagctgtggaaaccataagcatgatttttttttttaatagaggggag

SEQ ID NO: 219324 - DNA, 233 bp, Homo sapiens
atgatgttaaagaagtttactctgagaaattaactcttttcagaataatgccaaaataatgctataaaacttaagactaaagaagcatgccgctacagtgatgtccggaggcttttcatagcatttgattttaaaatagtaaagtaactgttaacagggaatggctgaagaaatcacagtataaaaacatcagttataatttatgaaaaacatgttagtatacacacatgctg

SEQ ID NO: 219325 - DNA, 584 bp, Homo sapiens
cataccagtaaaatgtattacttggttctgtcttctgaaaaggcctacaaacaataaacgacccaatagctatgaatattcttagcagccaaattgtggtatttaaatgccattttccactaaaaggaaccaggactccctaaagaaatgttaatttccaggtgtaaaactaaaaatatacaagatgaacctacaacatcttgtaacaccagaaagcaagacagcttctggggtcatgtcaaaggggcttgagccaacaagaagactcccaatgaccaaaactggaatcaatttgagcatcaataaggataatatatttaaaaactaagtacatttaagtctgtgtctttttttttttttttttttgagacgagtctcactgtgtcgcccacgctggggtgcagcggcacgatcttggagacaaaaagaccacaaaattttattcttcgtattattggtgatcttactgtattgttattctgaggctgtgtatttcaacaaattagtagttgtgttagggttcctgggaattgagttctccagtacagggaaagacaaaagatagaagatagaaataaaaaaaa

SEQ ID NO: 219326 - DNA, 747 bp, Homo sapiens
  misc_feature (733)..(733): n is a, c, g, or t
cacaaggtaacactatcaagtaggtatatcataacttatcttatcctaaccattatgatagaatgtttatttcttgtaacactatttcttaataagggtagtgagataaaaatttgactttttcattaaatccagacatcactgctcctaaagcaactaaagagttagaaaaaagaaaattctgacactagaaattttcatggggccaatatcacccaaggactgagcagttatcaatattgccagggggactgtttcttctgaaagtccacaggtagaagcatctttagtggaactatatcatgttatatactctattttgacaatgtacacaatatttcgagtaaaacatcaagatggtggaaatctgtatgtttaataattaaatttcaaaattttcaagatgacaacacttgataaaaaatgtgtttttaaagcaatgatcactgataggaccaatacattttagccacttttaaaattatttaaattattattttaacatattttagggagaaaagcatgtgtgcatttgtgtatgtgtcagtaaacgtattttacaaaaaacaatggaagaatatatattaatctgttaagccaagttatttctggggagggaaatgaagcagaaagtaaagggatactttatttgttgtaatttttatggtttcatctttcccaataagtatgtattcatgtactatttggtattttaaataataaattaataaanatattttttcatca

SEQ ID NO: 219327 - DNA, 427 bp, Homo sapiens
cagtttgtcttgaaattgtgggaaaaaattctaagttgaattcactggtaagtaattttttaaaatttcataatgcagattacatccaaaatttgatttaaaaattaaaacataagactgcagagaaattctgcatttcaactccaatactatccagacttcagaaataacttatcagttatttctgtaagcttcttgcttacctggatacctgacaggtgagatggctgtagcagacactggcagttccctgcccacacacctgtccctgtccacagctgcacaaggcagctctgtgtgcaattgccagcatctgctcctctgttctcagggaatctttgttagaaaaatgctgccatatttgtttctcacctattagtcttgtctcccagtcaagagaataaatttatgcaagcagagattgtac

SEQ ID NO: 219328 - DNA, 335 bp, Homo sapiens
ttcttttttcttttttttttttaaagagaacaagaaaagtacaacattgcttaagtcctacctcatctttatttttttacagatgaatgtacttatcttttctgcagggattgagcctgtgaagtgataatttctatctacctcataaatctttacatttccttctgcaacaggccctcttcccctcctcagtggagtttgcatttccctcttcccctgcgtggggcatgatatgcacaagcctggcatctgtatggctgggagggcactggatgtgtgtggtggggtgtattctgtagattgagccaaggaaacacaaaaaaaactactaagta

SEQ ID NO: 219329 - DNA, 396 bp, Homo sapiens
agaaaatttcctctccttgccccgtttctccttaaatggatcaccagtacagtctcttacttctagagccatgttaagctttcttccccaaagttgtaatgtccttcttttggttgtgtcgtgtcctaaaatcctactctttggtacaagatgaaggtatatgaagagataatgaaggaaacaaattcaatgtgtttgccaagaacacagtcttttaaataactcttaaagggttcgtttaaaacagtgtaataaattgtggtaatctagtacacaaagctagtaggaacctcgtttattaataatatttcaacattgagcagtagagggcagcactatccttcttttgcaaaatgttgagcactcttgagaaggaaaataaaggcaaagctcctg

SEQ ID NO: 219330 - DNA, 374 bp, Homo sapiens
ctaggaagggtagcgggaaggagggatcaggagatgttagttaacagatacaaaattacagctggataggtggaataagttctggtgttcttaagcaccatagggtggctatagttggcaataatttgttgtatattttcaaatagataaaaggtaggattttgaatgtcctcaatgcaaagaaatgataaatgcttgaggtaaggaatgtgctaattaccctaatttgatcattatacattgtatacaggtgtcaaaatatcacatgtaccccataaatatattcaattattttgtgtcaattaaaaatactttttagaaattactgtcaaaaaatgtatgccatcatttttactttagaagttctcttacta

SEQ ID NO: 219331 - DNA, 875 bp, Homo sapiens
agcgacattgttctccaatgtcatcagactccagtgcagaaagggatgttttcagattttccctttttattcccgctggtttcttttctcatggaataaaatagtcattgtataaaggccaaacaatttaagtcatcatagattaggatcctgtgaagtttccatctgaacaaccaagagccagaaaataaccaaattcctggggaaattatataataattcttacttattcattttttccaagtgttttgtcttcagcaccttgccaccttgcaattttggctgagctctcacctaaaacacttctggtgtttctagcagaatatatacatacaagtaaactgtatatatgtatacatatatatacacacacacatacaaatatataaatgcatataaattacttagtactataattatattttaaataatctttgacaggatttgaagacattatttgtaattttagagagatttactctcaaactgattttaaatccagggcagtcactaaaataagaattcatgtaaagcatagcctcttattttacccttgtctgtcatctccttagaaaatgccatcccaggctgggcacggtggctcacacctataatcccagcactttgggagggcgaggcaggtggatcatgagatcaggagttcgagaccagtctgaccaacatggtgaaaccctgtcgctactaaaaatacaaaaagtagccgggcatggtggcatgcacttgtaatcccagcaactcaggaggttgaggcaggagaatcgcttgaacctgggaggtagaggttgcaatgagccgagatcgtgccaccgcactccagcctgggagacagcgtgagacttcctctccaaaaaaaa

SEQ ID NO: 219332 - DNA, 434 bp, Homo sapiens
gagtgttttctagctgagtgcggctgtgctatgaaataccatgtgctatcttagccttagaggtggacagcgccgggctcccgtgtgatcctcaccaccctctagctgtgagcccttgaggatgtcatggtgtctttagcctcagtctcctcctctgtaacgggggtggataaaaccacctcacaaggttgtcatgcggcttaaatgagcaatgtgaagtgccaccaagtgtctggcacacagcaggccccaggggtgggcagaggcagatagaaacatgtggctctaacagcatctgtcttctggggaagacagaacacagctttgggagtgagcaggtggagaggaattgcctgtctcccatatccctcttcagggttcagaccccagcgaggaggtgtctggtcctcccagggctgggatggcctaggatg

SEQ ID NO: 219333 - DNA, 318 bp, Homo sapiens
cacatcgtgggtaacatttaataagataaacactggaaaagaactggggttgggaaaagaaagaggagggaaaggtgagcaggttcaaccacgttaaatattggataaacatgaaatatctaagaaaagctgtcaagtaggcaactggttcttttcctcatttcccacattcaatccattaccaaatcctatcaaatctacctttaaaatatagccgaaatctatccacctctcttcatctcaggaatactgttaccaccctaatgcaaggcatcattatctccctccatgtgctccatactgtagccagacagatct

SEQ ID NO: 219334 - DNA, 558 bp, Homo sapiens
tatatatatatagtgtacacacacacacataataggcagtgagagagcagtaatctaagtgttctgtagttttcctagccttttatagatagctatcaattttaaagctttatttccatcacaaagtaactggcagttacaagaataaagctaaagctaagttaaacattaaacaaaattaactgcccttagggatgttctagagttcagaatctctcaaccattactcctccctgcaacacaggtggtccttactcctctctaactgatttaatgtgtcacaaagctgagcgttttgtttgatcttacctttatgaattatatatgaataacaatattttagtttctagagttgagcaaacttgatgaaagaggtaaacctatacattccttagacaacagatccctttgcctacaatagaggctcctcaaaatggtatgaagagcaagctgatgttaatattcaaaagcctaaatgattctaaaatgacattgaaagtatacaaccacttttctaaatttttccatccaaaattaaaataaaggaaattcctttga

SEQ ID NO: 219335 - DNA, 389 bp, Homo sapiens
tgcatgttcccaagaacttaattatagaagtttttctgtaatgaatatgacagagaacccaactctacacaactgatctatatttatgttcctactgaggcatggtagtcctccttccccacacttgcctgcccatgaaatcgaaatatttggcaggattaattctcaaaagataaaaacactctaattgaagaaaagtatcaattcaaatcatatcttttaagaagaaatatattctttactttcctgcttaaatttgaaatagtagcagttgaaaattgtggattggaactaattactgattaaaacaaagtacacctatgagttttaatagaagcagtaagagtaatgtgtaaatgacttttctttgttcatggaaaccattgtgg

SEQ ID NO: 219336 - DNA, 464 bp, Homo sapiens
aactagatgaacacaatgctatgaatgcctataactgacttatttgaccaatatacagaggtcagtaaaggcttttgatgaagtagtcctggagccgagatctgatggatgagcaggactcctggttttggaggatgcagaacgagtaacataactgaagaaaggtcactgtgcctgggtagaggagtaggtatgggctggcctgaggggtctttttccttagaggtgtacgggaacccactgaagggttttaagcaggtagatgatgtgtggctttttattttattttatttatttattttttgagatggaatctcgctcagtcgcccaggctagagtgcagtggcactatctcggctcactggaacctctacctcccaggttcaagtgattctcctgcctcagcctcccaagtagctgggattacaggcatgtgctgccatgctcggctaattttatatttt

SEQ ID NO: 219337 - DNA, 436 bp, Homo sapiens
gactggctacaaacctcaccaaatgcgaggggactggcttccaccttgggctctgtgtgtatcatttccacccgaaacagaattgacttcatcgcagcagcaaaacaaagacagctctgagttatactgtaattcacagcgggagatttatgaatattattttcctgtaaaatctagcatttttctcgttgctacttgcaacctgtaagtggtataaagctgtgcacctagcaggacgccgcactgcctgtgcgcggggtgcccacgtgggtacacagcccccataaatggtgcctttgtgtttaacttgtctaatcagctcgccatatcaaaacttcataagtggttgcttctcatttaaaggtctagtaaaactgcaattactatggctgtaagacgccttgttctgaaaagtgcattaaatagttttatagat

SEQ ID NO: 219338 - DNA, 933 bp, Homo sapiens
cagtaatgttcttctgatttgctgctgtaaacagcaccaagaacagtgtctggcgcattgtgtgcgtgtagtaaatctgttccctagacaagaggacatgtgccagctactgtggcaggtactcaacttacacagccgcactcagtcactgtgaggaggggttctcccaaatcacaggtaagctgactgtggcaccagagaggttaagtcccattcttaaggtcctacagccggtacccaggttgactgactccagaaccagcactctttcctgacgctgcctgtgtagacagagggagtggattcatagagccctagaatcctagaatatggggaaaatagggccagctttttttttttttttttttttttgagacagagtcttgctctgtcacccaggcggaggttgcagtgagctgagatcacgccattgcactccagcctgggcaacaagagcgaaactccaaactccatctgaaaaaaaaaaaaacaaaaaaacacttaacatatagtatgtggcacacagtaagcactcaataaatgtaagatgctattgttaatattgcgactcttagtaacattgtttattgtctctccctgtattacaattcaagctcctgacagcaaacgctttgttttgtttaatgtattcctggtgggaagctcattttttggcacatagtaggtacataataaatatttgttgaatgaatgaatgagcaaatgaatacacagacaatgacattgacatccccagcgtccaggaggccccatatggctggatgtggagaaggatggatgctgggaagacaaacccaggccagctgcttgctcagggcccagccagccctctttgttcctagcagcccttggggcaggccctgtatcagtctgccctgatggggggtccattccactcagaacagagggttc

SEQ ID NO: 219339 - DNA, 657 bp, Homo sapiens
cagctccccaccagacatctgtgaattttgaaccaggaatgttcccagtgttatatggaatcatccaagccaagttattttgactccggtttattttaattatttaaggtaattatttattattattatattttttgagatggagttttgctcttgttgggggccagctccccaccagggcgaaactccaaactccatctgaaaaaaaaaaaaacaaaaaaacacttaacatatagtatgtggcacacagtaagcactcaataaatgtaagatgctattgttaatattgcgactcttagtaacattgtttattgtctctccctgtattacaattcaagctcctgacagcaaacgctttgttttgtttaatgtattcctggtgggaagctcattttttggcacatagtaggtacataataaatatttgttgaatgaatgaatgagcaaatgaatacacagacaatgacattgacatccccagcgtccaggaggccccatatggctggatgtggagaaggatggatgctgggaagacaaacccaggccagctgcttgctcagggcccagccagccctctttgttcctagcagcccttggggcaggccctgtatcagtctgccctgatggggggtccattccactcagaacagagggttc

SEQ ID NO: 219340 - DNA, 494 bp, Homo sapiens
atccaattacctctacctggtcccgcccttgacatgtgggattaatacaattcaaggtgaggtttgggtggggacacagagccaaaccatatcagggaacaacccaggtgtttatcagtcgacgagtggataaacaaaatgtggtctgttcatgcagtggaatattattctaccataaaaaggaatgaagtactgatacaagctacagcatggatgaaccttgtaaacactatgctaagtgaaagaagccagtcacaaaaggccatatattatatgattccatttatattaaatgttcagataggcacattcattgagatctgtggttgtcaggggctagaagtagggagtaatgagaaatgactgcacacaggcacaggttctggaattggatagtagtgattgttgaaccgccttgtgaatctgctaaaaaacactgagtcatacatttgtaaatggtgaattttatagtatatgaattatagctcaataaa

SEQ ID NO: 219341 - DNA, 356 bp, Homo sapiens
aaaacttcatgctaaaattcatatagaattttaagggacctggaaatagccaaaataacattgaaaaagaagaataaagttagtggcgtcactggggtttttatgttgttgttctttttttttttttaatttcaaaacttactacaaagtcacagtagtcaaaactgtgtggtactgacataaagatagacatacgaaccaaagaaatagaatagacagtcccaaaataaaccctcacatgtatggtcaaataattttcaacaacgttgccaagaccatcgagtgaggaaaagacagtcttttcaacaaatgatgttgggaaaactgaacagtcacatgcaagaaaaacaaaccaa

SEQ ID NO: 219342 - DNA, 489 bp, Homo sapiens
tgggcttccttctgccactaaagcaaacactgtcaatagaaggaaaggagaacaaggtgatggctgaaatttgcaatcctgtgttttcagatggaggatcaagagccctttaccttgccaaacattatttgaattttgtagaacaaacactggagtttaagttacatcctcaaattcaatatttggcataggtgatttctcccacttagtgtacctgttaattgctttgagataatgcaataggcactatcagaggattttaggagtttgtatgcattactccacctcttttttaactagtgaagaaactgagccccagagacgtgaagtgattcacctaggattatatagctacttgaaaaatggactctagagaaccccaggctcctaactcatattacagtgccctttcaactgtatgaggtttaattctgtttgttttggaatctgtatccattaaaataaagctatttgacttggatcaacttg

SEQ ID NO: 219343 - DNA, 445 bp, Homo sapiens
cccgagtagctgggattacaggtgcgtgccactatgcctggctaatttttgtatttttagtagagacagggtttcgccatgttggccaggctggtctcaaactcctgacctcaggtgatctgcccgccttggcctcccaaagtgctggaatggcataagccactgtgcccggccaagaaggttgttttttccgagctgttttttctgctctaaggaaagaggcaggattcaggggatgctttgtatcttttcctgcttcccaacccgagtccttcctcttgttttggatttcttgctgcatcatctctgtccttctttagggctggaggtgacctctgcgagccttcccttcctctaactctggcctctttcctgctgcaacatagttctcttctagtccgttcaaaactttttattgccacgtgaacaatctcattgggaaaca

SEQ ID NO: 219344 - DNA, 612 bp, Homo sapiens
  misc_feature (609)..(609): n is a, c, g, or t
gattacaggcatgagccaccatgaccagcctgcatttcaaaaatccttaatttatgtatttttttttgtgctgagatgaaattcatataacagactattttaaagtatacagttcagtggcacttattacattcatgatgttgtacaactctagttccaaaacattatcacctcaaaagaaaaccttctgttcattagcagtcacttcccttgtgctaccccccgccactggcaaccgctaatctgctgtctctggatttactttttctggagatttcatacaaatggagttatatagcatgcaaccttttgtgtctggcttttttcatttagcataatgctttggaggttcattcatgttgtagcatgaattcagagagctttattcttttttgtggcagaataatattccattgtatggatatatatcacattttgtttatccattttaacagttgatggacatttgggctgtttgcatcttttggccgttgtgaatagtgttgctctgaacattcacatacaaaattttttttgaaaggctctttgcaattaaccattaacctttttaaagacaccccctttttttcccctttggttgggacccanccc

SEQ ID NO: 219345 - DNA, 555 bp, Homo sapiens
atcatcccctgtgaaaattcatctctccttcacctactccaaaatgaccaatgatctcttagaaggtgccttagaggaaggtgccttatttggaattctcatagccccttacattccagggcgcactctcaattactttcgaatagcagcagttttaaaggccaacctaacattaggcaagagcctgggttgaggcttggtttcatctcccagacaggcactgtgctgggctttctctgccttatctcgctgtaacactcctagctctgttttccatgagatcaggcagctgaggctcagagagatggagtcacctacctaaggtcacacggccagtacggaagctgggagtgcaagcaaaggtgtttgaatccaaagcccacatcctcaccacactagcagattgccttagggttgccactgggagagcacctcacatcagaagcctgtgtgcaagagtcagtgtcccccatgaagctgtgaggtcccaaaagacagccatcgttttttattcaatttggttctcccctaagttggtcaggattttttttttgg

SEQ ID NO: 219346 - DNA, 553 bp, Homo sapiens
aaggtggtactattttttattaatcagactggtaaaatttacaaacacctataatgtctagttttgacacagccgtggagagtagagtctctagcatttggtgagtcatccctcattgcaagctactgcactcaatactttacatatgttatttcctttaatctctaccatctcccctccaccccaaacctaaatttataaattctaaaacacccttgttagatactattgtgtcctctggatctcacagatgagaaaactaaagcttcctgggtaaatcattggggctccaaggtaagttacttgccttgcattgcaattagtaagaagtagagctaatgttttaagttcaaatatgctaacgggtgtatcctataaggagcaggaagatgggggagaaagatgtatagagacataggctgattttttatattgccagagtaatgtagatcctgatacgtttgttaacatttgagggttatcactagtagaacaaaatactgatccagaactttatagatgatagttggggaaaaaggaaaaggggaacctg

SEQ ID NO: 219347 - DNA, 774 bp, Homo sapiens
  misc_feature (709)..(709): n is a, c, g, or t
taaagatttaaaagttcttactttttgttgtattttaaaatgtttaggtgtttgtgtcacagtgaaatttatattatgacatagaaagctttttggccccaaaacattattaagaccctgcattcagtgggtctggaagaataatgttaccaataaattcattttagtctaactctttctcctctgtgagcacctcttatcttgtaggcatacatagttttgactttgaactcttctgtgtatttcatgtttgcctaactcatgatactagtaatgctaaatctcctttattccaattggacattgcagttagggcaatcccataagaagatgtaaggggggagttctgctcagtgaaatttattaaaaagattaggatatgcctgtgccacgatttaactatgcattagcaaaaaaggccaaaacattcattttgtttatacttcttgtaatgtgtgcatcaaactgcctgatcatttaatgatacttgattcttagataaaggtgactttttaatgccatcaaatgagttctctttttccattagcattggagagaaagttttcttatagcagcgggaaaaaaatattccaggcaagcgtaaagctcagggtaggccagtttgaaattgtcttttatttatacccctgacaagtgcaaggagagaattttctgtgacaactcagtaggccaccttaaaaagaggccnaattgctggggaaggaagggcttgcctggttatggaagggtgggaagaatttggcccactggggg

SEQ ID NO: 219348 - DNA, 365 bp, Homo sapiens
atgttgctgctcaggcaccgtgaagagatagcgtcgtcagcagactagaggcttgtgctccagagcatggaagaaaaagcctacaaagacacaggaatctgccacttcagtacatttattgtggtccagtggtcaggggcatgctgtgatgtcctgtccaaaataaaggacaaatttctgtatcttgtctgtcctattacaaagaaggaagcacaatttctgctaggcttcttcaagttctgtagttaacacattttacacctagaaacattgctctggccctgatattagctgacatggaaggatatccactttgagtggaacacatgagatccaacagaccttatgatattggacctgtcagg

SEQ ID NO: 219349 - DNA, 466 bp, Homo sapiens
gtatcaaaaatatgtagatggattttagtagttgtaatttaaatgtggaaggtgaagagaatttcaaactccaaagagaaatgaatgatattcagatgtttcattaatttctagtctgtgaaaatatgcattttatagtaatatgtatagacttattttatttagaaataatagtgttttagaatttattaaaaactcagtgatagcctttataccaaaatgtttaactttaccaacagcaagtcataaaagtatttattttaaagctttttaatattatcgtgtaactttcatctgtcttcagatgtaaataattatctgcctaaatgttatatttttatgtatgcattttctgaaaatgtattgttttgtaaagtgggaaagataataaatcaagcacttcttgcacttgtttctgtgaagcatatagaactctattttaaataaaggaagatgtgtcgtattt

SEQ ID NO: 219350 - DNA, 476 bp, Homo sapiens
gcacgaattggcagtggtggggtgagcaggaaggaggttccgcctggttcatgaagacatagatgcaccccctaattcgggctgagccgtgtgactggcaggggccccagctgttgggcctgggcaggactgtttttagaaaagccccaactccctgcccctacccgggcccgtggctatttatagtccgggcctggagaagtcagtgagtcactagcgttcgcctctgcagggtcagtccaagcccccttagtgaggtggtctagcatgtcccccagtcccccaagcctctatctgacatctgctagcccagagccccaggggtccccaggaagggctcagagctggtggccccccccaggccttggcagcacctccttgtctgatgggactttgtggttcctggtggacatttaacattgtcggtttctctcatctggaaacaaacctccatgacgctcttggtttctcctgtt

SEQ ID NO: 219351 - DNA, 414 bp, Homo sapiens
gtgggggaaagttctggtcatcagccctagcattccatggttcatttcctcatcagtgatggaaaatcaccaagcaagagaacaggatggagaataaccggatgggtgcaatcggaggtgctatttcaggagctggccattcttcaagtcagaaggcctgagagaggagctgcccaggtggtcttcatggggctgtgcggccagtcatcccccacaggttgacaatccttgtgtacttcatcctcgttggatcctctgtatccctgacgatgagcaactgtgaggcccgtttcagcactgagttccagtcaggaaaacatccacccacccaccacacgctcacacttacacacacattcacacatgcacacacgttctggctccgaaaaagaaaaaaaaaagcaatttaaaata

SEQ ID NO: 219352 - DNA, 445 bp, Homo sapiens
tttcttgccctgatgtatttatctggtactcttttgccagtctccttctcaaagacattttcttgctaaatttcttactaacttgtcaaatggagggaaaataagattgaattagtaaaacattcttatcacaatatactctaaaagaggctgggcgcggtggctcacgcctgtaatcccaacactttgggaggctggggcgggtagatcatttgagctcacaagctcgagaccagcctgggcaacatagtgaaaccctgtctctataaaaatatacaaaaattacccgggtatggtggcacgcgcctgtggtcccagctactccagaggttgaggcaagaaaatcgcttgagcccaggaggtcaaggctgcagtgagctgagattgcaccactgcactccagcctgggtgatgggagtgaaaccctgtctcaaagaaaaaaaaa

SEQ ID NO: 219353 - DNA, 879 bp, Homo sapiens
taggtcgactgaaactgcctttgtaagaccaatggaaggccacaagattacaaatatagaaggggcctgaattctgcttaaatgtagggcggggccgggcacgttggctcatgcctgtaatcccatcactttgggaggctgaggcagcagtttacgaggtaaggagtttgagaccagcctggccagcggggtgaaaccctgtctgtactaaaaatacaaaaaaaaaaaaattagccgggcatggtggctcatgcctgtagtcccagctacttgggaggctgaggcaggagaatcacttgaacctgggaggtggaggttgcagtgagctgagattgcaccactgtactccagcctgggtgacagagtgagactccgtctcaaaaaaaacaaaaaaaaatgtagggcatagtttccatcatctcttattgctaaggaattgttgtggctagaggtcacaagttttgtgacttccccattgctcctacagataccaccattaccgatcccagaatctaagattagtcttctgagatgtatctcagacttctgcattctggcaaccaactgagcccacctggacttaatgattcacgactcaaccagtcctgtgccctcaccccaaccagaggcagacacagtggatgaggacagtttcccactgtgattgcatccctggccaatcagcagcacccattccttagttccctgcccaccaaactatccttgaacaattctaacctccaagccttcaaggagattgatttgagcaatctccagttctcccatgtggctggcctatcattaattaaattctttactataataccacagtatcagtgaatgggttttgtctgtgcagcaggcagaaagaacccactg

SEQ ID NO: 219354 - DNA, 445 bp, Homo sapiens
ttcagttatgcctcgacaaattggaacatatataagagaatgagacttttgacctggaaaaaatcaagtatgagattggaaatttaacctcacatgagaagaaggaattctctgtaatgatagatggatgtggtagaatgataaatagaaaggatgtaaatgtaaatattgcttctcctttcaaaatagcaatttcagtttgtcgtacatttgctacctgccagggaaggttcagaatgctttctatgacctcatctaccctaagtggcagtactttttttttttaactgagtcagaaatagagccaatacattcaaaatctccagagagtgatattcagactcttgaaacctgggctgtttattctttccaaccacacaaattgtatctcgttaaaagtatttgcagacagataacaggctcactggaggggagagttggggaa

SEQ ID NO: 219355 - DNA, 785 bp, Homo sapiens
tcatggacaaggaaaaatgctgtaggtaggctgaggctgttaagtaaaatgtcttgctattctttctcttctcttcttcagttatgttacagaagcaagggtattgcttctacatgggcaaatttgtctatgccctgaaagaaaccaagagtgaaactcaactgggaaagcatcagtttcactttattgtcactagcttcccaattttgccgggaaatttcttaatttaaaggtaataaccaagctgacattttactgtagccaaatcctacagagggtttcaaaatgagtgggtgaaaaaatatacaagcttaacatgcttatacttatttaacatgaagtgaaaatcattagcatagttcaggtatgtgcatggtatgtgcacgcacatggggcagtgctgtcatctaacagaagcccacctttttacttgactaatggtttactgttaatacctcgataatagtgtaatctttgatagacttttataaatgattatttcaaatgctttttgatcaccttcaagaatatgacctgagacaggtaatgtaatttagcagtttgcatctatgaactgtggaggatacctacagacactgaagtgttactaacagtaggatgcaggcattatgtgaatgcgtgggtattttatttccatttatgggctactatagcaaaaataattggggagttgccctatgatgaaagaagactgcatgttttttaaaaccatacctttgtccaaaagcaaatggtaaataaaaatagactgttgacataaagct

SEQ ID NO: 219356 - DNA, 404 bp, Homo sapiens
aggaaacaccagctacctataataacgcgtgacacgcaccttcttcaacactcagcacagctctgcaataatggcccagcctgatcttcacgttggaggtgaggacacaggccctggaggattcaagtggcaaggtcacagaagtggtcacaggggaccacagccccccctgcctggactgccctaggctctggatctgtaacccctggcttgctccccattcgcctgcctgaccacagctccgaggcctctgaaaagcctggcaagcccggtcacctggtcaccctatgaccccacaccctgcagctgcactgagcttcactgaccttgggtggggatgcctcctgagggctctttctgttgttctcgcatctctccagccacatattaaagtgactcagacc

SEQ ID NO: 219357 - DNA, 1068 bp, Homo sapiens
acgtgacatgggttggaagatggcgtctcccacagacggtaagagccggcttagagatctttgcctgcagcctccttctttgctctactgggaacatccactctgtctctgcccctcgaacatacatttctttcttgggctcttctcctttcccttttattttttttcttgagatccatcgccgtcttcagctcaccggttcttcacagcagctccggaggtgcccagtttccccgctctgtaccaggcgtgtggaggagggcactagggagggactcattctgggtaaaaggacaggggggtcgccctgtgccttccttatctctatttgggcgaggctgagggtcgaggaggagatgtttctggaggacgtggcttactgtagttttctccttggggtacccattgaaaggatcagttctcttctgattgagcgcacggatggaatgattctcacaaaccctcgcagggctgctggctgacctcatctcgatactgaaccgcaagagaaacatgatctctctcctgtctcctcagtttgggaccattgccgtggcagcaagagaagcgggggacgttctcggcccctcgccctgagagtcgcgaggagaatcagtattgagcttttaagtgtcgtcttgcacaggtcgcaacctgtcttccatctgctttacgtgttgtttcttaaggctgagtgaattaacgatttctgtttatatattgtgtaaaatgcaagtcatttcaagtaacaattaagttgttttggtatactcccatgcttttcctcttggttctgctttagagagttagggtcttgcagtcatttttaaactcatttttagttctaccatcctcatcccaactatatatcgattttattgatatataggtttccttcccttagacaaaaacattttatatttggaaggaatcttggaagttcattgcaggaatgaagaaattgaagccaaggtgagctatattaagtacctgctacatgaaaggcataatgctaggtgctttgggagaccaaaagatgactcaaacatataaacatttttttttttc

SEQ ID NO: 219358 - DNA, 548 bp, Homo sapiens
cacccatctcatactgcagagaagtgaggtaagaaccttaagacatctctttggaaagtctgctcatctactcaccctatcagtgactcacttccaatctcaaactttcttccagatgggtctgtgtgcaaatcagtatgcccaatggtaacctctggggctttttttctgagaacaaaggctgagggttcccctacctgcagaagctagagtgtgaggggtatgtatgtgtgtatgtgtgtttataggcatttgagtcaatgacccagactaaatgtcaaataaatatagtcacgcactgcataatgatgttttggtcaatgactgactgcatataatgatggcggtcctgtaagattataaggaagctgaaaaattactattgcctagtaacatagtggcagtcataacattgtagtgcaacacagtactcatgtttgtggtgatactgtgctgcaagttttataaaagtatagcgcacacaaccatgtacagtgcctaatactttatatagttgatgataaatacttgataacaaattactatgt

SEQ ID NO: 219359 - DNA, 464 bp, Homo sapiens
caggagcagggttagcatatctggattttagtctgagctctttgtcaaaaaagtcctgggcctcagtttctttattactgaaggagagaatcaactctgtgattctaagttataaaccaccgttattaaagttctactggagccaaaactccaaattgttctgtatattaaaacttttcggcagggcatggtggcttacacctgtaatcccaatactttgggaggctgaggagggcagatcacatgagcccaggagtttgagaccagcctgtgcaacataggaagaccctgtctctacaaaaaataaaaataaagttagccaggtgtggtggcacgtttctgtggtcccagctcctcaggaggccgaggcaggaggatcacttgagcccaggaggtcaaggctgtagtgaactgtgatcacaccactgcattcctgcttgggcaatggaacaagaccctgtctc

SEQ ID NO: 219360 - DNA, 704 bp, Homo sapiens
cgcaagcttcgcctcttgggttcatgccattctcctgcctcagcctcccgggtagctgggactacaggcgcctgccaccagcctggctaatttttttgtatttttagtagagacggggtttcaccgtgttgaccaggatggtctccatctccagacctcgtgatccgcccgcctcggactcccaaagtgctgggattacaggcatgagccaccgcgcccggtggcttgcatgttttcttaaaaagctacagaaatttccaaatatcttctttcagataatagttggtggagtggcaagtacatcacaagatatgcatacttatgctgcctgcacatttttggctgcaagtatgaaagaagggaagcaaggaattcagagaaatcaagagtctgttcagcttggagcgattgaggcctgtgtgatgtggctactagaaaatgaattcatccagagtacagaagccagtgatggaacagaaggaaaggtgtatcatccaacacatcttggttcggccactctttcttcttcactttctccagctgatactttagatatttttgctgacctgcaaagagcaatgaagggctttgttttagagaatgatcttcatattctctatctggttacacctatgtttgaggattggactgctattgattggtatcgattatctgtttatgggggagaagttgccactcatgag

SEQ ID NO: 219361 - DNA, 2522 bp, Homo sapiens
  misc_feature (2499)..(2501): n is a, c, g, or t
cgcaagcttcgcctcttgggttcatgccattctcctgcctcagcctcccgggtagctgggactacaggcgcctgccaccagcctggctaatttttttgtatttttagtagagacggggtttcaccgtgttgaccaggatggtctccatctccagacctcgtgatccgcccgcctcggactcccaaagtgctgggattacaggcatgagccaccgcgcccggtggcttgcatgttttcttaaaaagctacagaaatttccaaatatcttctttcagataatagttggtggagtggcaagtacatcacaagatatgcatacttatgctgcctgcacatttttggctgcaagtatgaaagaagggaagcaaggaattcagagaaatcaagagtctgttcagcttggagcgattgaggcctgtgtgatgtggctactagaaaatgaattcatccagagtacagaagccagtgatggaacagaaggtaagtgtgacttctcagttgcaatttactcactttttcttctttagtgagggtgtatgactgctcagtgaatggaaattgtcttttcatgtagtataaaaggaatttgattttttgagcagtgtatcaactcatttttagtaaatcagtattgtatttagcaacttcagaccattatgatagagcctgctcatacattttcatgctctggataaggtactatttgtaaaatttatcagccgggagggttagcatggaaaacagaaagatagtattttgttttattttattttgaatgtttgttcctctgtttcctcaccctaaccctaaaccaggaaaggtgtatcatccaacacatcttggttcggccactctttcttcttcactttctccagctgatactttagatatttttgctgacctgcaaagagcaatgaagggctttgttttagagaatgatcttcatattctctatctggtaagttctgttttaacaattatgtttgtgaaaatagggagaaaaaaatagatatataatcctgaacatcaaagataccctaacagaacatctcgtctgttttccatgcctaggttagtactggtgggaatagagaagaggtaagaagataattgttttaaagtaataatctaaatgttctagttacctttaaatttattttctccaacctcctttcaaaaaagatttgagttgttttataaaaaatatatatttttacaacgtataaaagaacagcaaagaaaaatgggatatcagaaaattaaagatcggatcatgatgtaaaactcaagcaaaggtcagtacacaaacatgcgtgccattaagtcatgtccaatgctgttgtcaactttgattctgggttttctagcaactaaaagaaagaggaaagcttgattagtgttaatattcataagataaaaaacaaaacaagtttaggaaaaacattgcatttccctgcctaagagaaatttagtcctaaaaggatactttggaacttaacattgtttgataaaaatctctataataaatgcaataaggaattttaaaagtttgtttatattagacaatgctctgtgaatattattttgtataacaaagatattaataagaattggatagtgtttaaggtcatgttctctggcaagaacctgatcagaaataattaattttgtcagttaagagcagatgcatgcattttgataagcaagtgataaggggaggtgagtaaaattgaaattctcattagaatgaagggggcttatcaggaaatgtgtttcaataaaaatcgctatgtagtgagcagaggggaaatgtctagacagtaccaattttcttttattacaaactcgcataatacatgggtgataataggctcaaaggtctgtgcccaagaatgtggctgggaggaatctcaaagcaggtttcaccggtcatctatcatggccttaaaaataagtcatttattatacagtggctaagattgtgggctctaggatcagactgccttagttcaacttttggcctcatcacttagtaatcatataaccttgggtaagtatttaacctctcttacgattccatttcctcatttgtaaaatggagataataatacccacctcagggctgatagtctttgatgaatgtttggtatctgaataaatgtttaataacatctattatttctagtaaattctcccataaacattatgtaagtcatttgccaaattacctaactactcctactcctgttccctctctaaaacgtgaagactgttggcagtgttagtatgctgaatgcttgtggttagtggtcttgtatacttctctcaccattcgagttgtatgcccttcaagagttagttgtgttcccaaacttgttcatgtcagtttgcttctgagaaaattaggctgaggcagaaggatcacctgagtccaggaatttgagaccagcatgggaaacagagcaagaatctgtcgtgaacttcgccagtttgtcaaannnattttaaacaaaattaaaaaa

SEQ ID NO: 219362 - DNA, 1563 bp, Homo sapiens
  misc_feature (1540)..(1542): n is a, c, g, or t
cgcaagcttcgcctcttgggttcatgccattctcctgcctcagcctcccgggtagctgggactacaggcgcctgccaccagcctggctaatttttttgtatttttagtagagacggggtttcaccgtgttgaccaggatggtctccatctccagacctcgtgatccgcccgcctcggactcccaaagtgctgggattacaggcatgagccaccgcgcccggtggcttgcatgttttcttaaaaagctacagaaatttccaaatatcttctttcagataatagttggtggagtggcaagtacatcacaagatatgcatacttatgctgcctgcacatttttggctgcaagtatgaaagaagggaagcaaggaattcagagaaatcaagagtctgttcagcttggagcgattgaggcctgtgtgatgtggctactagaaaatgaattcatccagagtacagaagccagtgatggaacagaaggtaagtgtgacttctcagttgcaatttactcactttttcttctttagtgagggtgtatgactgctcagtgaatggaaattgtcttttcatgtagtataaaaggaatttgattttttgagcagtgtatcaactcatttttagtaaatcagtattgtatttagcaacttcagaccattatgatagagcctgctcatacattttcatgctctggataaggtactatttgtaaaatttatcagccgggagggttagcatggaaaacagaaagatagtattttgttttattttattttgaatgtttgttcctctgtttcctcaccctaaccctaaaccaggaaaggtgtatcatccaacacatcttggttcggccactctttcttcttcactttctccagctgatactttagatatttttgctgacctgcaaagagcaatgaagggctttgttttagagaatgatcttcatattctctatctggtaagttctgttttaacaattatgtttgtgaaaatagggagaaaaaaatagatatataatcctgaacatcaaagataccctaacagaacatctcgtctgttttccatgcctaggttagtactggtgggaatagagaagaggtaagaagataattgttttaaagtaataatctaaatgttctagttacctttaaatttattttctccaacctcctttcaaaaaagatttgagttgttttataaaaaatatatatttttacaacgtataaaagaacagcaaagaaaaatgggatatcagaaaattaaagatcggatcatgatgtaaaactcaagcaaaggtcagtacacaaacatgcgtgccattaagtcatgtccaatgctgttgtcaactttgattctgggttttctagcaacattcgagttgtatgcccttcaagagttagttgtgttcccaaacttgttcatgtcagtttgcttctgagaaaattaggctgaggcagaaggatcacctgagtccaggaatttgagaccagcatgggaaacagagcaagaatctgtcgtgaacttcgccagtttgtcaaannnattttaaacaaaattaaaaaa

SEQ ID NO: 219363 - DNA, 2325 bp, Homo sapiens
cgcaagcttcgcctcttgggttcatgccattctcctgcctcagcctcccgggtagctgggactacaggcgcctgccaccagcctggctaatttttttgtatttttagtagagacggggtttcaccgtgttgaccaggatggtctccatctccagacctcgtgatccgcccgcctcggactcccaaagtgctgggattacaggcatgagccaccgcgcccggtggcttgcatgttttcttaaaaagctacagaaatttccaaatatcttctttcagataatagttggtggagtggcaagtacatcacaagatatgcatacttatgctgcctgcacatttttggctgcaagtatgaaagaagggaagcaaggaattcagagaaatcaagagtctgttcagcttggagcgattgaggcctgtgtgatgtggctactagaaaatgaattcatccagagtacagaagccagtgatggaacagaaggtaagtgtgacttctcagttgcaatttactcactttttcttctttagtgagggtgtatgactgctcagtgaatggaaattgtcttttcatgtagtataaaaggaatttgattttttgagcagtgtatcaactcatttttagtaaatcagtattgtatttagcaacttcagaccattatgatagagcctgctcatacattttcatgctctggataaggtactatttgtaaaatttatcagccgggagggttagcatggaaaacagaaagatagtattttgttttattttattttgaatgtttgttcctctgtttcctcaccctaaccctaaaccaggaaaggtgtatcatccaacacatcttggttcggccactctttcttcttcactttctccagctgatactttagatatttttgctgacctgcaaagagcaatgaagggctttgttttagagaatgatcttcatattctctatctggtaagttctgttttaacaattatgtttgtgaaaatagggagaaaaaaatagatatataatcctgaacatcaaagataccctaacagaacatctcgtctgttttccatgcctaggttagtactggtgggaatagagaagaggtaagaagataattgttttaaagtaataatctaaatgttctagttacctttaaatttattttctccaacctcctttcaaaaaagatttgagttgttttataaaaaatatatatttttacaacgtataaaagaacagcaaagaaaaatgggatatcagaaaattaaagatcggatcatgatgtaaaactcaagcaaaggtcagtacacaaacatgcgtgccattaagtcatgtccaatgctgttgtcaactttgattctgggttttctagcaactaaaagaaagaggaaagcttgattagtgttaatattcataagataaaaaacaaaacaagtttaggaaaaacattgcatttccctgcctaagagaaatttagtcctaaaaggatactttggaacttaacattgtttgataaaaatctctataataaatgcaataaggaattttaaaagtttgtttatattagacaatgctctgtgaatattattttgtataacaaagatattaataagaattggatagtgtttaaggtcatgttctctggcaagaacctgatcagaaataattaattttgtcagttaagagcagatgcatgcattttgataagcaagtgataaggggaggtgagtaaaattgaaattctcattagaatgaagggggcttatcaggaaatgtgtttcaataaaaatcgctatgtagtgagcagaggggaaatgtctagacagtaccaattttcttttattacaaactcgcataatacatgggtgataataggctcaaaggtctgtgcccaagaatgtggctgggaggaatctcaaagcaggtttcaccggtcatctatcatggccttaaaaataagtcatttattatacagtggctaagattgtgggctctaggatcagactgccttagttcaacttttggcctcatcacttagtaatcatataaccttgggtaagtatttaacctctcttacgattccatttcctcatttgtaaaatggagataataatacccacctcagggctgatagtctttgatgaatgtttggtatctgaataaatgtttaataacatctattatttctagtaaattctcccataaacattatgtaagtcatttgccaaattacctaactactcctactcctgttccctctctaaaacgtgaagactgttggcagtgttagtatgctgaatggtgagagaagtatacaagaccactaacca

SEQ ID NO: 219364 - DNA, 181 bp, Homo sapiens
tactttgtcacccaggctggagtgcagtgacatgatcatggctcagtgcagcctcaacttccctgggctcaggtgattttcccacttctgccttccaagtgcataccaccatgcccagctaagagtgtgtgtgtgtgtgtgtgtgtgtgtgtgtgtgtgtggcttttctttttttttcttt

SEQ ID NO: 219365 - DNA, 526 bp, Homo sapiens
cagagtcacagatagatatttgtacatccatgttcatagtgacattatttatggtagctgcaatgtggaggtaccccgagtgtccattgatgggtgtatggataaacaatatctagaggaatattattcatccataaaaaggaaggaaattctgacatatgcttaaaaaggaaggaagttctgaaatatgacagggatgaaccttgaagacattattctaagtgaaacaagcccatccccaaaagacaaatactatataattccacttatgtgaggcatctcaggtagttaaattcatagagacagaatgctgattcccaggggctagcaggaggggagaatggagagttttaaaaaatgggtatagagtttcagtgttacttgatgggaagttctggagatggatggtgctgatgacattatgaatatacggtagttaattccactgaattacatacttgaaaatggttaagatggtcatttctatgtcacgtgtatattaccacgataaaaaaattgggaaatc

SEQ ID NO: 219366 - DNA, 542 bp, Homo sapiens
caaattacatcggcaggtactctaattacaaatgagatcacattctgagttgccagggattaggacttacacatgtcttttctggggggacactgttcaatcccacactaggcaacatgaacgaagccctggatccagaaaagccagtaaagaaaacagagaaagaacaaccatagggatcagaggagaatttgggcaaaatgaagtgatcaaagtcctggggagagagagaagtcaacactcaggaaagtcaggagcacatagtcctagaaagggtattggacttggcagtcaagcctatcattggccaccctcctaagagcctggtcacaggagaccagcggttactggtggtaaagaagggaagcagccaagcaggctgttctttctaaggtgtttgacaatgaagtgaagtggggtgggtgacgatgtggggagtaggccaggtgcgggaaaggagatggagctttttaggggggcccttgagcacttatatgagaccagaagaagaagttgaaaatgccggagctgtggaagagcct

SEQ ID NO: 219367 - DNA, 281 bp, Homo sapiens
cctgcacaatgtgcacatgtaccctaaaacttaaagtataataataataaaaaaagaaatatatgttttttcacctactgtttattcttacaccagttacttaacctttctaattctcggtaatttctcttgcagaatgagagtgataatacatgtctcacagagttgctgtgtgcaaccatattttgtaaagcatcttacacatataaacagtcttaaatcttatttagaataatagtgttacaaatatatttaactataagtttattaataaatacatc

SEQ ID NO: 219368 - DNA, 425 bp, Homo sapiens
gccacagtgaggacagctgcctggaagaaacagacccaagtatccttggatgtgaactccctttggagctttgcaacaagcagtttcttaaagatggagtctccttctgtcaccaaggctgtagtgcagtggcacgatctcagctcactgcaacctctgcctcccgggttcaagtgattcttctgactcagcttcctgagtagcttggactacagacacttgccaccacacccagttaattttttgtatttttagtagggatggggtttcaccatgttagccaggatggtctcgatctcctgacctcgtgataaacccaccctagcctcccaaagtgctgggattaggcgtgagccaccccactgggtcctcattcttgtatcttaaaagtcagtgatgttgagtaatttctcatgccaccacct

SEQ ID NO: 219369 - DNA, 259 bp, Homo sapiens
tcttatacagaagtagaataatataacaaacacccaagtatctgtcatctagtttcattaattatcaactcagggccaatctggtttcctctatacttccattcacttccttccatgccaccttcctttttcctccacttctagattattttgaagtgagttctggaaattacatttcatttataaatagtggtatatgtgtctaaaagataatcacttaaaaaaatttcactcacatgtaaaaaaaatatgcttcttc

SEQ ID NO: 219370 - DNA, 199 bp, Homo sapiens
acgaagttggggaagagactaatggataagagagataataaaaagtaatgtctaaggcagcctgtttcagcatgtttattgtagtgagatactaggcaggtggaaggttattgctgtgatgaaataagttttctaaattgtgtgctgtagttctctctctctctctctctttttttttctttgttttttttggagacag

SEQ ID NO: 219371 - DNA, 221 bp, Homo sapiens
gattttaaattagactgaaattctcgtatgattttttttccccagggttgatatttaaagtacgaatggattgaataacttcttctctttggtcaaggtggttatttttgaggcaagtgctaattctggttcccaaggttttatcagaatatcttgttgttcaggtcatcttgttagtggatgtgtacctcttctttggcatgtagagaatcttagaactt

SEQ ID NO: 219372 - DNA, 390 bp, Homo sapiens
ataactctttggtaaatttattttcagtgtttcctgacaccccaagcatttatagatatatatgtttaaaaagagtcgtgttatatataggagtttatgttcctcccttgggtattttgagaaactataaaattaaatcattcttatgattaagaaaaacagtgttacagcaacagcctgtttcaatcccacctccacttacatttccattccaacacttcagtgctgactaacacccactgtttgaaaaactttctagaatttacatgtatattttatatacactttgaatatatcttcccttccttctttacccccatacatatcaaaatatgctttaactttgactatcttgttattaacaaaagacttaaataaatatgttaactt

SEQ ID NO: 219373 - DNA, 294 bp, Homo sapiens
gagacagggtctcactctgtcacccaggctggagcatggtggtataatctcagctcactgcagcctcgacctcctgggctcaagtgatcctcctgcctcatcctcccaagtacctgggaccacaggcatgcaccaccatacctggctaatttttgtatttcttgtagagacagggtttcaccatgttgcccaggctggtctcgaactcctgggctcaagctatcctctggcctcacccaaaatgctgggacccagatagagctggtcctctcaaccaacatattgtatcaggaa

SEQ ID NO: 219374 - DNA, 311 bp, Homo sapiens
cttcccgggcgagggggaatcttaccgtatatttgttcacctacgttgattatttttcccagatacgtacacaagtttgttttctccctggtagcgaagaaaggggaaacgggggaggggacgccccaccaaagcccaggttttctcgggtgggggagatcctttcactctcttgtaagggggcggggacggccccagagatgctctggagatcctgactctgggctctggttgattcacagagtctgcacccttatttagataaccaagttaggaggaagacttaagagtaagttggggggagggggcga

SEQ ID NO: 219375 - DNA, 1387 bp, Homo sapiens
gcatagctgttcctagagtacactcgtatccagaaagtattctcacccactctttgtcctcttttatcacttaaaatcacggaaggctgtctgaaagcggctgggctcctgtaacattaaaaaattattaaactcagaaactaattctgttttttaatcataaatatgaaaactaggaagcaaactgagaagaatgaaagaccaaatcagcggatctgaagcaggccactctcaggaagactcctgaggaataattaaggctaattttaaatatcacctcctgggtatcatcatcaccatcgttcccaggtacctgtctgagatagtccattttgaaatagatataccttaaattatgttaaaatgtactaagcacttattgagctcagtgatcctgaaatatgcctaataataagctgcctagttgccacttattagctaggtttatgtctaggaggtctaggagggactatgaagaatatgagctgtttaattaggggtacttgtcatcactaatgaacaacaagaaatagtttgaaaacttctttgagatattcacttgcaaatgtcacccgaatttcagaaaagtacagtctctggagtaaagctattatacactcagagagactgttgtgctttgcatgcgttatatcatttagtcctcaaaacatgttgtcaagattggcattattatctccattttaaagatgagaaaattaggtgcaaagagcttcagtaacacactcaaactcattcaacaataaataactaaaaattgtgctatacacactttaagagtcacatgttcctcccccaaaattatgaaaggccatagaaggaattcaagaagtaggcttcatgacttatcgtttcttctcatctcagatgaattcactttaatctctcatgcccaaattgtaaaatatcattttgatcaccgtcaatattacacagacctgtttgaatgtgctcagctttttcagtaaaattagaagaaaccacaatttacaaacaggtatatgtgcattaaggaaaaaacaaaaaactaccatgtgattttagatatggatgccaattcttaaacattgtttattatttctgagctcaagtgcttagaatgtttaaaatgcaatatatttatgtggatttttttccaggatattggaacatatataaaatatgcttgtgcatatctaagctttgtatttatttcaggttatatgtatactgagaagaatatataaacagtgtatgatatttacatgttatttcattttttgagggaaattaacctccacaattattaactatgcataaaatgtaatggcagatatgacttatattgtataggactgactacaattcctctttagaaatagctgttctt

SEQ ID NO: 219376 - DNA, 335 bp, Homo sapiens
ccttttctcctcctcttctctacacccccttgcctccccatactgacatcctggacttaatgatttaagccaagggaaacaaggaaaagctcggctcagcattttagcagagcaggctgggaatgaaataatgaagaaaaaagtcattcccggcaggagaaagaatttatacgggacttaatctttctttttaaggagagggcatctgcttgttcatccctccctcattcttggtcactggtttctcgtttaattcttccttctccactccacctcctttatggccccattgccaagcttattgtcagggctccattaaatatatgtgaaatctg

SEQ ID NO: 219377 - DNA, 708 bp, Homo sapiens
cctcttagcgcctcccagcctcagacgtgtagcaagtgaaagctgtttgaattggcaaatgaggtaattattgagtagctggttggaatgtttgctactagctatccagcagaattgttagttcttagtactggtgtaattacagtaattagaataagtaaacttcttttaagataattgcagggccaggttatatagagcttgtttagcttgccttttagtattagcatgtacatcagtgtgtatgttaaaggataccctaatagattttgtggaaatggaattgtcttatagtaaattccagatcaacatatgtatggaatgtatctaatgtagtctagaccagtggctcccagtttttttggcaccagggactggtttcgtggaagacaatttttctgccagggtgtgtgtgtgtgggaggggagcaggatggtttcgggatgaaactgatcatcaggcattatattcttataaggaggacgcaacctagatccctcacatgtgcagtgtgcaatagggcttgcattcctttgagaatctgatgctgccgctggtctgacaggaggcggagctctggcagtagtgttcactaccactcacctcctgctgtgtggcctggttcctaacaggccacggactgtgggttggggatgcctggtctagattgttcttcacagattaaatctttaccagattaagtttatt

SEQ ID NO: 219378 - DNA, 232 bp, Homo sapiens
tatattaaataacaatagccagaagtgggtctaaacaatgccataaatcagaaacaataatgaacatcgatgatacttcaagatatccaccccaactgcaacataatatgaaaacatctgtgatttctcttggtgaatgtcagaggtacttatatcacttacatttataattaaaggagatgctaaatttctgtcagaattcaatgaaaataaaggtataatttttttctca

SEQ ID NO: 219379 - DNA, 208 bp, Homo sapiens
gctttttcaatctttttgaccactctatgtcttttgtttggagaagttaatccatttatgtttagggttattatcggtgggtaaggaacttactgctgccattttgtagtttgttttccagttgatttgtatatactgtgtttctttcttcctatgttgctgtcttccattgtggtttgatggttttctgtagtggtttgcattgatt

SEQ ID NO: 219380 - DNA, 563 bp, Homo sapiens
caacccaaaaaagtgaaaaaaggtgcagacatcgccatgaaagttcactacacaagagagtgggactggcaaaggacacaaagttacatgcaaagaataagaagtcaaaatgaaatcaggcttctcaagagcaactctagaagctaaaaggttcagcaagcaatatctccaaaatgccaataaaaaatattcccaacatacaggtatttgcctgtataccaaggcaaactacactcaagtttgacagtattataaatacatttttcatacaatctagaacacaaaaagtttacctctgttgatatattaagaaataatttgtatgaccatactaggacaatggcagggagtagggaacagagcatatgggaacaaaagtttgtacactattgaaattaacttaatgctaatcccaactagattgttttaaaataaaatataattgtaattctaagggaaaccacgaagaaaataactcaaaaaatacagtaaaataaacagcaaaggaattaaaatggtacactagacaataccattttaatacaaagaaggcagtaatggag

SEQ ID NO: 219381 - DNA, 724 bp, Homo sapiens
ccatggggaccttcccatgctattccctcaaaatggaatgttcttccagtgctttttccactttaatcccaactcaaagatcaattcctcagagaagtcttcctgtatttcccagtgaaggtactgttcctttttaatatattttttctattagaagcatgtttctttcctttacagtacttactagtagctggcacgaattcagaaaagcacaagcactggaaaaagcactgcgaaggagaaatcatacatataggtaacttagtatataatttagtaatatatgtttgaggcttgtcaatccctgcttaccattattacatcagcaagtagcatggtctctggcacatagtaagtgaatatttaatgaattatatacatagattactacaaattaagctgcaaggtatataaatcaacatcagatgcaattcaagatcacagcataattgctgaatcccaagtaacactgatccagataacttaagatcatactgaaacctacagcaaccattcgaaagtattaaactccaaacacgtaattcaggccttatgtttttccaaacagcatggcaattttaattctcaggcagtatcacacacttaattcatggtactattctcacaactattcatgttacccactgttcctttaaacaactaaagaaaatattcagctgaagactattctggaactagcaaaatttagactaattttctgtat

SEQ ID NO: 219382 - DNA, 676 bp, Homo sapiens
ccatggggaccttcccatgctattccctcaaaatggaatgttcttccagtgctttttccactttaatcccaactcaaagatcaattcctcagagaagtcttcctgtatttcccagtgaaggtactgttcctttttaatatattttttctattagaagcatgtttctttcctttacagtacttactagtttatatttatgcatttgtctgtttaacctaaacttcaggctccttgagagcaagaaccttgtcaatccctgcttaccattattacatcagcaagtagcatggtctctggcacatagtaagtgaatatttaatgaattatatacatagattactacaaattaagctgcaaggtatataaatcaacatcagatgcaattcaagatcacagcataattgctgaatcccaagtaacactgatccagataacttaagatcatactgaaacctacagcaaccattcgaaagtattaaactccaaacacgtaattcaggccttatgtttttccaaacagcatggcaattttaattctcaggcagtatcacacacttaattcatggtactattctcacaactattcatgttacccactgttcctttaaacaactaaagaaaatattcagctgaagactattctggaactagcaaaatttagactaattttctgtat

SEQ ID NO: 219383 - DNA, 485 bp, Homo sapiens
agaaaaaaatatgtaacgtagattagattaagcaaaaattctacagtcttaaatttgattttgaagtattagtatgacctcatgataatttcttcttttaaaaaaacctatttactacctctgcccactgaaacatgtctaaaaacaaaggtcaacccaggatcgatgtgtattccctaaatgccactaagaaatgactaacatcatgtctgggaaggaaatgtacaaaatgagcctggatcttcatgtaccatagagaaaacataacatcaaagaccactgaaagtgtgtagaaaggactcaggagccatcctgaggagcctcttactggccagagatgggtcaatttaaatatcagtaaagataatggcaatagattgaaagacatcagatatatttaaatttcttagttaataatggctatagaaataaaaacaattggccacttttgaccagtgagttatttaactatgttgaaaactggt

SEQ ID NO: 219384 - DNA, 609 bp, Homo sapiens
atgatacttagtggtgaaaagcttaacatttttgtcttgagatgaaaaacaagacaaaaatgtatgctcccacctcttctattgaacattatactggaggttgtagccaagaccattaggcaagaaaactaaatacaaaatatctggataagaaggagagaaataaaagtatccttattgcagatggcatgatcttgtatataggatatcctaaagaatccactgaaaatctactataaccaataaataagttcagcaagtttgcaggatagaagatcaatatataaaactcagttcttttaatgcacttccaagaaacaattagaaaatgaaattcagaaaacaatttcctttatcgtagtatcaaaaggaatattatacttacgaataaatttaactagcaattcttcttctggaaatatatataatacagatttacctgcactcgcagaaaatgctatagttcatagtaatttgtaaaaaaaaaaagtttagaaagcttcgtagagtatattagctgggtactggtgaaatagaccgtggttcggccacagaatgaaacactatgcagccaccaaaaggtaagaatgagggaaaggaaggaaggaa

SEQ ID NO: 219385 - DNA, 467 bp, Homo sapiens
cagggggtcttccagataatagggtgaattcaaaagttttctaattggcaattggttgagagagttactttattgtcaaaagacaacagaagggaatgtctaagttaatataagggcttgtggagaccaagtttcccattatgcagatagaatcaatagaagggaatgtttcttatcaatttaaagagtatgtgctattaatcttaaggcctcagttttaatgttaatgctgttcagctgtgcttgaattccaaggaaggagggcataaggaggcatgtccaacccccacttcccattataacctaaactaatttttaagtttaattttggaatgcccttggccaaggggagggtccatcagtgagttgaaaggcatagagttttatttttggtttacagtactctggctttgttgttaaaaattagttctctttagagatattcaaggtctaatatttcttatttt

SEQ ID NO: 219386 - DNA, 357 bp, Homo sapiens
cccctcttgtgctcagtcgcgctgttcttgaggtctcttttctctacaccatggttttcaacttatttggggggaaatgccttgagcataatacaatgggaaaatattctctacccctttctcttcagaattcattcttatctcttcctgtctgaacaaaaactgtatggaatcaacaccaccaagttctgtgggagaaaagaaaaaccttctccctttgctctgctggaagctggagagtgccagacccctgtgtagcagtgcatagaattctagcttcttttctcctttctctgtatattgggttcagagagtaccgtgtgtctctgtgtgaatatggaccatcatttatcaaca

SEQ ID NO: 219387 - DNA, 322 bp, Homo sapiens
cgtccttatcatacctaccaggacaggattggcatgggttgatggttactgaggctgagcgatggcatgtgaggttttattattttattgtttactttcatctattttcaaaaagttaaaaaatcagccctccctttgctgaaaaaagaaaaaaagaaaagaaaaactacaggttttgtccctgcctcctggagctttcagttgtagagagaaagcaacacttactgagaaactaaaagatgatgtgtgttgtaaaatgagagtgcagggtgacattgcaattgagcaagctatcttgaggtaggtatgatgaaggacgagt

SEQ ID NO: 219388 - DNA, 379 bp, Homo sapiens
tttccttccttcctttctttcttttcttcctctcctttctttctctttcactctttctctctttcttctctctctttctctctctctcttttctgtcttctcttctcttcttcttttcttttcttttcttttttcttacaggatcttaccctgtcacccaggctagagtacagtggcacattcacagctcactgcagcctcaacctcctgggctcaagcaatcctccttgtctcagcctcccatgtagctgggaccacaggggcgtgccaccatctccagctaatttttaaaattttttgtaaaaacaggcctcactttgttgcctaggctgctacactcttttaaacaatcagatcttgcatgagcaagaggggcacc

SEQ ID NO: 219389 - DNA, 254 bp, Homo sapiens
agatcctctttccaatccttcaacattcttattagcacagtcatggttagcttagaggttacaatcaattgggggcaaaatcagggagtttacactatggcaacagagaacatctcattttcatgtgtacgtgggagatctttttggaaaaaaaatgtatttcaactcattctcataaaaaattggggccagggttttgtgacttttccaaagctttaattaataaatcctgatttggttgctttcaaaagata

SEQ ID NO: 219390 - DNA, 461 bp, Homo sapiens
catcacctgttagcttgttagaaaagcagaatctcaggcccactgcagacctattattattattattatttagagtctcgctctgtcacccaggctggagtgcagtggcactataatggctgactgcaaccttgacctcctgagctgaagcgactctctcttctcagcctcctaactagctaggactacaggcatgcatctccgcacccagctaattttaaaattttttgtagagatgggatctcactaggatgcccaggctcatcttgagatcctggcctcaagcaatcctcccacctcagcctcccaaagtgctggtattacaggtgtgagccaccacatctggctttatcatgtgtgtgtgtgtgtgtgtgtgtgtgtatgtatatatatatttattattattattattattattattatttttttttttagatagagtcttgctctgctgcccaggc

SEQ ID NO: 219391 - DNA, 508 bp, Homo sapiens
gcaccgcgagctgtagacagagccgcggtctttctcgattgagtggctttggtggccatgccaccgcgctcttggggcagccgccttgccgctagtggccgtggccaccctgtgtctgcccgattgatgctgccgtagccagctttcctgatgcacagtgatacaaataatgccactaagggaaagagaacagaaacgtaatgggcgctgagctgggaaaaccagggagaagactgatttattagagatttcagaaataaaattcacattcattatgatatctcattagtgaaaatttccattaggggattgtaaataatttaaagctttttttttttcagtgctatttaattatttcaatatcctctcatcaaatgtatttaaataacaaaagctcaaccaaaaagaaagaaatatgtaattctttcagagtaaaaatcacacccatgacctggccactgagggcttgatcaattcactttgaatttggcattaaataccattaagg

SEQ ID NO: 219392 - DNA, 525 bp, Homo sapiens
atggaataattagcaataacaattttcttgaattgctctttactttaaagactattagcaatttcaaaaagaataaaattcagttttaaagacaaattccataaaatttcatttctaaactgaaatttgcacttaaccagaaaaaattctatagcattcagattgtatagttttacaaattgaaactctaagtggtcagattgaataacagaagtaaagtaacatgctctgtttttttggtctttataaatactgtgctctcattgctaattctgaatcttccacttaaacataaagatatgtagttccatgggggctgcagacatgaactgctcctaaggcaagcttgagtgattttaagctatcatgaacttactactattgaaacacatacatatagccagctatatgtatgtgtgtgggggggtgactatgaaatagttctccaaattaactttcatgtacaatacaatgttcattaaaagtaattaaaatgtgcaaatttgaagtttacacaaatattat

SEQ ID NO: 219393 - DNA, 353 bp, Homo sapiens
gtaatagctgagactgcaacacatgcaccaccatgcctggctaatttttttgattttttttttagtggagacgaggtgtgactatgttgcccaggctggtctcaaactcctggcctcaagcattcctcccaccttggcctctcaaagtgctgggattacaggtgagagcctctacacatagtgggaagttagtttttaatggtagttccagtttgggaagaaaacattctgcggatggatgatgatgatgattgcagaatggtgtgagcgtagctaatgctgtagaactgagtacactccagcctgggcaacaagagtgaaactccccccactgcccaaaaaaaaaaaagaac

SEQ ID NO: 219394 - DNA, 150 bp, Homo sapiens
atggagagggagtgaaatggagaggacaaggagagaaagagaaaggggagtgcgtagaggagtgatcactcagaatcaaagtcaaaaattcatttttctgacttcaacttgccacaacacacactttttggaaaccaaactttccatttg

SEQ ID NO: 219395 - DNA, 311 bp, Homo sapiens
gactatgagcattgggatgttggggatgactggatcacaagtgagcatggtgatcgccaagaggtgataaaattttctataaatacctaaggagattagtgtggaatgtgaccattatcaaaatccaggagaataaaggaggaaagattatccaaagacttcttcagctctcaagtgggatgctttactattccactaagactactgacaaagggaatgagataactatcccaaagaaatccaagagctatcagagaagaaatagacccatgataaaaaaattgtaaaaataaaattacaaatgtcagcta

SEQ ID NO: 219396 - DNA, 290 bp, Homo sapiens
gacaatcagcatttactgagcacttactgtattccagggaccattttaaagctttacaagtattcactcatctaaacaaccccattcttacatgtacctaattagacagatttgttggtgttcagcctaagggattgacacagcttatcaaacaataactgtaagaacttgctgcgcactctggcacatgcctgtgatcccagcactttgagaggtcaaggcaggcggattgcttgagttcaggagttttgagaccagcctggacaacatggtgaaaccccatctctatt

SEQ ID NO: 219397 - DNA, 493 bp, Homo sapiens
gacaacatctacacaatgattaatctggtgccacctggaggcagccggtccaacttcctgatgggtcccagcttggacggtccaatgggcagcatgggtggcatggagccacaccacatgaacggattgttagggtcaggcgacataaatgacttccaaaaaattctcctaacaacgtgaatagtattagcaatcttccaggcacccctcgagatgacggcgagctaggagggaacttcctccactcctttcagaatgacaattactctccaagcacgacgatgagtgtgtgatccccccttctccaagatgctgagagagctggcattgcaggcaggaagatgccagaaattatgcaagaagtgaggtgtcattacccaggagctggtggagagggcatctcctgctcccctcaaccccctcccaccccatccacgcccaccttttccaattttagtttcatgcagtaaaaaggccgaactttttattccat

SEQ ID NO: 219398 - DNA, 866 bp, Homo sapiens
aaaggaaaaaatagagaattacctctgtgataatttttataaaaagcagcaataattcgaatggctatgcaagttaatgtttttagagtcttttcttcagtctaaaatgagccagagttattctttaataatctgctgtttatgcctttggggagtatggtacccatgagccaagcctccctgaaattgtacagagggattttataattgaattaaaatttaggaatgcaatagcttgtaaagagcctgctctccaacatagggtggtctcattcttctggagacttttttagataaagtaaaataattgtttaaatattttgtttaaaatatgactgtttttcctccctttttcctagcagaaataaagctgtaagtcttaaaaaaaaaaaaaaaaaaaaaaaaaaaaaaaaaaaaaaaaaaaaaaacctcgtgccgaattcggcacgagctggtgaagacatctgattttctttatagccaagttaggataacaaaatgcaaacaagtcattaatatttactatatgcaagatccagaaagatgaaggaaggagtaagaagttatccttcggggaactattcaaagcaaaaatgcaaaataccagggaaagctttgaagaaccaagatttgagcaggttcttagaatacagattggattggatttgatttcaagaaagatgaacgtgtaaagcaaaagtgggaagccaaaaacttttttccaaattagaattaagcattctttcaatgaacatttggaaatcaaggtagaaaaatatccctagggcctaactgaggagtctgaatgttgttgggttttgatagtaaccattccaagatttggttattagaactgggtttctgaa

SEQ ID NO: 219399 - DNA, 417 bp, Homo sapiens
aaatcagggaatagatagaagattcattcaaataatgaaagatagactgatggatttttatgtaacagaataggaaaagtttatgacatgttttcagattccaccttgcaactaatttttaagaagctaccacttgtcagccaggcacagtggctcacgcctataatcccaacactttgggagtccaaggtgggcagatcacttgaggtcaggagttcaagcctggccaacatggtgaaagacttctctactaaaactacaaaaattagctgggcatggtggtgggtacctgtaatcccagctactctggaggctgaggcaggagaattgcctgagcctgggaggcagaggttgcagtgagccaagatcgcgccactgcacaccagcctgggcaacaagtgcgaaactctgtctcaa

SEQ ID NO: 219400 - DNA, 430 bp, Homo sapiens
gcaaaatgaacccactgggtagttacaattgtaatagtgttatgaagtggggtctttaagaggcgattaggtcaagagggcagagcccttatgaatagatcaaagccattatgatgggagtgggttagttatcactggagtgggttcctaataaaaggatgagtttggccagatttcctctctgtctggagtatcacaatttaaacatcatgcttgtaaacagtacagcattgactttgtcacttaatgaagtattttcttcttttacatttaatgtagttattgatatgtttgtatttaaatctaccattttatgaagtgctttctgtttatattgtcttcctttcttgttttctttttggatgcaattttaattgcattttgccctctgaattatcttgaggttatataaaaatcacttaggaagata

SEQ ID NO: 219401 - DNA, 929 bp, Homo sapiens
atttcttagcctatgtataacttctaaatagcctacactaaatggtaactattacctatgttgtgtttgttattttaaactttaatgttatttattttatttcattttccttccacattacctctgctgttagcagctttgagaaatgctgctataggatgtgggaagtcattaaaggatttaagcagggagaggcaagatcagattaacatttcagaaaaatatttactgttttccagctgaaactagtagagtacaatttactttctggtcacagcacacagcagtcacatcctggaggaactgtacttctctaagatctagtctgtcctgtggtttaaatgacctttagcaaattgtctttattactttgtacactgctttcaccagtctgctcttccatggctaacggggcagaactgttatttttagggttttccacatccagtatgttcataagatttctaccctgtgtgaacttccagatgtcgaataaaggctggatgctgaccaaagacctttccacattttttacatgtgtgtagggttgctcaccagtagtattcccctgatgcttcataatggttgatcccagagagaatgccctttcacactcattacattcatagggtttctgtccagtgtgagttctgtgatgggaaattaggttagaactttaaacaaaggcctttccacgtttgttacactgataaggcttatttccaatgtggattctttggtgttacacaagattagagctgtagttgaaggttttcccacactctgccttcatagaacttgtctttatagtgaaatctctggtgttttttaaattgtgttagtcctttttaaggcttaccatgttcactacactacacaattcctctccatggtaactatttgggtgctcattaaaggctgtactctga

SEQ ID NO: 219402 - DNA, 654 bp, Homo sapiens
attaataagaataaaataatgatcatcatgtagcctaaagaaagaagttgactttccagctgtttttttgagaagacagagttgcattgactgcaaagttaatatgaactttataaagtgtggttgttgactgggcatggtggctcaggaatgtaatcctagcactttggggggctgaggtgggtggatcgcttgaggccaggggttcaagaccagcctggccaacatggggaaagcccgtctctactaaaaatacaaaaattagctgggtgtggtggtgcatgcctgtaatcccagccacttggaaggctgagacaggagaatcgcttgaactggaaaggtggaggttgcagtgagctgagatcacgccagtgcactacagcctgggtgacagagagagactccttctcaaaaaaaaaaaaagaaaagaaaaaaaaagaaaaagtatggttgctaaaagaagttgccatcacctgaagctacattccttggatgatgacacctctactttctgtgctggagagaaggtataggtggagttccagaagccatcttcccagagagaccagggctgactagaattctgaagagaaggctgttctcctcctctccctgacagttccccagccctgccctcttctttctcttatcaac

SEQ ID NO: 219403 - DNA, 442 bp, Homo sapiens
agtgctggacaactgtggaattgcagcgtgatacctttcacatctgggtcatctccatatgatatcttcttcctggtacaaggccagaagttcaccccacgcacaacacctatggaagccacttacgattcaaaggacagtttttctgaaaaagggtgcatgatgtatacttcccttcaacactaaaattctgctgcttaaactttgtaagtgaaggaaaggactggttctcttctactttggctgtcttccttgtttcctatttattgggtgcttgctttgggcaacccattgtattggatgtgctctaaaccacaatctttgctcctaaggagtccgtagtatttatcgggggatacgacctggataattcatataagatatgaatttctttctttttcttttttttcttttttttgagacagattctcactctgtcgcc

SEQ ID NO: 219404 - DNA, 389 bp, Homo sapiens
tgctccaaaatctaaaatgttttgagtgccgatatgatgccagaagtagaaaattctacacctgatctcaagtgactcagtaaaaacaaagaacctgacaggaagccagctggcaatgaagtctgggaaatatcgtgccccagcatcacaaggcagagaattgaagagtgatatggaatcaagagacaataaatgaataactggcatatacactgtgaatgttagggcatgaataaaattttgagacctcattctattgaaataattagtaatgtaaaacactcactacattttaagccattgtattttggttatttgttaatgataaatggaagataatatttggtgttgaagaggataagaactgattaaagaatgacttggtttac

SEQ ID NO: 219405 - DNA, 452 bp, Homo sapiens
gtttgtttttgtgttttcacatgaaagtgtttagtttattaatattcttgtgaaaaatccacaatggccacagattacaccattgcagcacctttactccttcagctttttgccagcaccaacattggcctttgcagtccccctgactttcctcattctgttcttgcgttcctctcattgctttcttgaggtctttttcttctcatacaggccatgtcttgcaagtctatgtttgggttcatttttctttgcataatccaggggatcataaatcatgccaaagccggttgtcttgccaccaccaaaatgagttttgaatgcaaatacaaagatgacatccagtgtggtcttgtacattttggctagtttttcccaaatttctgtcttaggcactgttgccttcccagggtgaaggatatcaatgactgtttgtttcctctgaagtcgtcggt

SEQ ID NO: 219406 - DNA, 548 bp, Homo sapiens
catcttgagagtttgttagctgacaatatgttgtaagggcatcacaactgagcagcatgtttcttggtggaatggtcttgagaagcatggaaggcactgctccatgagatgagaagccatgaccagacagccacagttccactttaagctgtcatgtgctgtcagtgtagtcccactcatccccttctctggaaactatactctttcacccacctggccaccaggacattcgagggtcacatgacttgccacccttgccacagtgggctggcacagaggtgggcaatcagctcaagctaggactgttaggagtagcaaatccatatgggtctacagcaacctccatttttgccttgtcagaagaaagcattcaaccaaggggcataaggcagagtgagaaactgaggcaagttttacagcaggaatgaaagtttattgaaaagttttaggtcaggaatgaaaggaagtaaagtacaattggaagagggcgaagtgagctgcttaagagattcaagtacctggtttgactgttgacttgggatttgata

SEQ ID NO: 219407 - DNA, 2102 bp, Homo sapiens
  misc_feature (439)..(439): n is a, c, g, or t
tttaaagagatcaaactagataaaagtttactttattcttcatgatgtctgataggttgtttgctgatataggtgctgtgtctggttttcctttcatgacttgtacctagtgtagctatttatagtgtatttgacaaacttttccacttgtagactcaggtaggcctgcttgacctcctctggggatatttgttaatgtcttgtcagagttgataaaattttccatgttcatgctttcttttgattctcataataatcttctaaggtaactaaaaaagaatccttattttcacatttgattaaggaagctggtcctaagagattaagtcacttggtcagggtctcttggtgaggtacttaagtgaaattggttttccaggtgctggccttccttttccaaactaatcctactttgcgtgtgacctgaaaaacatttttntgttacctgtttttgtttgtttaaacatgtacttgtttattagacgaaacagggagcccaaataaaaccagatgtgagctgcttttaaccatccctgaatcgtaatgatccatgtgtgaattatccctttgtagctagtttttaatcccagactgggctcttccagtttttcagcctgctgttcaagtctccccagcccctgacttggttttgtcagagcagattagagagaaattctacagtgcgagaacacgatgtgtatgatttaggaagcagaactcttttttttttttttttttttgagatcagagttttctttgttttccatttacctgaagtaatgcattgtttcatttaaacttaaatagctttcaagattgggttcatgaacatgtcagtgggcagagtttcatatctagactcgagagatgacaaaataaatatgtctaagatagaattattttcacacctgccttttccctttcaagttctatcatcagtgattgagaatttaggctttcaagggcacacttggatttaaatctcagtttgtccatttagtagctgtgaatgcccttgggcaagttaatctctttgccttggactggttatcctccaaatgggataaccctacctataatgaggaatgaaatgcagtaacgaacaggaagccactaagcacagtgccttacacagaaactttaataatagataaaaatatttgtatcaccttctgggtgccaagtttgatgctaggaaataatccaatgggctataaaagtatgatttggtaatttgtttggagcatgggtaaatgaaaacagtaagaatacataataggcttatataaaagttttgaagagagagcggttatgctgttggggtgtggctttgaagggcttaaaaataatcaggggtgttgagttttgatcccaaggtttaagaatgactttaataagcatgcaagttaggatatagtttggtcctaagtgcaaaaaaaatctaccctgaatccaccctaagcagaaaataaatttgttgtgaacaaacaatagatacatggagcagtttacaggatctgagaaacacctgaaaaatgggatcagaaaggtggacgctgggcagctctggggctgctggtggagggagctgaagccacatctctgtagagcgtcccccggtggatgagccaactccaacccttttctgtctttttctgcttgagattcaaattccatggacaaacgttcaaatgtcccagtttgagtaaaatgtctaaaccagcctatggagataagttattttcatttgacaaaactgggttgcttctatcagaaatggggaaaatagatgttggatagcaaaagtccaccatgtccaggccaggcgctgtggctcactcttgtaatcctatcactttgggaggccgaggcaggcggatcgcctgaggtcaggagttcgacaccagcctgaccaatatggtgaaaccccgtctctattcagaatacaaaaattagccgggtgtgctggcgtgcacctgtagtcccagccactcaggaggctgaggcaggagaatcgcttgaacccaggaggcagaggttgcattgagccaagatcatgccactgcactccagcctgggctacagagcgagtctccatctca

SEQ ID NO: 219408 - DNA, 294 bp, Homo sapiens
caggctaagtaccatgctatggggcaactgacatttaggcatcagtgaagtattagaagctgctgctagcattggatactctggttggggaggggcactagaagtcagtgacccaacaagcagtcaagggtgtgggatagcagctagtctagacctacaacgaggcccaggcatcccagacagagtagacacatgaacagctgggtggatgtggggacttcagcccaggtggttgatttctcaagaaaaagaaatcatcttcactagcagacaaggttggcttgatcccgtgtg

SEQ ID NO: 219409 - DNA, 493 bp, Homo sapiens
atttaaaatagaatagaaggatacacacccaattattgatagcattgtctctggagattgaatttgaggctgttgattaaaaggagactttagctttgcttgtagtttttatacctgaaaaagactggtagcatataaaataaatcttaaaagctaatgatacacaatgacaatatgaatgtttacttgtaatagtgtttttcttgttctttctcacaacaggccaagggaagcctgtgcccatagaaggaaatgttataatggattcatatgccctatcagatgctcaactattttatgaaaaatctctctagaaaattagtaattagaatattcttgtttattatataatgtgaaattagcacattttagcaacttgatgatgctgtgtttttatattttaacatttctgaaattggactcctttcaactgatgatatcttagattcaagtaaatatttaattattaaaaatttgaaaatcagatgccagt

SEQ ID NO: 219410 - DNA, 746 bp, Homo sapiens
attcaagtgatcctccctcagccgtccaaagtgctgggattacaggcctgagccgccacacccggcctaacacacttagcccctttatggcgtatcctcccacagcaaccagcaaaattcgaaatgtcagtgggagcatgttggcaccctgcttagagtcctctagagtcttctcccacctgcctcctatgacctgtgagaccttctgtgcgcctctcccacctgcctcctgtgacctgtgaggccttctgtgcgcctctccccctctcagacctgcgcccaggcacaccccatggatatgttcacacacagacataatgctgggattacaggggtgagccaccgtgcctggccactccatcattttttaattgattcctgttgaaatgcgagtattttggatatattggattaagtcaaatatattgttaaaattaatctcaataatttactttaggactttacaatgtggctactagaaaatttacaattacatttgtggctctcatcatctctcttgggcagtgctggactagagagtggcaagaatagaagcaaggaggccggctggagcccatcacagaagcaggggcacaagatgatggagtcgagcatcaagggtaggaacagtgtaggtgtaagaaggggtcagattcaggagacgctattgtgataaaatacacataacaacatttaccattaagtacattgacattgctatgccatcaccaccatccatccacaga

SEQ ID NO: 219411 - DNA, 517 bp, Homo sapiens
gctgtagcttatgctaaatgttggttggaacagacaataagttatggagaacttcagaggacactaaggttggatgggattttggaagttgtgcaggtcaatgccactccagctattggctgagtttcactaggttaatacatgaacaacaacaaaaataacctagatcagaagttaaagatcattttattgactatctgccgtgtctgtgccattgcagtgtactaggtgcacttacgagtcctctacttacaaactgcttttcacaaaatatgaaactccaggcaaaggttcagacatacgacgtttgtttttaaaatctttctacagtcttgtatcctttttcctttccttccttttaccctttttaaaatgtgttatgagttttatcttagactaacatcatctgtaatgttgatatacgccagtattcagttgctgtgtttgatgaatcataaaatggtgtaaaacttcaattagtgtactttttaaataaagtatctatgaatgcatccag

SEQ ID NO: 219412 - DNA, 368 bp, Homo sapiens
ttccctaaacaaaacttaattaaggctggtgggggtgaggtgaagaggatggggaggaatgttctatggaagccagtaaacttagagccaattgtgttcctccctccagccaataaatatgacactggcacttgcatgctggtgagttttaacctttggcttcttgaggttatgttgctcttcttcttgcccttgtctctaactgccctcactttgaaaggaatctttgtgtacttgttgctttttctttaaagaatttttttcagaattctttttgaaatcagaaagagtaaaaaaatacacatatgggatgtaacttatttttcttttatgtttaatatagaaaaagttggaagctgtagacaagc

SEQ ID NO: 219413 - DNA, 782 bp, Homo sapiens
ttgcagcagtttttcaacaggtgcaagtgttaaagggtatgatccttcagtggaacaaagcctccgtgtcacctgagggatagcaacatgcctacaagcactgcaagagttgtttgatgcttcaagaaaaaaggagaaacagcttcctagaacaatgttcccaactaaagccgtctgtattatgaagcctcgaccttaaacgcttgaagattcttccagcataaatgatctttccgatgtcctgttagaaggttcaagttagccttgtgtttcaccacttacctacagtgctgcgcatctcaccacctcaccatatgggcaccatgggcaccaaatagaaattataatcgtcatcatcgtcaaatgagggttatcaagagagaaaagcgacagtttatgcttctttttttttaatttttaaattttttgtaaagacaggattcactattttgcccaggctcgtctcgaactcgcagcctcaagcagtcctcttatcttggcctcccaaagtattgggatcataggtgtgagccactgtgctcagccagaagagccagagttttgatgcgtcttaatgtactctttcaggtcattaaatgaaagtcatctgcaagtgttgatagaaaatgtggctgggcgtggtggctcatgcctgtaattccaacactgtgggaggctgaggcaggaggatttcttgaggtcaggagcttgaaatcagcctggacaacatagaccccatttctatttttaaaataaaaataaaacaaaaagtgttacattgt

SEQ ID NO: 219414 - DNA, 560 bp, Homo sapiens
gacaggggagcaagccaggtatgctcccacagtaggggctaggaagtgagcaaggcctgagtggcagtggctgggtctgggaagtgagcactgctgtgatctgagacagggatgtaagtggggcttgagttgcttctgggacttggttgtgagctgggcatgggctgatgcagtcagggtggcaggggtgagacccagtgatgctggagcatgaaggagacatgcattttccaccactggtccaggctgtggccaccaaagttggccccaccctctccagtagcagagcctcagtgtggatactaccatctctcacctgagcactccacctgcctgaagatcactccatgcccactcacaacagctggtgcctactttcaccagtggggggcctgagcacaagcccacccagcctggcttcaagacagagcactcctcctgggggcctgaggttggacctaacctccctgctaccaccacctcagctggcacctacctgccagcaccacttgcaggcctggagactgatccacccaactcatcacagccgccaacatcag

SEQ ID NO: 219415 - DNA, 443 bp, Homo sapiens
caattcccaattttaaagtttgctacaaagcagcagtaatcaagacagtgtggtactggcataaagatagacagatcaatggaacagaattggaagtcctgaaacaaacccatgtgtcaactgatttccaacaagatgccaagactactcaatggagaaagactagccttttcaacaaatgatgctgtgacgactggatatctacatgccaaagaatgaagttggacccctataccatcccatatactcaaatgaattcaaaacggattaaagacctagatgtaagagctagcactatgaaactcttagaagaaatacagaggtaaatcttcatggcctcaggcattggcttcttaaatataacatggaaagcacaaccaacaaaagaaaaatagataaattcaatttcatcaaaattgaaaacttcatcaaaagacaacatc

SEQ ID NO: 219416 - DNA, 583 bp, Homo sapiens
gtgaaaatgaaaataaacatccagagatttgcacaaaatcttaagtgaaaggaatgttcttcttagtacgtgggcttagtctgaaggtgacttcaattcttgacagctttcatattctcctcacatagagagagtgtaggtgagttttacagacaaggccaggacacagcttaagtctccttacttcaagtccagggctttttctactctgatgtcatctggttcaaccttagtttttcatgttggagatctaagtaccagaaaaattcggttgatttgcctgatattacatagctggatatgtgatgccttgctagtcagactaatgtaattcctactgtcacctccccacccattactctctgtcatcctgtttatttcctcaatggtatttattacagtttgaacttgccttctttatttgttttcttttgtttattgttgtcttcctctctagaatgtaattgccatatcttcctggttctctgctctgcacagcaaagtgcctgacacatagttggtacttaaatatttttgaaggaaggagtgaatggttggatgggtgagtggctagttggaatag

SEQ ID NO: 219417 - DNA, 567 bp, Homo sapiens
aacatgatcttagggctgaatcttaaaaaataaaagataaacctgagaaaagccgtagaactgtaaaacagctcagcatgttttgaaaccagcaggtagataggtatgacgggtatgaagagtgtacaaggatggaatagaagaaaacaattcctagagctagaaagtaaccataagtcaggtgacaggagacctttggggccttactgaggagtttggattttatcctggaagtaatgggacatgaattgacaggactctgcaatgttagggattgtgctgcagaaggaagatgtctggaatgactcttggctttattgatggtttgaatggctaggtagggtggtcgtccctgaaaaaagggatatattttgcatcttttatgtgtttacatcttcacaacaattttgtgaggtagtaaacattaacattttataaggaagaaaagtgaagacttgtataggttaaagattttgtttgatttcttgcagctagtacttgatgaaatcatgtggaacacaggagttgtctgatcccaggatctgagcttgtagccactattgtagg

SEQ ID NO: 219418 - DNA, 662 bp, Homo sapiens
gccccgcccccgcctcggcgctctgagcaattggactctgccagctctaactccggcgggactctgaaactcaggcaagagccgaggtgactgggtcctttgaaatgggtaggggacacgtatccggtagaactaaaactagcgtggggatttgaagccaaaactctcaagtttttactgaatcttaaaaccatcaacttccaaatgtctgcatttgtctttacaccacacaggtctcccctctatcatggcatttgtcgaaaaggagggtagatgtttgtttttcgcacctttactttggggaattgtaaaatcaggaagataataagaaacaattgttagaaatcagtaactaaaaatgcttatgaatatttccaccaaaataatgaccagtgtttgtgaggtcaatagattcaggattaccaaataaattctttcattatattttaagaagtacacagttaaaatagaccaatagcactttaacattaatcagcttaagattatgcaatattatatataattctcaaatcccttaagggagatcagaaactactgaaatataagagatttttgtcacctctgaaattgtgaagaatatgtttttttttctttcagcttttctaccaagtaaataaagcttccctttaggcattttaaaa

SEQ ID NO: 219419 - DNA, 378 bp, Homo sapiens
gccccgcccccgcctcggcgctctgagcaattggactctgccagctctaactccggcgggactctgaaactcaggcaagagccgagctgctgtgtgtgaaaacctgactccagtcctcccagcctctaggaccctgcccagacctggcctaccttcttcctcaccgccactggaaaaaaacagacgtcaaaagccttaacaaaatactgtctgatatagcaaaatggaacatgtttcctactagaagtatatgacccgaagggggaaaaatctgactcattttaaaaacaattgttaggggtgtgtgtgttttgagagaaagaaatagaaaagggccaatgtatttgctattaaaaaaatcttcaaaataacagaaaa

SEQ ID NO: 219420 - DNA, 399 bp, Homo sapiens
tgggggcagcttgggccgtcgcctctcccgtgtatgtgaccagaatccccaagcaccccagggctggagtgcggatctccacaccttaccatgacaacagcacctcagctttgttgtcaacctacccctttttaaaaataacttcgttgagatacaattcacagaacatatagttcacccatttaaactgaacaaatcactacttttgggatattcacacagttgggcaactgtcaccacaatcacttctggattattttcatcacccccaaaagaatccccacacccattggcagccactccctattgcccctctctcccctgacaaccactaatcaacattctgtctggatggatttgccgattctgaaattgcacagttgtccttttgtgtctgcc

SEQ ID NO: 219421 - DNA, 273 bp, Homo sapiens
gaatcagctgggcgcagtggctcacgcctgtaatcccagcactttgtattgtcacatttgatgcttagaaataaggggctcatcttactaatcctattgatgccaaagcaggggcatgatgatggtgatgatggtggtgatggtgatgatgatattgatctttggaccacaccccagatgcaacctctaccacctgcctctctcctcaatactgctggcctccctttttccaatcccgcctcattacagtcgtccctagatagtcagtgagat

SEQ ID NO: 219422 - DNA, 648 bp, Homo sapiens
tgcccggccgcccctactgggaagtgaggagcccctctgcccggccaccaccccgtctgggaggtgtacccaacagctcattgagagcgggcgatgatgacagtggcggctttgtggagtggaggtggggggaaggtggggaaaagattgagaaatcggatggttgccgtgtctgtgtagaaagaagtagacatgggagacttttcattttgttctgtactaagaaaaattcttaccctaaaacttaaagtataataaaaaaaaaaaaacttcagttttctaaaaattatatttaaaattgtaatcaaaatgtacctagtttataaatgtttattttgtacttaatacctgtaaagtcttagttttcagacattaagtgactgtatcatgttcggtttaataaagaatttatgcagcaccatttaacgttttgaaagtattatttaaaagaaaaagactattcttacggaataatcaaaattctgctttcttaattgtaaaaatctggtttaaatatcccatggctcctggccaggcatggtggctcgtgcctataatctcaacactttgggaggccgaggcaggcagatcacttgaggtcagaagtttgagactagcctggccaacatggtgagacccgtctctact

SEQ ID NO: 219423 - DNA, 514 bp, Homo sapiens
tgattttcttgctttcatgcagttaagccatggtgctcctcttgttatatcacccttttaaacccagagattgatagtattagccatcatttgctgagtgtcatgcactattctaagtgctttacatgtatttgcctaatcagcgccctgtgaagtacatcctgtctccattttgcatataaggataccaaagcacagagttggagggaagatagttatattcccttactttatttatttatttttttgagacagggtctcgcactgtcgcccaggcttgagtgctataagaccttaagtttcccctttcaaagtagtttatagtgtctaaatatcttacataaaagtatatatcaaatagggtggcagtctggaaagatttaaaatccagaatgactggaaggttgggcaactaagatttcttaaattgcagctgttttcaacatagatgtgttgtagagtcttttcggtttcaaaattaaattgactataaatggagtgtgcttaattcaga

SEQ ID NO: 219424 - DNA, 386 bp, Homo sapiens
tcccatgtatttaacattgtctctaaattacttataatgcctaatacaatgtaaatgctatgtatatagttgttatactgtttgtttagggaataatgagaaggaaaaagtctgtacttgttcagtacagatacaaccattcttttttttccccaaacatttttgatcttttgttggttgagtgcacggatgcagaacctgtggatatagaggactaactgtgtgttattttagagtggtagatgaactttggtaggtgctgtgtttggtatgtttgtccatccattttccctactacttgccagttatataagacagcatgagtaataagacttctgacattttaaatgcagaaatattacataaatactattacataaagattt

SEQ ID NO: 219425 - DNA, 364 bp, Homo sapiens
tcaaagctttgttttaaagccttttttttctaactgcttgacttactatatctacagttacatccactagtacactctgttctggagaagtttgtccctaagcttgactagttcacctgttctctccttctagaccatacataaaagccgtgcctttgagttccccagacctcttcctcctccccacccacgcacacatatacaccctgggtcaggtagctcacctgtaacctgtaatgtacttctttgtgctatacctagtgcaggtcgcttattcatttactagactgggccctgggaataaaagattcattaaacacaattcttgtcccccaagtccttacaggagacatgattacggtac

SEQ ID NO: 219426 - DNA, 818 bp, Homo sapiens
aggaatgggattttgccatgttgcttaggctggtctcaaactcttgggtttaagcaatctgcctgccttggcctcccaaaatgctgggattacaggagtgagccgatgtgcttggccaacactttttaagaatgtatttactcctttttatttttttttggatcctccttttactctctgctccatcctttctctataacatatattaacatagtaagtttttgtatatggtctccatttacacatatttacacacacatttctaaagatctgttagtttgacttatgaaaatcaaatactacacatgcttttgtgcatcttagctttcattgattttttttctgttaatgactgcataatattctgtggtgtggacttattaaaacatccttcagagaagggcattcatcgtctctgtctccagtcctctgtgactacaaaaaaagcagtactgtactgaacacactgtatacacacttactggtacttgtatttctatgagataaattcctaggtgaggtaaagctttaacacgttactagactgttttccctaaatgctgtagcaatttattgttaagcatgtattcccagtctttgcatctcttcaagatattttatcactctaacttcatgtatattgaccagctagattttctgttatgatctgtcttttcatatcctttgtccattttctattttattgtttgttccctacttgataatctgtaagtacagtttctgatacattattaaattgaatatgttgagacattaaggaagaatttcttaaacaagtcataaaacatacaaattat

SEQ ID NO: 219427 - DNA, 707 bp, Homo sapiens
gtagggaggctgcagtgcagggaaaagaggtcgcagcagctgatgcatcacagcagcagttcatagccgatgcatcatccccatttctgatgtttctctccatatggaaatgtgattcttctgatttctttctcacttactcctcgccaggagtgacataatctcattggttaaattaaaaacaaaacaaaactgggaatttttagtttagtttctgccttttttccttttgaaagttaactgctcacagcaagcatacattgatcactgtccttcaaggtaaagtgaccaggctcatctctcttgtaggaaggtctgctctggtccagcatcacctgtacctctgactagctgtttcagaccacccaattctgggataacttatgcagcccttcttggtaagctatattctccaacttagccattaacggtaataaagatgatactgtttgtcttgttttacattttgttcagaaaccaagtgtggaaaagatgatgttattatttggatcccctcaggaaacctaatagttgtcaacagacctaaatcaaatcatggtggttcagatttttatttactggaactcaatttcttcctctgtaaagggagatggttggatggttcccaaacctgaatgagctttggaattactcatggttttgaaagtgcttttttttttttttttttttgagatggagtcttgctc

SEQ ID NO: 219428 - DNA, 292 bp, Homo sapiens
gtagggaggctgcagtgcagggaaaagaggtcgcagcagctgatgcatcacagcagcagttcatagccgatgcatcatccccatttctgatgtttctctccatatggaaatgtgattcttctgatttctttctttcttcttcccatgccagatgcttgcttccactcccccttccactggacatcagactccaggttatttggcctttgaattctgggacttgcaacagtgacttcatgcggtctctctgaccttcagccacagattgaaggctgcactgcagcctcaccag

SEQ ID NO: 219429 - DNA, 492 bp, Homo sapiens
gacgaggcgggctcggcaggacgctgctgtgccgtcccgtgtggatttggctccaggtcgtcctgaggatgccgcgcagaagccgtgtgggcctcgggacgcaggcctgcgtggctgcagcgcaccaggggaggctccggggatcccgagctggcgcggactcgcgagaccccctggccgctctgcggggagcgctggggaggcgtcccgagcgggcgccagagacccgcgggctccccgtgcaggggctgcctgggctggggcccgggtgggtctgcgcaggtgtgggaagtgccggctcccggtagatgctgaaggcggagttgccaggatttgctgcggacttttggagaaatgaggcggggaaggacgagcttgagaaccgacgccggagagacggggaagacgggggaggcctgagcgcgggctggcatggctggggaggttgtgcactgcccaagaatgctcactgaggagcgtgttcacgtctca

SEQ ID NO: 219430 - DNA, 463 bp, Homo sapiens
  misc_feature (444)..(444): n is a, c, g, or t
cctctcccccacagtgagttaccttcatcaccatctcaaagcactgtcatcacctcctgaccttaatgaagacagtatcatctcaggataacccccactaccatgatggctttttctctctgaacttacatacaaggagaggaagtagggtttgtggccactcacttctcatttgcgatgctcttccatcagcctctcaagaagctaggaccacaggcatgcaccaccgtgcccggctaatttttttttaacgttctgtagagatggggtcttgctgtgttgcccaggctgactactcagttccttaatcacctcatctccagtgatgttatcctccactcgaacctcaaccatccacttgccactgacacaggtcttcaaaatctgtattttggtcataccaccgaaaccaccataccacccttcttattcttccacctcctntgggggacgggggggatcc

SEQ ID NO: 219431 - DNA, 529 bp, Homo sapiens
tgttgcccaggctggagtgcagtggcatgatcatagctcactgcagccttgaactcttggcctcaaggtaccctctcgccttggcctcccaaagtgctgggagtacaggcatgagccagcacagctggccaaaagtttattttgtaaaaatcaggtaatcattgcatatattaagaaaatccagaaggtttaaataggtcttcaataagtttttccttcctcctgtgtgatccactgttagtagtagggctgagcaccagatacctttgctcattttacctgtactacaatttttcttacggtaaagagtaaaatttcttgaactcatgtctctattaaaagtttgaaagaaaaagaaagaaaaaagaaaaattaggcatggtggcacgcaccagtagtcccagtctcccgagtagccaggattacaggcatgcgccacacccagctaattttcgtattttagtggaaatgaggtttcacccttttggccaggatggtctagaacttctgacctcaggtgatccacctg

SEQ ID NO: 219432 - DNA, 427 bp, Homo sapiens
  misc_feature (157)..(157): n is a, c, g, or t
agatttcattctgcaagtaatgaggagcccgtgaagggttttaaaggggtaaagaaacaattaggcttatcttttaggaaaatcagctggggagtcatattagaaggggtgagccctggggcaggaagaccagtcaggctagtggatggaagaggtnatgagggtctaaactgggaagagtagtgtgggcctggagaggtgagaaaaagaattgtatttcctttttaattctcattatatccccagcaatttagcagcatctgctatgtagaaggttacatatgaaaacacacagaaagcattgggtgtcttttttttccttcaaataggaaagaaaaagaagaagaaaacatggttataaccatatgaagctactgccaggacgatatgttaataaaataaatttaagaaaagatttgttaaaatc

SEQ ID NO: 219433 - DNA, 617 bp, Homo sapiens
gacctactgtgttaactcttctctgtgccatgcaactttttaaatgatgttggctcatcttcattttcatacattcaacgatcactttgcatatgctcatcatgaaatgctggagaaagcaaatgaagaaaatctatgctttatgtactttattgccttgtacccaagtatttcaagccttaagaaaggtctcatcccaaattattttaaggtctgaaaacacattgactcatactcttcccttgctccacctaagtgtaaatggagttcattttatattctgccattaaggatcttctgctttctctctctccccgtgatgtttggttctttctagacatgggaaacagatggccagctaagtcaatcagatgtaatttggacacaagcatattctctggtctgttgttcatctaagagttttcatttcaggaaaattcaagagaataacaggatcatttaggaaagaatattgtgtagtgataaccataatgctgttagattattattattatcgacaagctaaaatagatgtcacaaatcaagatttgcttagacaatgtgccacagtataagaaaacaggatttgagattgagaaatataatttttgactcag

SEQ ID NO: 219434 - DNA, 222 bp, Homo sapiens
ttgaatgtatctgcaaaactaaagtgataggattgttgcccacccaggacgttatggattcactcagcattcattcatgaaatattcgttgataatttactatgtgccgtgtactgcctatataaagcagagagtacttgcccttatggattttattttctagtgagtgagacaaagaatgaaatatttaagtataatatagtgtcagatagaaactattgc

SEQ ID NO: 219435 - DNA, 298 bp, Homo sapiens
  misc_feature (8)..(8): n is a, c, g, or t
gtgctganggtgaggagtcacaagaggaatttggagcccaggtcggcctctcatcctgcccaaatgttggcagaatctgggtcttagactagcataagtgaagtctggggagggccgaactccaaggcagaagaagtggaagaggaacagaggtggagaggtaaagctctaagtcttccttctccacctctgttccttttccacttcttcttcctcctcctcctcctccttcctgtggatattctattgtttcagcaccatctattggaaaaactcttctttttccatttaattgtct

SEQ ID NO: 219436 - DNA, 554 bp, Homo sapiens
ctcaccaaaaagtatgaacagagtgtgtatgaattttagacatcatgcctgaggcccactcctttggcccaatagatggtggatcagttctcatttcaaggggactgtttgtcagctgagatgtttccaaaggtattcatttgcttgtgtaactttatttcctcaaaagtaaaatctgacctcccttcccttgtgtggttataagtcttaaaggagaccatgtacaagaaaaaaaattgtgaaattcaaagggctttatatatatcaggcactagctgtaaactgaagtcaccctgtgaatcagatgtagagttaccatatttaggctcacaccctctaaatccccaaggtgtagtcctctttccatggacagttggaaggtcaatgtcattgaaagaaaaaaggtaaagcttacctaatgtgaatattgtgggcttagagttcaccagcaggcaagaactctctccagggttgtaattaattaccttatttgcattatgtaaatgctaccttttaaaatttcataattgttattaaactcagttatttctcta

SEQ ID NO: 219437 - DNA, 197 bp, Homo sapiens
ggttttagagtttaaaatattatatttttaaggagtttagggaggagaaagaatgattttcttggttttacttctaactgtggtaggtgctggcagaggctgcctgtccgctggggtagtgaggagactatgcagcgtgtttttgctccagagttgcaccctgtagtgacagctttggtttcacctgtgattgaagt

SEQ ID NO: 219438 - DNA, 711 bp, Homo sapiens
tgagtggctctgtggtattgcgggagtggttaacttctctaagcctcagttttcctggtcttggagttggtcaagacaatttctaagtttcatttcaactcgaaaagtctatgattttgccatgttgctcagtttaaaaatcttttattcagatacacacatacacacagacacacaacatactctgagttcaatatataagtaaaattcccagcattcttaattgttccaaaaccaaataaaagaaaaatccaagatgtaaacacctttagcctctgcaaattttacctgccactgatcaccaaatacacaacagcactgtgagagctctgtatttataactgttgactccctcctacaggattacaatgccaggcactggagataacagaacatgcagaaataaaagcttagaaaataaaccttcatacagctaatgaaggattatctagtgtgcaatttttctaaaatgtcacagctattagcaagttatttttttgtttgggacaaacaaaatttctcctgtttctcccctgtttctactttgttgccctgaaaagtttcccttaagtattatcagatttagagactcaaaaacttcaaaattataatgtatatacttaaatttataaacttatatttacttctccgggaaaaggtctgctcaggttctgctatggactcaattgtatctccctccactcccgccaa

SEQ ID NO: 219439 - DNA, 297 bp, Homo sapiens
cggaccagaaatggtttgtcccaaacaaaaaagatagcttgctatagctgtgacattttagaaaaattgcacactagataatccttcattagctgtatgaaggtttattttctaagcttttatttctactttgttgccctgaaaagtttcccttaagtattatcagatttagagactcaaaaacttcaaaattataatgtatatacttaaatttataaacttatatttacttctccgggaaaaggtctgctcaggttctgctatggactcaattgtatctccctccactcccgccaa

SEQ ID NO: 219440 - DNA, 377 bp, Homo sapiens
caccactcttaaaatggtttcttggattcttatattcaaaccagaagtgaattatatgtattctttatttatttatgtatttattttaagaacttgaaggccaggctcatgcctgtaatcccagcactttgggaggccgaggcaggtgaatcatcttaggtcaggagttagagaccagcctgaccaacatggtgaaaccccgtctctattaaaaatacaaaaattagctgagtgtggtggtgggcacctgtaatcccagctactcagaaggctgaggcaggaaaattgcttgaactcgggaggcagaggttgaagtgagccaaaatggtgccattgcactccagcctgtgtgacagagcgagactccctctcaaaaa

SEQ ID NO: 219441 - DNA, 466 bp, Homo sapiens
tggagcatgaggccgggccttcggaggaagcactgctctgtgctgtgcccagcagtaaggagtattcacaggtgctgagttgtagaggactcttactcggtacactccagatactggcagtagtctctcttgggaggtggcaggaggctgtatgtagatcagaaatggctttatgaaagatagaccacattcttggagtgagaatatgagaattaatgactggtctgttaaatctctttgaagccagggggtgctaccagttctgctgatcaatgtatttaggagtgagatggttacaaaggcctgagaatgtatctctaaagttctggattctaacttacaaggtttgagacaaactgtcttcatctgtttttcaagctttcaggactgggaagaatgaccttcatgggtggcttgttgttaggaccaagagggctttaaattgaaatttggggctagtaaagag

SEQ ID NO: 219442 - DNA, 806 bp, Homo sapiens
atatagagatttcccacctacaccaagtcagtttcctttatctttaacatcttatataaatgtgctttgtcaaattaatgaaccagtattgatacattattattaactgaagtgcatactttattcgtatttcctcagtttttacataatgttctttttctgatttagaattccatccaggataccaaattatatttacgtgttatgtcttctgaggcttctcttggctgtggcagtttgtccaacttaccctgtttttgatgaccttgacagttttgaggagtattggtcaagtattttgtagaatgtgccttacttagaattcgtctgatgttttcctcatgattagagtgggattactggttttgggaggacaagaactaagatgaagtgtcattctcttattttcatgaaattttatgggcgttttgatgtgattgaggcttagtttcatcatctgtaaagtggagataatgataatggcatgcagtaaacactaagtgagaaaactatgtgtgtaaagtatttagcattaagaagatctgatgcagactaaagagctcagtagcggccaggcgcggtggctcacgcctgtaatcccagcagtttgggaggctgaggtggacagatcacctgaggtcaatagttcaagatcggcctgaccaacatggtgaaaccccgtctctactaaaaaatataaaaattagctgggtgtgttggctgcctggaagcagagagaattgcttgaacctggggggtggaggttgcagtgagccaagcttgcaccactgcactccagcctgggc

SEQ ID NO: 219443 - DNA, 433 bp, Homo sapiens
ctctgcctccctggctcaagtcatcctcccacatcagactcttgagtagctggagccacaggtgcacaccatacacctggagagtttttgtgtttttttctagagatgaggtcttgccatgtcgcccaggctggtctggaactcctgagctcaagcgatccccctgcctcagcctccccaagaccaccgcagcatcagccactgtgtcaggctcccttctgcttcctatcccacaccttacttttgcctgcaagactttattgtctgaatgtgtctgaatgagcttttccagtacagtattttaaccgtatctccagatccactgtctatctggctcctcccacctatctgcctgacagtagacttcttgcttccagcccagtgactcccttcttccctcagggcccctgtcctactttgccccacacctcct

SEQ ID NO: 219444 - DNA, 451 bp, Homo sapiens
cttttatttcggttaaaagaaagcagcatttgctttgtttaaaaaagaaaatggggggaggggaatgtatgtgggtttgtttaaatgctgaagaaaactgttctaagcagctggatgaataaaagggaggagcactaaagaaagaatgcgctaaatctaaagatacaagaacaacacccaggaattgattgaaaatgctttggtgacaagtgaggcatgtaatgacaagaaagcagcatgtgtgcatattgaggagtgcatgtggaaaacaggtttctccttttaattagctttgccgctgggaggaccttctctctccactttctgtccagctcttccatcccagaattccactctgggttcttgtgatgtgctaacgaggctgcagggcagctctgattgagtgggccaataatactggctcaaggccacctagagaagtgttctcccc

SEQ ID NO: 219445 - DNA, 450 bp, Homo sapiens
ggggtgggggcagtccccagcgcccagggcttctagccaggagaaggcctgagggaggctttcctcgccctagaggctccgctggaaagtgctgagcacccgcagacgcccagccagagcagggcagggcgggcacgctttctctggaaaaggccagacggcatttaggccccgccgcggcgcaggctccgttccaggtactcagcacagccatccaagcacgagaacagccacagacaacgcctgccggatcgcctggccatgtgccaagaaaaccttatttatggactcctcatttgaatttcatataattttcacatctcacaaattattcttgtgattttttttcaactgattaaaactgtggaagctgttcttagcttgcagaggttgcagcgagccaagatagcaccactgcacctccagcctgggcaacagagactctgtctc

SEQ ID NO: 219446 - DNA, 298 bp, Homo sapiens
cccatgaggcccttccctgatgactcatttattagaaaacttttccttataaacgatacaaaaataaacttcagctcacctggtagaatcacagaaaatttgaattagtaaagtaaaacttgaagacccataggtaacaaatacttcatgttacccacagagtccccatgtcagaactgtctgatgtcactgtcagagacacagaaaccagggacctagacagagaaagaagttccatggtcctaaccgccgggatgcaactgtggtttgggagtggcaaatgagggctctcaactaa

SEQ ID NO: 219447 - DNA, 594 bp, Homo sapiens
tctctgcatcaaacgtgaatactgccccgtgcctccaaagcgcggactgcatcacattggaaagacctaagcgtgaatgaagccgggtatggcctgaagagctgctgctgactgacagcggtgcttccacttgtgggaggagggcaggggcacgtggccctgcttgggaaattaatgggcttgcgagccggaagccctgagctgagttgtcagctctgcctaaatcatacctttatgacctttggcaagtttctcagcctcaatttactcatctgtaaaacatgggtaatcccagtgtgctgtccgcacgaggttgccgtgaggatttttatgtaaagtgacgcatggtgaatgcgagtttcctccctcctccgtacttgaaattcaaccaaatcactcagtctcatctaactactttgtgtttttaaaatgagtatcagtaacagctgctgcttctgttcttcccagagatgcagtgaacacaggccgtgaggctgttctgtaatttctaaatgtttatcttctcagagtgatgagttatgttagaagcaggtgattttcttcaaaaaactaataaagtcttattattctacc

SEQ ID NO: 219448 - DNA, 516 bp, Homo sapiens
tatgtatgtagtctgttgctgctgaaagatgtctgtgtgcctgtatcaacatgtgacttcatgtaaagtttctttgtgttcacagttcttagcaaatgcagttacaatccatagatagccagcagtggatgttactccaggaaaatgcaggattaaaattgtccttgtgtataacgtgtgaatcatttttttaaactgaaatttaaaatgcaacatagtttaatctctgattaaaatgtactaatagggccaagctgctttgatgcatggctataatcccagccgaggtgggaggttcacttgagtccaggttcaagactagcctgggcaacatggcaagaccctgtccctataaaaaatacaaaaattagccaggcatggtggcgtgcgcctgcagtcccagctacttgggaggctgagttgggaggatcacttgagcctgggaggttgaggctgcagtgaactgagatcacgacactgcactccagcctgggcaacagtaaaacctggtctcca

SEQ ID NO: 219449 - DNA, 207 bp, Homo sapiens
acttttctaacttggaccctattccaggtggtgcaattcttcattagatgagcacggcccactctgcacagacattcagcatcctggccttgcccgctaaaggccaatagcaatccctggtcattgtgacaaccccgaatgcccacccatttctaaatacctgctcgcaggctggtgctgcctctagttgagacaagaacctaggct

SEQ ID NO: 219450 - DNA, 563 bp, Homo sapiens
actctttggcttctgtccaaatgactgtgaaaatagatttctctcaatatccaccaatattacctgtttctgtccatatatgtatttaaaccctgttgaaagaatttattgatacaaatcaatttttaagggcttcagtataacggaacctttttctaccacccttttggtttatttttccaaactaagccagtatagatttgaggtttagggaaaataggcacttctttttaataagaatgtgggctaaaacagatcttatggttcaaatatttacaacttaaggaggcaaagagatttgataggaaatagacaaggtgatgtgtcctctgacaggtacacaaatcaagagaatatgacaggtccttgggaatgattgtgtcagtgttcgcttcccatccttttattctgaaagttcacagtaggggaatgtgagaaccaaaatgcatatgctaggtcagggactgggacactttctctgtggagagccagagaataactattttaggctgcgtgagccatacggtctctaggacaacagctgagatagacatttgtaaatg

SEQ ID NO: 219451 - DNA, 172 bp, Homo sapiens
ctcgtggtctcaggcttggggtgaggaaaaaggcgaagggaagggagaaaatccactgagtctaatgtgttcccactttattctcactccagaactccccatgtagagaaaagagaagagtgatttctggcagggcagggagtaaataaaggaaagttctatctttgaatca

SEQ ID NO: 219452 - DNA, 414 bp, Homo sapiens
aaggatggagatctgggtttcttgtatgctgaagagcacttgagagagactggtttgtgtatctaattgatgagaaaggcctagttaataaatgtccataaatgtagccaactttattgcaagccatgctgcccccaaaatagccctaagagttgtacctgaccaaataactcagtccagttttacaggatgtgaagactgagtattccatccccagacaatgcaatttcagttatctgagtttttaatcctgactgggatgagagaaggctgagtgatagaagtatctgaatatgtggtattattcctcctgcaactcagggaaaaacagagaaactggcaaagtgaacatcctatttaaaaaagaaaaaaggaaaagatgtgtttcatctgatcttgaaaaacattaactag

SEQ ID NO: 219453 - DNA, 457 bp, Homo sapiens
cctggagcttgtggaggctctgaaacaaaggagtagccgggccagatttgttttagaaagattccttaggctgtctggagtcacagagtggctgggcccaattgtccaggaagatgatcaaggcctgaaccaaggcaggtgacatggagagggcaggttgaggagaagataaacccaagacatagtgtgggagatgaggaagagagtggagttgacaacaacctccagggctgctgcaggcagcggcactccttccatttctcaggatccactacaccagccacttaaaccagccagtctgcagagcatgtggcccagcacccaaatcctcaccagaggctgcaaggccatcccagtcagtagtagctctggacaacccaccactctccaagcctgggactgggctcctttcctgccaggggaatggttgggggcctctgggaaagggcgaggcctc

SEQ ID NO: 219454 - DNA, 206 bp, Homo sapiens
gaagcacattatataggcgatatatttagggcagaggagtggcagatttactgtgctcatgtcatttttttcttaagctaatatttaaattatatggaacctccccccatccttcacatttttagaagtgtgcaatggctagttgggaaaagttagcttgtaaatttaaatcaactagatgtaattcactctgaataattcacata

SEQ ID NO: 219455 - DNA, 434 bp, Homo sapiens
ccattccattccattcccttccattccactctggttgattccattcctttccattccactcgaatacattccctcctattccactcggaacgattccattccattccattccattccattccattccattccattccattccattccattccatttcgttccattccattctattccgtatcattccattccattccattccattccattccattccattccattccattccattgtactcgggttgattcaattccattgcattccattccattccattccattccattccgttgcattccattccattacattcggattgattctattcaactcccttactctccattccattccattccattcgggttgttccattccattccattccattccactccattccattgcactcgggttgattccattccatt

SEQ ID NO: 219456 - DNA, 483 bp, Homo sapiens
ccattccattccattcccttccattccactctggttgattccattcctttccattccactcgaatacattccctcctattccactcggaacgattccattccattccattccattccattccattccattccattccattccattccattccatttcgttccattccattctattccgtatcattccattccattccattccattccattccattccattccattttgattccattccattccagtcctttccattccattccactcgggttgattccattctattagtttccattccattccattcccttccattccactctggttgataccattcctttccattccactcgaatacattccctcctattccactcggaacgattccattccattccattccattccattccattccattccattccattccatttcgttccattccattctattccgtatcattccattccattccattcc

SEQ ID NO: 219457 - DNA, 227 bp, Homo sapiens
aaaagaaatagccccatgtaaattctcctttaaataatctgcctttaatggtctctgttcaatttatatcctaaaaatgtattttgcatatgaccaagttgcatttctccctaaagtaggtgaaatctaattcttacttgaaaaaatggtatcctttctccatatgattgttattcagtgtttattgaagtatatttgttgattcaaaatgcaaaaagggagttttt

SEQ ID NO: 219458 - DNA, 478 bp, Homo sapiens
gctcagtaacaatagaggtaatggtgatattagtaagataataataataattatgacaataagagcagctgccacctacagagcagtccctttgtgccgggccctgtgctagactttcacgagtaatctcgtttgagcctcacagtactttgaggtaggtactatgattatccccatttttcagatgggaaaactgaggctaagagtggttaagccagttgtctgaggtctcatggcccggaaggggatgaggggcctgatttggggtctgtgtctggctcctcccctcactgtactgcattcctttggagctgccttgacgatcctcagcgaaggacagacgggctggggcagggcatggtatgaggagcccaggcaggaaccctgacccagagtcccagccctgccttctagtggctctgtgagttgggcaaaccatttaactccagtccgagcccaagtgattaaaagttcatcc

SEQ ID NO: 219459 - DNA, 195 bp, Homo sapiens
ctcacatgatcctaccatctcggtctcccaaagtgctgggattacaggtgtgagccactgcaaccagccagaaaaaaaaaaacagaggtggcaaggatgatcttaaggtctttagtctgagcaattagaaggacagagttgctaaacgtctcctgagtctcactttcctcatctgtgaagtgggaataaaaagag

SEQ ID NO: 219460 - DNA, 823 bp, Homo sapiens
tcatttatgactctggggagatttctgagcgagagctaggtgtcaggccctgttccaggtgctggagatgcacaagagaacaaaataggcaaagtttcctttttatggaacttatagcaggagaataaagataaaaacaagcaaaaatatttatctctgataagggcaatggataaaaataaagtagaataggccaggcacggtggcttacgcctgtaatcctagcactttgggaggccaaggcgggcagattgcctgagctcaggagttcgggaccagcctgggcaacacggtgaaaccccgtctctactaaaatacaaaaaattagctgggcgtggcagcgtgcacctgtagtcccagctacttgggaggctgaggcaggagaattgcttgaacctgggaggcggaggttgcggtgagctgagatcgcgccactgcactccagtctgggtgacagagagagactccacctcaaaaaaatttaaaaaagtagactaagagaaccaagcatcgctgggtgaggggtcttgttttaaagagttttctaggaagacctctctgagaaggcaccatttgagccaagacttgatgacctggctactgcatgaggatggaaggtggggaagctgatgggagcagcgagagaggtgggagcagttagaggctattgcagcagtccaggtaagaaggaatggtggcttggacaaggaggtggtagcagagatagggcagagatggccagattccagatgtattctgaaggtagagctgacagatttgctgagcaattggatgcagaataggagggaaccagaggcagtca

SEQ ID NO: 219461 - DNA, 388 bp, Homo sapiens
gtgtataccctgtgatattattcataatatcctggggagatgcaactgcctgatatcacagtgcatgtacccggtgtgtgtacacccttgatatcagtcgtgatatccagggtaaatatgactcctcatatcacacagtgtgcacaccctgtgatatttttcataatatttaagggagatagcgcttctaatatcaccgtgggtgtaccccatgtgtgtgtactctgtgacagtattttttatatccctagggaggtattactcgtaatgtcacagtggggtgttcaccctgtgatgtcattcttatttgaccttggcgccttttttaaaccaccctacaaaaggaatggaacagataagaagatgttgagattagactgtgctgcca

SEQ ID NO: 219462 - DNA, 439 bp, Homo sapiens
ttaaatggttgcagaggctttcattcatgaagttcaagtttactatatcatggtatgtcaggaaaaaaaaaatcatgaccctctgtgataaattaaatatcacaaccacgtaaatgtcatcttttcaatgaaactgaaagtgcataggaatgggactctttttcagtctgttttggctttaagctgtaagaaaaatattttaacactgacagtagtaaacctatgaagctaaagaacaaagccatactctccccagctttataagtcacacgcggaattgtgaattaaattattctaattgcaaaatttggggtcttggccgaaagaacacaggttgaatttgaagaagaggcagctagaaaaatcggtgtaacttttacatgaagataatttgcacagaatgtaattgaaagagaataaatatggagctccatgatgt

SEQ ID NO: 219463 - DNA, 464 bp, Homo sapiens
agccgaacatttctgtacaagtgtgtctaacttgccaggaacattcattttacctttcagattactgagtagtacaagaaattaagagtggaatattatgtagatatacacacaagtggcttatctggagcagatctctgcctttttctcttccctactgtatagagtaggaaaagattttgtgccctaatgctacaattccaagggggcagcagaaataagacaaatgagagaaaaacagaactaggaggccccaaatacatttaaaattagaggtctatgaatcctgttatttttcagctgataggaaatctccccttgtcaggttatcattttaagtaatatcaattcagatgacaactggggcatttttgtttttttgagacagtctcactgggtcacccagtgcactctagcactctagcctgggtgacagagtgcgacttcctctcaaaaaaaaaaaa

SEQ ID NO: 219464 - DNA, 303 bp, Homo sapiens
tcgacgcgcactactccaatgtaagataggctagacgtatgacaatcaattaatacactacattaacaggataaaggacgaaagccaaatgatcatctcaactcatacaacacaaaaactcagcactacaattccacatacggccaggtgcggtggctcatgcctgtaatcccagcactttgggaggccgaggtgggcggatcatgaggtcaggagttggagaccagcctggccaacatggtgaaaccctgtctctactaataatacaaaaattagctgggcatggtggcaggtgcctgtaat

SEQ ID NO: 219465 - DNA, 452 bp, Homo sapiens
ccgaaatattcttcagttgggtaatgtataaacaaattttggtacatctgtatggtggaatacatacaaccacatggatggatttcagatgtagtatactaagtgaaagaagctagcctcaaaaggctacatcttatatgattccattatatgacattctggaaaaggtgacagtctagtgacagagaacagatctggaaaaggtgacagtctagtgacagagaacagatcagtggtaagactgggggaatggtttgactagaaagcagtaaaatgaaggaatttggaaggaaggatgatcaactgttttgtattgtggtggttacatgactgtacatttgtcaaaactagtaccctaaaaagggcaactttcactactatacgtaaattatacttcaactttaaaaaagctgctacaaaaggataaattaaagtagaattgctgagtaaaa

SEQ ID NO: 219466 - DNA, 426 bp, Homo sapiens
ctatgtttcatgttgaccatacagctttgcctttttccagtctaggtttatgccagacattgtgtctgttattttccctttttaaagtgatatctgggctgagtgcaatggctcatgcctgtaatcccagtactttgggaggccaaggcaggcggatcacctgaggtcaggagttcgagaccagcctgaccaacatggagaaatcccatgtctactaaaaagacaaaattagctgggcatggtggcagatgcctgtaatcccagctattcaggaggctgaggcagaagaatcgcttgaacctgcgaggcagaaattgtggtgagcagagatcacgccattgcactccagcctgggcaacaagagtgaaactctgtctcaaaaataaataaataaataaaataagtgatatctgtgatatctggcca

SEQ ID NO: 219467 - DNA, 405 bp, Homo sapiens
  misc_feature (114)..(115): n is a, c, g, or t
gcaggattgcccatgaatgaacatgggtgaaatcgttggatcagctcagtcttgcctgtgcttaagcctggaaaaaaataaatggtgcttcacagtggattactacaaccttanncattgtaatcctttcattaagacccataacccaacacccagtattatggaacttactgaccccatccaatcaacaactgatttgatgttttgtcattttaaaggatactagacaagaggatctcaatttggatcactatattgggctcctaatatcctaatataattttaaatcatctcaaacaatgcattattaccatatacatcagcatttcccaaactgtgctataagctatgtatacttttgctatttttgagctaaaatatgcttacaaatatataaaaatataa

SEQ ID NO: 219468 - DNA, 479 bp, Homo sapiens
atatggcctttcttggtgcatgtatgtatgtcgagagggaagatgggagagggagctctaacctgtttctcttctcacagggacgctaatcctatcatgggggccccaccctcatgacctcatttaactctcaaaagccccacctctgaaaccatcccactgggggttggggttttaacataaattttggggagacacaattatatagtctgtaacacggactgagttataaccctgtagtcaggatactccattcctttgcctagagatgcttgtaagccctaggtgaattgttacacttgtcctgagggcagggcagtggacaagtcacatggcttatcagtgatgaggcttggggggtgccatccacccagccagccaggacattggtgtctggattttagccacagtgaaaaacaagggtgaattgcttaatggctgcaatgctgggcaactgaccaacttcattcatgacttaa

SEQ ID NO: 219469 - DNA, 718 bp, Homo sapiens
ggctaactcaagtagacagtgcaatggcccagaagaagatgaacaaagagaacaaagctggcaggagctggaaggcttgaggaggggaatccataggcttggaagaaattaatatattctgggaaaagcagtgatggcaaaataatttgggaaaatcaattcagaaaaatttttaaaaactaatatgtgcctatcactatgctaggtgctctgaacaatataaatgtgttatcagacaaggttcctgacctcataggcaatcatacgtttagaatgatacattctacaaattgaaatgttgcaaaaagttcttttaggataacattacaaaccagcatttcaaaagtctgacttccctccccaaaccttctgcaaaaataattttgtatttaatgcatttgagaattattttcttcagaattgttttccctgtgaaaataatttttaatatgctgaaacttggtgtatgtgaagcagagggtaggagagcatggaattcactttttagcccttactaaaattcattcattctgtaaagttaggttttccagactatctggttcaaggaagatgacaaaagtctttgtaaggtctggtcatagattttcagggagactgatgtgcaagaaacctccatagcttcttgatcatttatatttcacctttttccccagaaagaatttaagacaacttaaggcagacactggacagcaaacgg

SEQ ID NO: 219470 - DNA, 430 bp, Homo sapiens
ggtttctccatccacaggtcacatagcagctatattttcttccttttcaccatttgtcatttgaatgttaacaatgaacttttgaatctacctgtaattgattttgctatataaatgtgtcagtagacttatttgggagctttggtttattctgtcttcatttgtttggtacctttgttgaggtacacatcacgtatcacaaagtgtacaattcactgattttgggtacattcatagagtcgcgttaaccatcaccacagtccatttcagaatattttcatcatcctgaaaaagagccgagtacccattggcactcatttccattttcccccatcagtccacggcccctggcaaccagtaatcagctttctgtctctatgaatttgactgttctggacatttcaaataaatggaatcatacatggtgtgg

SEQ ID NO: 219471 - DNA, 682 bp, Homo sapiens
gacacaagaacaccagtggagtgttgaagcctcccactagtgtatttctcaggttcttaggtttagtagtagtttttttatgaatccgggtgctctgatgttgcgtgcatgtatatttaggatagaccttgatgactgtgtgccttggtgatattcatcttgcatagcatctctcaagtgttctctgaatttcttgtatctgggtgaaaaacatggaacaattcatgaattcacatatcatccttgcatcttatagccagagaagtttattcctttaattaataagacctgaaataatacttactaaatatgaaataaatatatgactaccatctaaaaaatagttctcggttaggggtatgctcctttctttcatgcctggctatgagatgagtggttgaatcagctgtaagaaacatagtggtaggaagtcacttttaacaccgcattgttaatgggcagagggaaagaagcagagtcctggaagttggtaacagacttagaaccacagatatagaaaacttgaatgttctaagtcccttgagggattttgtattgttcatttggtgtctaagaaaactaaatgttatactttcagcacagatttgttgaattgatttagattgaattgaagcgtggtggttttgtaagaattctaccatttattcctaagcatctagtt

SEQ ID NO: 219472 - DNA, 430 bp, Homo sapiens
cttataagtattttttaaaatcttcatttgcacctggaaaatagagctcagagaagttatcagagaagatataattaactccccaagcatgaaacaacttaagaagtggaagaggcaaggtacagggctagaatgattaactctaaaattcttattccttacacaatgattctaaatcatttctaacctagagaaacctcaggaggcccaaagtttctatctgttcgaagaagaatctggaaatggctctggatgccccatccatatcaattttgcagacccgtctggagctctgttgcagtggaagaagctgcataggagaaaggatgaatgagagggctgaacacaagaacacagaagggactgaagcctccacttttccccacctctgcctattgccacagtatctggattaaaactctatgcattg

SEQ ID NO: 219473 - DNA, 426 bp, Homo sapiens
tgatcagtgaagtgaatctacagttaagattgaaagaagtggtaggagccccatcacagggtggaaatgcagatctcagggcccctggagtaaaaatgtgggtcaacaaaatggtaaaattaaaatacacacaatagaccacatgtggtggctcacacctgtaatcccagcactttgggaggctgaggcaggtggatcacctgaggtcaggagtttgagaccagcctggccaacgtggtgaaaccccgtctctactaaaaatacaaaaattagccggacatggtggtgggcatctgtagtcctagctactcaggaggcttaggcaagagaatcacttgaacctgggaggtggaggttgcagtgagccgagattgcgccattgcactccagcctgggaaaaaggagtgaaactatctcaaaaaaaaa

SEQ ID NO: 219474 - DNA, 272 bp, Homo sapiens
gtcaatgggaaaagggtggcgtggactgggctggaggctggtaacaggcgatgaggacaggtcctgggcgggctctgagctgccttttgagcttccagctcagtgctccccacaccatggttctggctctccctgaacttcattcttcactctgctaagttagctgctacctgtctgcgatcactgcctcttggaagcatatcctgaccccctgaggtgcatcaggtacctcccctgggctcctagcttccccacctagcaagaagtcacct

SEQ ID NO: 219475 - DNA, 992 bp, Homo sapiens
aatgccaaaaaaggtctggaatgaggtgggcactcagatgctttattaaccactctaggtattattctaacactttatgtgcctattaaattatcccgacatattagatttgctgaattgcagtccatatttcgtagatatgatagctgaagcacggaatcattaggtaacttgcccaaagtggcattcacgactcataaatggcttaggatgtaaactcagttttattccctgggacgccctctctgctcttcagcacttgaagttcaggcagcgagagttgacatggggccagggctgcgcccctggggcgggttgaagacagggtgagtctcttgatattcaggaaatcatcgcgcacccagtcaccagcgttcgggagcctgtcgcagcgggaccgacggaatccggagcaggcgacagggcgcagaagcgggatgtacttctgttggggcgccgactccagggagctgcagcgccggaggacggcgggcagccccggggctgagctactgcaggcggccagcggggagcgccactctctgctgctgctgaccaaccacagggtcctctcgtgcggagacaacagcaggggtcagctgggccgcaggggcgcgcagcgcggggagctgccaggtgagcggggggccccaggtgcagggtgtgaggaccccagtacatgggcgcgggggcttgggtaccgggcgcagggaaccgggtgcggagcgctgggacccgggtgaggggcgcgggggcccaggtgcagggagcggctcagatgctgggcgccgcgggccaggcagggaggggtgctgggagccttggattcctcggggcccgaagagccacaggaaccaggaaaatggtgccctgtgctaccgaagagcaacttcctcagtttcgttttcccaacgcccctcggatttgtttcggtttccaattcaagttcaaagcgaaactgagagccgaaactaacctggtcagcgctgctc

SEQ ID NO: 219476 - DNA, 1354 bp, Homo sapiens
aatgccaaaaaaggtctggaatgaggtgggcactcagatgctttattaaccactctaggtattattctaacactttatgtgcctattaaattatcccgacatattagatttgctgaattgcagtccatatttcgtagatatgatagctgaagcacggaatcattaggtaacttgcccaaagtggcattcacgactcataaatggcttaggatgtaaactcagttttattccctgggacgccctctctgctcttcagcacttgaagttcaggcagcgagagttgacatggggccagggctgcgcccctggggcgggttgaagacagggtgagtctcttgatattcaggaaatcatcgcgcacccagtcaccagcgttcgggagcctgtcgcagcgggaccgacggaatccggagcaggcgacagggcgcagaagcgggatgtacttctgttggggcgccgactccagggagctgcagcgccggaggacggcgggcagccccggggctgagctactgcaggcggccagcggggagcgccactctctgctgctgctgaccaaccacagggtcctctcgtgcggagacaacagcaggggtcagctgggccgcaggggcgcgcagcgcggggagctgccagaaccaattcaggcattggaaaccctaattgttgatctcgtgagctgcgggaaggagcactccctggctgtgtgccacaaaggaagggtcttcgcatggggagctggttctgaagggcagctggggattggagaattcaaggaaataagtttcacacctaagaaaataatgactctgaatgatataaaaataatacaagtttcctgtggacactaccactccctggcattatcaaaagatagccaagtgttttcgtggggaaagaacagccatgggcagctgggcttggggaaggagttcccctcccaagccagcccgcagagggtgaggtccctggaggggatcccactggctcaggtggctgccggaggggctcacagctttgccctgtctctctgtgggacttcgtttggctggggaagtaacagtgccgggcagctggccctcagtgggcgtaatgtcccagtgcaaagcaacaagcctctctcagtcggtgcactgaagaatctaggtgtggtttatatcagctgtggtgatgcacacactgcggtgcttacccaggacgggaaagtgttcacatttggagacaatcgctctggacagctgggatacagccccactcctgagaagagaggtccacaacttgtggaaagaattgatggcctagtttcgcagatagattgtggaagttatcacaccctggcatatgtgcacaccag

SEQ ID NO: 219477 - DNA, 449 bp, Homo sapiens
gaatttacttccttcagacatttagaatggacttaaggtcttgattcaaaagaccattggaggagacaagaaatctggatgatccttctttttgaagaaaagtgctgtcttaaacttgtgttaaattaataatctgcagtggtggttggggggtgttttgttttgtttcccaaagaaccaattcaggcattggaaaccctaattgttgatctcgtgagctgcgggaaggagcactccctggctgtgtgccacaaaggaagggtcttcgcatggggagctggttctgaagggcagctggggattggagaattcaaggaaataagtttcacacctaagtaagtgtttcaacccactccttcatttattcaatatatatagtaccatgtgccaggcactgtgcaagatgccaggatacaaagacgactgcttggattacaaggaggggatct

SEQ ID NO: 219478 - DNA, 1737 bp, Homo sapiens
gtgcattgttaacaatagtcttacttataaatttgctcaaggtcagttaagtaacaaatgagctgtaataacccagatcaacctgactgcaggggcttccaggaagcctcctctgattccctacccatgccatacactcacttagaccctactctcctaggagaacagattagtgctgcccagaagctggggcaggacattagtttcctattgtcactgtaatgaattaccacaaagtggctcaaaaaacaaaattattatgttacagttcagaagtccaaaatcagcttcaccaggctaaagtcaaagtgttgacaggtctacactccttccgtgggctccagggaagaatgtttccttgctttttccagcttctagatgctgcttgcagtgcttgattcgtggctcttttcaccatcttcaaagccagcagcagagcatcttctctcctctctaacctctgtttccatccctacatctctctaattctactgcctctcacttgtaaggattacattgggtctactgggataattcagtatcatcttcccattggcaagatccttaattaaatcctgccttcaaagtcccttttaccatttaagataaaatgttcacaggttaagcagctggtgagtgtctgtagtcccagctactcagggggctgaggctggaggatcacttgagcccaggagttcaggccagcctgggcaatatagtaagactcttctcttaaaagaaaatttatatttatcctcaggtcctggggattaggaattggacatctttgggagaggggcttttagcctgacacaggcagggtggaaagtgggcaggaggatgcacccaggcccagaatgaacctctgtgctttgtccagcctcccctagcctggaatgagaggtggtaccaaggcggaggtggcaggtccagaccccatgtctagagaatgtcaaatgcctcctgtaccatcaccaccagggagagccaaagatgaagatcaggcttaggagaaagcctcagtttaggaatcgttttagacctgagaccttcctggtaaccacagtggaggattcctcaacactgtctcctctccagaaccattctgtgctcctattccccaaggctgaagataattatattcccagtgaactaacctgggttctctctggaaagggcagattgattagttgtcttctttttaaattgttatttttaattatttaatagttaaaccatgcttctcatagcatagtgaattccatcaccaggcccctttcttattttattttcttcttttttaaaaaaattttagactgggcacggtggctcatgcctgtaagtcccagcactttgggaggccgaggaaggtggatcacctgaggtcgggagttcgagaccagcctggccaacatggtgaaaccccatctctactaaaaatacaaaaattatctgggcatggtggcgcatgcctgtagtcccagctgctcaggagctgaggcaagagaattgcttgaacccaggaggcagaggttgcagtgaaccgagatcatgccactgcactccagcctgggcgacagagcgagactccgtgtcaaaaaaaaaaattattatttttttaagagactgggtctcactgtcacccaggctggaggacagtgatgtgatcttggctcactgtaactttgacctcctgggctcaagcaatgctcccacctcagccttctgagtaggact

SEQ ID NO: 219479 - DNA, 627 bp, Homo sapiens
ctaggtggagacgtcgacgttaatggcagtggaatcatatccgcagaaggactcaggaattgacattggggacatcactgcaaggaaggctctcaggaaacagctgcagtgcaagaccttccggtggtacctggtcagcgtgtacccagagatgaggatgtactccgacatcattgcctatggagtgctgcagaattctctgaagactgatttgtgtcttgaccaggggccagatacagagaatgtccccatcatgtacatctgccatgggatgacgcctcagaacgtgtactacacgagcagtcagcagatccatgtgggcattctgagccccaccgtggatgatgatgacaaccgatgcctggtggacgtcaacagccggccccggctcatcgaatgcagctacgccaaagccaagaggatgaagctgcactggcagcctctcagggagtgacccatccagaaccgaagtccaagcgctgtctgaagctgcaggggaatagcgacctggagttcggcttcagctggtgttgcagacgtgctcgggccagcaagggagcatcaccaacgtgctgaggagcctcgcgtcttgacccagcggggccacttccgtgtgcctcttgctac

SEQ ID NO: 219480 - DNA, 2281 bp, Homo sapiens
  misc_feature (10)..(10): n is a, c, g, or t
  misc_feature (167)..(167): n is a, c, g, or t
agcggggttntcctagcagcgcgggccggtcggaccgccaaggcagccggcgctggcgatgggaagcggcgtggccgccgacacaggcagtggcaaagtttcccagacgtacacatctggacgcgcggctgccggctacccgtgacccctctaggaagggttcaggnatttttaatttggaaaaaaatccacctggtttcctttgtcaaggtctctccgggtggccagcggcaggagctgcaaacttgggcacggcggctacaccggcagcggaccgggctttggagaacctcgggactcaggtgctgaggtgcccagcggctccggacgtgctacggggtgcgagcgcgggggagttcggggcgcacgacaaggaagggcccccgggagctctatatggaggaaggagcccagaatggtgtgcaccaggaagaccaaaactttggtgtccacttgcgtgatcctgagcggcatgactaacatcatctgcctgctctacgtgggctgggtcaccaactacatcgccagcgtgtatgtgcgggggcaggagccggcgcccgacaagaagctggaggaagacaaaggggacactctgaagattattgagcggctggaccacctggagaatgtcatcaagcagcacattcaagaggctcctgccaagcctgaggaggcagaggccgagcccttcacagactcctctctgtttgcacactggggccaggagctcagccccgaaggccggcgcgtggccctgaagcaattccagtactacggctacaacgcctacctcagcgaccgcctgcccctggaccggcccctgcctgacctcagacccagtgggtgccgtaacctctcatttcctgacagcctgccagaggtgagcatcgtgttcatcttcgtcaatgaagcgctttcagtgctgctgcgctccatccactcggccatggaacgcacgcccccacatctgctcaaggagatcattctggtggatgacaacagcagtaacgaggaactgaaggagaagctgaccgaatatgtggacaaggtgaacagccagaagccaggcttcatcaaagtcgtgcgtcacagcaagcaggaaggcctcatccgctccagggtcagtggctggagggcggccactgcccctgtggtggcactctttgatgcccacgtggagttcaatgtgggcttctctgcacagggctgaacctgtactcacccgcatcaaggagaaccggaagcggatcatctcgccatcctttgataacatcaaatatgacaactttgagatagaagagtacccgctggctgcccagggctttgactgggagctgtggtgccgctacctaaatccccccaaggcctggtggaagctggagaactccacagcgccaatcaggagccctgccctcattggctgcttcattgtggaccggcagtacttccaggagatcggcctgctggacgaaggcatggaagtctacgggggcgagaatgtggagcttgggatcagggtgtggcagtgtggcgggagtgtggaggtcctgccctgctcacggattgcccacattgagcgagcccacaagccctacacagaggacctcaccgcccatgtccgcaggaacgctctcagggtggctgaagtctggatggatgaatttaaaagccacgtctacatggcatggaacataccgcaggaggactcaggaattgacattggggacatcactgcaaggaaggctctcaggaaacagctgcagtgcaagaccttccggtggtacctggtcagcgtgtacccagagatgaggatgtactccgacatcattgcctatggagtgctgcagaattctctgaagactgatttgtgtcttgaccaggggccagatacagagaatgtccccatcatgtacatctgccatgggatgacgcctcagaacgtgtactacacgagcagtcagcagatccatgtgggcattctgagccccaccgtggatgatgatgacaaccgatgcctggtggacgtcaacagccggccccggctcatcgaatgcagctacgccaaagccaagaggatgaagctgcactggcagcctctcagggagtgacccatccagaaccgaagtccaagcgctgtctgaagctgcaggggaatagcgacctggagttcggcttcagctggtgttgcagacgtgctcgggccagcaagggagcatcaccaacgtgctgaggagcctcgcgtcttgacccagcggggccacttccgtgtgcctcttgctac

SEQ ID NO: 219481 - DNA, 401 bp, Homo sapiens
tctaggtgatcttggatttggcaatgacttcttagctacaacaccaaaagcaaaatccataaaataaaaaatatatatagttgagctttatttaaattaaaaacttctgctctgaaaaatacaagagaatgaaaagataagccacagagtgggagaaaatcttttcaaaggacatacctgataaaggactgatattcaaatacacataataaactatttgaacttaaagataagaacacaaacgacctaattaacacattagcaaaacatgtggcaggcacctgaccaaagaagacacataaatggcaaataagcctatgaaaaggtgttcagcaacatatgctattagtgaactgaaaattaaaacaacaagatactaatacatatctattagaatggca

SEQ ID NO: 219482 - DNA, 547 bp, Homo sapiens
ttatattgttatagtatctaattcattgtttgaacaagatgaacattaaaaatgataattatatgtataatcagtttataccaaggttgttagagtgaattgtttactggagatatgaggggtgattatcatatcactctagcctcatatactatgatgttagtaattcttagagtaatatgtttataaaaactccacaagatgtaatctgggtgaggagtttgcaagctgagttggcatgatttggataagactgaatccaaattagtaagttaaatgtagaatacacagctaggaagactgagggtcacttgagctgcatatggagactgtgggctaagataggtaacgagattttcacaggtctcagtatacaagtcctagactcagcagattaccatccaattccgtattaacaccttgagctctcgtacagtcttttgttttttttaaatcaagttttcccttgtaatggtagagtaaacataaatttcacacttatgggatgagcatacttcacaaaaggaagcaaagctccttaatgggg

SEQ ID NO: 219483 - DNA, 791 bp, Homo sapiens
atccctgtggcccacacagctgctgtgctataccatcttggaattggagctgtgactgaagtgtgtcttgctccaggggtgagtagtcatggctcccctttgtccctaaggctaagctgccaccaaaccaccccagcacagtggccccacatctccaggctgagctgggagcaactgttggctctgttcctcgggggccagcagagatggagctgctccacctgttcttcccccagctgctttggactggagctgaagcagtatcctgccttttgggaaaacagtaccttgaacactcagagcaatcatgcctccccagtgtctcagttgaagcagcgccacgcctcccaggaagtggtgcattggccatccagagtgatcacacatcccagtacctaagctgaagcagctcccagcatcacagggaaatggtgcctggcccacccaaaagagtatgctccctgggcctgagctgaagcagcacattatcctttggggagttggtgccttggccagactgagcagttgtgcatgccagggatgagctgatatagtacaccatgtcccagagaaatagagcggtgactgagctgagacaccttgcccttacaggccgtagaactctagtaccctgcttgcttgaacctgtactagtcttcaagaagctcagctgcttagataaccttcctcttggagagtggaattatcactgtgctatcctcccctcccatgctgggtccacacaacagctctgctcccctaagctaggatacttgctgtcattgcactgg

SEQ ID NO: 219484 - DNA, 560 bp, Homo sapiens
agtacactctggagagctaatgcatgctatatatacatatatatgtgtatatatgtgtgtgtgtatgtatatatagcctgtgaatatggtgcagtggtaaacctacttaattcaaaccttttagtgacagttatgctagttgtacctcttgtggcatttttcatttcctcgccttaattgcattttacccattttttattactgtaagatacttttgctttttttgtctccttgaccgggagaagataaaatattgtatagatttgagtttttgctgagacttgaagttccatatttagactatcttcttgaaacttggggagaaattttaacttgtctttcctgtactcctaggaagaattttggtagaaagttggcttatggccgggcgcggtggctcacgcctgtaatcccggcactttgggacgccggggtgggcggatcgcctgaggtcaggagttcgagaccagcctgaccaacatggcggaaccccgtctctactaaaaatacagaaattagctgggtgtggtggtgggcgcctgtggtcccagctactcggg

SEQ ID NO: 219485 - DNA, 515 bp, Homo sapiens
cacagaaactcagttttaagtactaaggaaacagggaaggatcttcaacaaaggcgccgaagctgaaaattactctaacataactctgttccttatccttttatagaaaacatcactttttttgttctattaaacagcacccccaattttcataaaatctataaagggaaaaactgtatttcagcctttttaaaaagtagcgagggtgcaatgtaccaaatctgtgactacaacagcttcacataaacaggctcgctattaaatgaccaaagatcaagtatacatcaattctgttttctgagttataaaacacaataaaactaatcagtatctgatacaggtactaacttggtccttccagccatagctttacaaaggggtcttacggctgagtgtggtggctcatgcttgtaatctcaacactttggcaggcctacgcaggaggatcacttgaggtctggagtttgagaccaggctaagcaatatatttgagaccgtgtctctaaaaaaaaaaa

SEQ ID NO: 219486 - DNA, 435 bp, Homo sapiens
ggggccactgggaagccaagcccttgtggcgtcggaggaggcgttttccgggttcgagttgggaattactcacagtccggaaatggcaatttatttagggttgtttatctgtttggaaagctctcttacccctttgaaaggagggggcttaactatttggtaacttattttcttggaacatcaaattaaaaccaaaccttgaaagttaagctgttccctctagggagacatttttatatatttaagatgggcttagactgttagggcttgtgagaacttattttaagacggggaggaggcgagagcgttcataaccaaaggaaacactgcgtgatgtctacatgttccaagagactgaaaatggatgtgacatgtgtggaaagattggaaaattctggtgggagtttaaaaacacggtctctttagaaaatccgc

SEQ ID NO: 219487 - DNA, 771 bp, Homo sapiens
aaaaccaagctggcccaaggtgtcatgcagcctgtaatactgtttaatcagagtgccattttttttttgttcaaatgattttaagtattggaatgcaaaattttcaaaaatatgcaaatagaagtttaaaaacttttttaaaaaaagggggggactcctctttttaaaaccatcagatctcaggagacttattcattatcacgagaacagcctgggaaaggcttgcccccatgattcaattacctcccactgcgtccctcccacaacacatgggaattcaagatgagatttgggtggggacatagccaaaccatatcaaatccccacccctagaagaaaattgctgccattttctgaacatacctcatatgaagaagcatgtttatgatctgtaactgcacatctggagttcctccctgtacatgcttacatacatacctccccgccccacatctaattccttaaagttccctggattccatcaccttcggaaggggttctttagaaaaagagctcactcctccgttcctgaccagcaataaaatctgcttgcctttttttccaattggatattctttcttggctatcaatacaaagtaaggaaagaacttggtttcccagtgacagaaggaaataaaggatgaccaaaataaattgagggatatactgtatatatgattgggaagaagcaatgtagagatgcaagctcctctgtgcccctaaaaatctatacacagaatacattttaataaaaatatcctataaaacaaa

SEQ ID NO: 219488 - DNA, 1895 bp, Homo sapiens
tcccctttctttttctttctttctttctttttctttctttctttctctttctctctctcttttttctttttctttaaggtggggaaagagacaaccaagagacaggaagctgatctgcaaggattcggagttgtgctaaaaggactttgattttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcctcaagatcagccatcttgacatcactctctcatgttgtatgtgttagcttttgctgaaatataaaccatcccaaacttagcaa

SEQ ID NO: 219489 - DNA, 2380 bp, Homo sapiens
  misc_feature (2082)..(2083): n is a, c, g, or t
  misc_feature (2087)..(2087): n is a, c, g, or t
  misc_feature (2091)..(2091): n is a, c, g, or t
  misc_feature (2094)..(2094): n is a, c, g, or t
  misc_feature (2100)..(2100): n is a, c, g, or t
tcccctttctttttctttctttctttctttttctttctttctttctctttctctctctcttttttctttttctttaaggtggggaaagagacaaccaagagacaggaagctgatctgcaaggattcggagttgtgctaaaaggactttgattttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaaaccataaacaggactgaagaatgtctgtctgaatctttgccttgaatgaagaaacttcattgaacaagaagttggcttccagtttgcacagacgtcaatggaatgcatttttgttgttgttgttgtagtttttttttagtgttataccttacccaatgaaagcaaagtttttatgtgctgtgcaaatggtcttcatgtggtctgacaatttatttttgccatcatttttttaattaaagaaaaaatttccagaagaggannaaanactncanaaacanaacattgaaggttgatattttatgtggaagaacatttgaattgaattcaaaatatctctgaaggtgtagatacttctttttttttttaacagaaaacctgatgtctagaggtgggcactataaacggaatccaattggcttgcttaataatcaagctgctttctctttacccctctttatttaacgcaggggggtgtatcattatccctttctatcaaaaccccagaaccggaaacactagacttcgttagccttcattttaggggcgcaaagggcctgg

SEQ ID NO: 219490 - DNA, 1782 bp, Homo sapiens
tcccctttctttttctttctttctttctttttctttctttctttctctttctctctctcttttttctttttctttaaggtggggaaagagacaaccaagagacaggaagctgatctgcaaggattcggagttgtgctaaaaggactttgattttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccaggtaaaattctttctttgtatgtaatcgttctttcctcattgttccttttaaattccattccttttttagtactagagcccaaagcaatagaatatgcaaaaaaaaaaaaaaaattaaaagtagcttatcaaatctgtcatccctctgtgtctttgcttggagctaaataatttcaatgtaattataaataaactgtgcttgttcaaatgtcaaaaaaaaaagaaaaaaaaaaaaaaaaaaaaaaaaaaaaaaaaaaaaaaaaaaaaaaaaaaaaaaaaaaagaaaaaaaaaacaaaacaacaagggggggggcgcgccacaaaagcaacacccacgggagggagcacacaaatgaagagagacacacgggttatcagaaaagagcgagccccacatagagagcggcatataatatacgacaacaagcgagagcccctaaaaacaacggacgaggaagggaaaacacccagcacgtgcaccagcggcagcaaagccgggggacaaaaaccacacaacagcggggggcaggacaccacaatacgcgaaaacaccacaccacagagagatatcaacccgcaccgcgcagagaaaaaaaaaaacgaaagagagagaaagagacagaaacaaaacggacaaataatacgacaggtagagaaaaaactgtcacacgacgataagattgctagcaaaaaatcaacaccg

SEQ ID NO: 219491 - DNA, 1943 bp, Homo sapiens
tcccctttctttttctttctttctttctttttctttctttctttctctttctctctctcttttttctttttctttaaggtggggaaagagacaaccaagagacaggaagctgatctgcaaggattcggagttgtgctaaaaggactttgattttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaagtaagtctgggctgtgctaagctcttttcctcaagatcagccatcttgacatcactctctcatgttgtatgtgttagcttttgctgaaatataaaccatcccaaacttagcaa

SEQ ID NO: 219492 - DNA, 1073 bp, Homo sapiens
tcccctttctttttctttctttctttctttttctttctttctttctctttctctctctcttttttctttttctttaaggtggggaaagagacaaccaagagacaggaagctgatctgcaaggattcggagttgtgctaaaaggactttgattttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcttcaagagcgggacccagctgtgactaagcgtctcaagtctgttacttttctatgtatgagcaggagcttgagaatatgctgatatgcatatgggaatgtcggtttgtcacgagtacttagaggggaatcctctagggtcggccgcacgg

SEQ ID NO: 219493 - DNA, 1282 bp, Homo sapiens
tcccctttctttttctttctttctttctttttctttctttctttctctttctctctctcttttttctttttctttaaggtggggaaagagacaaccaagagacaggaagctgatctgcaaggattcggagttgtgctaaaaggactttgattttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaaggtatggcttgacccacggtctggcgatcagcgtggtatcgttctgcacttgggatgggaaacagacaggcgtgtgaattattagttaacccccacccccatcacttcttcctgcttctttgaaattagtgacataccaatggagttaatgaggcagaggaagacataagaagaaagcagcaaacccggaattgtagctttctctttaaggagagataatagtttcacttgagttcagtttctttgttgttatttggcagcataaatggtcctgatatcaggaacgtcttttgcagatgggcacggtttttagaaagcagatcacaacagtgattaccaggcacaagaatataatttcaggggcttttctggtgagctgttctttgattgtggctctaaaagggtttttcccactggataggacgtgcaacggtgggggtaactcaaacttttaatcgcagggtatagaatgaaagaagggtgtgagaaggtatagggctcctaccagagtctctgagagtttatttttatttttaatttgccttgcctattttattttatgttgaggatgatcagcatgctacagactgctttacaatagatgttctttacttttagaagatctatttttctgtgtagctgccatgaggaggcctgcctgcgaacctatgaggtccgctcattc

SEQ ID NO: 219494 - DNA, 1082 bp, Homo sapiens
aaggaatgatggatggagagcttggctttcattgatcattttgtctatgataaacattctgcacaagacatcagtaaaaagaagtaatgcccctagtgaaagcactttcaagagcattttggagattattatctagattgcagtttaaacaaaagtttctctatttgtacaatgtttctcaatactcagaacttaccatatttgttactttccttcccttagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccaggtaaaattctttctttgtatgtaatcgttctttcctcattgttccttttaaattccattccttttttagtactagagcccaaagcaatagaatatgcaaaaaaaaaaaaaaaattaaaagtagcttatcaaatctgtcatccctctgtgtctttgcttggagctaaataatttcaatgtaattataaataaactgtgcttgttcaaatgtcaaaaaaaaaagaaaaaaaaaaaaaaaaaaaaaaaaaaaaaaaaaaaaaaaaaaaaaaaaaaaaaaaaaaagaaaaaaaaaacaaaacaacaagggggggggcgcgccacaaaagcaacacccacgggagggagcacacaaatgaagagagacacacgggttatcagaaaagagcgagccccacatagagagcggcatataatatacgacaacaagcgagagcccctaaaaacaacggacgaggaagggaaaacacccagcacgtgcaccagcggcagcaaagccgggggacaaaaaccacacaacagcggggggcaggacaccacaatacgcgaaaacaccacaccacagagagatatcaacccgcaccgcgcagagaaaaaaaaaaacgaaagagagagaaagagacagaaacaaaacggacaaataatacgacaggtagagaaaaaactgtcacacgacgataagattgctagcaaaaaatcaacaccg

SEQ ID NO: 219495 - DNA, 1813 bp, Homo sapiens
tcccctttctttttctttctttctttctttttctttctttctttctctttctctctctcttttttctttttctttaaggtggggaaagagacaaccaagagacaggaagctgatctgcaaggattcggagttgtgctaaaaggactttgattttttttccccctttacgaacgctggcaattgacatcactacagacagcctggttagagaacaaactgcctcatcccaagtggaccccggcagctgggggaagccaggcaagatctgggaaggctgtgtgtgggtgttttttctacagatctcactcctcgccctttttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaataccacaacacaatgaggctcctgacactgaccgggtac

SEQ ID NO: 219496 - DNA, 514 bp, Homo sapiens
ttaatagaaggggacatattaatataacatattacaaagtcaaaataaaacctttatggcagtagatgcctaaagcatttgaaatagggcacttgcaaaattggaggctacaagagacgctcatgtatgacttcttagtcatacatgaagtggacccagtgattatgccctgagtaccaatggctaagcaagtgattctgaagcctgcggatgccaggcctggtcaccactgtgactcaggcaggcacctggaactggaagaacatcagcacagcaataaaacatctgcgcaagatcagtgacagcatgcctcatccggcaccacaggagtggtggactcaacagactgaccaggttcctctctgactgacttgaaagctagtctgattctctttggactgagtcatcccaagttttctcgatctaagatgggtgggtggtggtggtagggggtggcttaaattgacgagctttgctttctgctaataataaagttggaacaattattaaaaga

SEQ ID NO: 219497 - DNA, 292 bp, Homo sapiens
gcctcgggaaaaacacaaaagtacaaaaagtaatattcagctgagaaagaaggctttagtttactctctaaaatcacgtttttttacaagtggctatgtgtccatttgtttctttgttcagttttttacgccagcctttctaacagttaccatgtgcttctggaggtaaaaggatagtttcccaggtaaatacttcattctttccttctttttttttttttgagattgtgccactgcactctagcctgggcaacagagcaagactgtgtctcaaaaacaacaacaacaacaa

SEQ ID NO: 219498 - DNA, 323 bp, Homo sapiens
aaaaaaaaaaaaagaaagaaattaaaaccaccatgagatgctattgtatatgcactacaatagccaaactaaaaacactgtctataccaaatgtcagccgagatgtgaaacatacttatacactgctggtgagactgacatgaccactttggaatacagttggatgcttaaacatacaccaaaacatccatatgggctgggcgcagtggcttacgagtataatctcagcactgtgagaggccgaagtggacagatcacctgaggtcgggagtttgagaccagccaggccaatatggcgaaactctattacaaaaaccaaaatt

SEQ ID NO: 219499 - DNA, 500 bp, Homo sapiens
atcactgagcctcccttagctctttactttgttggcatcctttggaattttgtgttggctcattgaggtcattgatctgtctggctgtctgtggatttatgaataacaccatacttgaacagcaccattctaaattattgcatacaatgcacttaattttgtcctgaatctcattagagaaaacaaggaaaatattataaagtaaaataatacaaatattggtcagtgtattttactcaaaggcaatcactgggaatttgtttgtgtatttcctgccaatcttttttaatgcatttttaagaaagcatgataatgtctaaaattcaactgtttatttaattttgtattttggtgtaatcctttaatattgtaacctaagtgttttccaatattctataaactctttgttaagttttacttaatgaatatattgtatactgcagtattgtaaaatgaatttgcaaaaatttcaataaacaattttctcattgttgaacttt

SEQ ID NO: 219500 - DNA, 606 bp, Homo sapiens
aactcttgacctcatgatctgcctgcctcggctttccaaagtgctggaattacaggtgtgagcccccgcgcccagccaaaaaaattgttttaaattagctgggtgtggtggtgcctgcctatgaagtcccagctactcgggaggctgaagtgggaagatggcttgagcccaggagttgaaggatgctatgagctctgattgtgccactgcacccctgcatgggcaatagagtgagaccctgtctctttaaaaaaaaaaaaaaaaagtatcatattgtatgtgttctgtagaacttgctcccacactttaacattttgctttaaagatttgttcgtgtacttagatcattccttttcactgctttatgagctgaatcatttctgctcttctttccatccatacccattggtctccaaagtatccaggcctccccaaaagttcctgcaggagacctcagttccactggctttcaggtcattattgttccagcactacttctccatttctggttccagcccttctctcccacattctcaagcttctagagggtcataagagaggaaaaacgccaaatgcctttgataaaatgttgcctttccagtggta

SEQ ID NO: 219501 - DNA, 425 bp, Homo sapiens
aagtaaattgataatacagaagatattggggagaatttagagagcagtatccttgagtagcaagttcatatccaaaacagaagagagaacttggagtgcaaaataattccaatagatggttatacttgctaaattgtttactaatcatttatcacaggaggatttagacagggttgatgtatcaatttcaactaggagccaaccagtcaagcatcatggtgtcctctaacagagtaactgtagaaggtgaactgcatttttctaagtatcacctggatatctggatagggtgtgtgactgttaacatggctcttttttttttgtttgtttttttgtagtggtaaatggagattattttttgtagcttatgaatatatttgtttctgaaatgattcttttctttttttaaaaaagtgagatttgta

SEQ ID NO: 219502 - DNA, 380 bp, Homo sapiens
gaattgagcaatccgggggctctccaagtctctgcagctgcccgagggtcgaaggggcacaaagattccctctctgctatttaagaattggtggagtgggctgggcacggtggctcacgcctgtaatcccagcattttgggaggccaaggcaggtgtatcacttgaggtcaggagtttgagaccagtctggccaacatggcaaaaccctgtctccactaaaaatacaaaaattagctgggcgaggtggcaagcacctgtaatcccagctacttggaaggctgaggcaggagaatcgcttgaacttgggaggcagaggttgcagtgagcagagattgcaacatagcactccagtctgggcgacagagcaagactccatttc

SEQ ID NO: 219503 - DNA, 889 bp, Homo sapiens
tagtacaaaaatagtgagtaaaagaggtagtaaagcaaagactctgaaaccatactgcctggattcaaaatttggctttgtcatttattagccaagtagccttcattagggacttacacattctaggcctgttttctgatctatagaattgggtcaataagagtatttacttcatggtgttgtgatgattaaatgataaacatgccaggcatacaaggaagcaggacattattgctatggtggttgctatcactacaaagttattgttaaccaatgcactgctttcaaacaaaaatggcaaacagcatagaatcataagggaaaaatatgtaggagtggcaagctggagaaagggacctggggctacagatgtgccagcaaaagtcatgaacacacagagacagccaggaggaaggtagccagtagtggctgtgggtgtgcccactgtcagcacatggatgtaactgacatagaggtcatgggagaaggggctgctggagggagcctgaactgggtctgtgatctccttttgcaacatgctcatagcacttagttcctaagatccatcaccaactctctgtggggaaggatatctttggatctgtttttgggcacagttcatctagaatagtggggaacatcagccaaagaggcaaaattaagttgtgcaccttttgacagcagcaagtatctccaggcattaaaggcaagttttgtctaatgtagtagttttcctgacaaatgcagtactctactcatggacctcttttttcttttccttttctttttcttttttctttttctttttcttttttcttttttgagatagtttcatgtcaggtcgcacatattggaatgaagtggcattatccgtaccgttgtttttcct

SEQ ID NO: 219504 - DNA, 391 bp, Homo sapiens
gattcctcagcccagcccactccaatgaaccagaatctctggagatacagcccaggggtctgcattttcagacaactcccaggtgattctgatacagaatacagtttgagacatcccactaaccccagcactgcaccgtactacctcccagctccaaatgggaaggtgttgtgaaaatctgcacaggtagttgtagtcactattatgcacgatattattatctcctctagtccaattctttctttgcagtcccagaggtttagaaggaagtaagaggaagggctgaggtggaaaaagatgagaaggcagagcagggagggaggtctcagcccaagcaactggtacattgctccctgcagtgcaaaaatcagagctgcgaccaacacaccac

SEQ ID NO: 219505 - DNA, 237 bp, Homo sapiens
cagggaagctgacagtgcacccttcagtctgtggccaaaggcccaagagcccccagcaaaccaatggtgtaagtgcaggaatccaaaggctgaagaacctgaagtatgatgtccaagggcaggaggagcaggaggaagcatccagtataggaaagggaaaagccagaagacccagcaaacaaagttatcccaccttcttccccctgctttgtctttgctgcactgcagcctcttgga

SEQ ID NO: 219506 - DNA, 539 bp, Homo sapiens
cataagaaagtagagataagtatgattaattttttagctaactttctcagcttactgggtaagaaaataaataaataaaaattgataggtaaatctagttcaaacttggaaatgttctctttaagatgtaatacaaattattttaagaaactaaaaatctagaaaaaattgtgttatatatacttagtatatttaatacataaggaactgttattacaaattaataagaaaattatgaaaatccagatagagattgtgaaaggcaattcataagggaaaagtaaaaattgctaaactttgattttaaaattactattatacaaacatataaattaaacatagtttgtatttttttaaattaaaaagaaaaattatagttttggtgtagttgcactgaaactgaaaatatagtaccctgctcttagaaatgtaaactactagaacctttcaggtaagaaatacaatatccagttatcaaaaatgtaaaattgttcatatcttttctgagcatttgaatcttatcctaaaaataaaaaaat

SEQ ID NO: 219507 - DNA, 422 bp, Homo sapiens
taactgtattagtaatagcagtgattactgtagagactatatgaagtagttgaaagaatgtggacgtttagacagacagacatggacattaccttcttcttccacttaagtagcatttcagcctcggacaaatttcttagctcattatctttctatgtaaaattagaataataatatcttaagtttcagtattacgaggattaaatgagatagtgaattaaaaggttttagtacgtagatcctcaaaaaataatcatttttctgtcactgacatcttagagttggttcctactgctcagtcttatcccctcccaccccccagaacactttcttttacgcttccggggtgttctcttttgtaatctggaaggagaattgctacacacagttatagtccaattagggctcccactggcaatctc

SEQ ID NO: 219508 - DNA, 794 bp, Homo sapiens
ttcagaagagagatcacagagcctagatcatttctgcctttgatgtgcatctcctagacgtcagcaggagactagacggcttgtcaggaatgagattagaaacctgcaaagcaagaaccttttcctaagatttttcaactatccctgttgttactggacagactcaggaaagagagaaaaatgcatctgaaatctctaccttctaaggctttcgttgagaagaaaaaagcaagcccaaatgtatgagcctttgtgctgaaatctatgtgaaagaaagaaaaagataagaaaagcaaagaaagagagaaaaaagaaaaaggaaggaaggagaaagagaaagaaagagagagaaagaaagaaagcaagcaagcaagcaagaaagaaagaaagaaaaaagaaaaaaaagaaaaaaaaagaaagaaaagtgagattgtatcttaaatggctccagggtggggcaggaggagtttaagaaaacataagcaggctacacttttccctttttttttcagcgacttttttctacacaggatttcctgatcacatcatgaggaactatgtaaatatgccctctttgactcagtggaaataatcatttcctgtcaagttatttcaaggaaggaaaaagacccccaaacagccaaaaccagaaaagtacaaattgtcaaatgaaatttcataagggacagttttcaagtgagtcaagcattattctgtaattcgttcttaacttggttgcctttgttttgtattgttttgttggtcaaatacattacttacattgcgaaataccc

SEQ ID NO: 219509 - DNA, 659 bp, Homo sapiens
ctaactctcactgttcaagccatgctagccttaattaggtccttcatttcaccattctcccttctaccacagggcctctgcacttgctatttcttctgtctggacaaccatctcccatctatcctttctttgccaagttaacatctactcctccttcagatcatagcacaagtatcatttcttgaggatgccttctctaatctggtcaaatctcactaatgtaagtgttacccaatacctactcttatgccactgtcacaggtgcaatttaaacacttaatttgacatttctgtcttctccaccagaccctaagttccatgggggaagggtatcacatcagtttttgccccacataatatcctgttgcctaggtggcccaataaaaatgtgttgcatgaatgaacaaatgcatgaaccatgctcaaaaatcatgagatatggtccagactgcctaagtcaaagttcagttgccagcaatcacaaaacattcaccactaggtcaaactcctatcaccatgatcttcactatactaaattttctttggcaaggtccttttagctaagataatgaagtttacttatgacaggccttcttctggtggcttcctatttacatgaagaaaccatcaaaaactcaaactccattgaataaaataaa

SEQ ID NO: 219510 - DNA, 624 bp, Homo sapiens
  misc_feature (586)..(586): n is a, c, g, or t
gtcaccctccgcttggatcggactattgctctgcagtggggcaggagggggaactgaggtcttattgacaatgcctggtggtggctgtctgcagttctgtgctgaggcctggaggccctgtcctggttcagtgggaaaggtacgtaggttgattactgacatgagccatgggcaaggggagtaggctgcgggggcatttgctctgtgccagcctacactacatgttggagctgctggtcttgcctctgtctcagtgctgagccccaaatgggtcagcatggtagagatggtggagggaactggaagcccccaggattctttgctcctgtgggagtcatacctctttcccaggcaggagaaggggcaggcccagggcaagggaatacacatgacataaaatatccccagtggccaggcacggtggcacactcctaggtgacaaagtgagaccctgtctctgaaataaaatacacacacacacccaaactccagctctccaaatctaaaaaagtacatagtacctttatttaaactaaatgcttaagtgtggaagtggcacacaaatagatagaacagactaggtganaagaagagaaagtcccgaataggccgggggatcctcta

SEQ ID NO: 219511 - DNA, 675 bp, Homo sapiens
aaaatacagtaggctgtgtgtaaaatatttcctgaagctagctgatgggtacatgaaaattcattaaataaacatcaacactacagtccgccatacccatatgaacgtatatctgtacttattaatacaagtaatacacaaaagtgctgacaaccctcaactagaaacaaacactaaaccagaataagatattactatacatggtttatgggtcaccatggggaaaaaaattacctacctccataagcctgaattgtgttattttaaatagtatataaaatgaatgatctaagattattcaaaatagagccagatatggtggtgtgcatctgcagtagtcccagctacttaggaggctgagttggaaggatcaactgagcccaggagttcaaggctgtattgcaccatgattgctcctacaaatagccactgcactccagcctggacaacacagtgagacccccaactcttaaaaaaaattattattcagaatgacagaaaaggattatttccaaagggcgtgagtaccccgtttactatttttgagtattcttgttcctatttgccaaaaatgttttaaacgattaaagccttggtttttaaggtttaatagtaaaattttaattattcactggcaatcttttaaagcactgttaacttcctgggcaccaaatg

SEQ ID NO: 219512 - DNA, 864 bp, Homo sapiens
gggatgggatttctgggaatgtttcctttctaatggattttctggttgtatttttaaggtggtgccaataggatgtactgacagatcagaagtggtcgtgagagaaggagcaagtagccagaagagtgaagtgtgcactggctgagatgtgggagcaggtgttgttggtttccccggagatgcagcaagaaggccctcgccagatatcaaggccttaagcttggacttcccagcctccagaactgtcttatgtatcaacaaaatcacaccagaccacccaaagctggccctgccaactgaccacacacacccctgcctgaaaggcatgtttcaatgtgcaacagacgcctgccactcaggggacatcaaatgttcatgagaactcgctaacctcgaaacaggttctacaaattcaaaaaaaccacccgtggcctggctctgggctgaagctgagtcctggcttgaaatcccctgccttaatctctcttcgaagacttttctgcattcatctgagtcctcatcctccaaggcagggctcaggcttgggctcaggctcccagccatgtatccctcctggaccattcctgactcctttccagtatccttatcacttgtaccacatacgttggcctttgatcctgtgtactgttggatttgtctttacttcacaggttcatcttgtctccccaagaacaatgagagttgcctcaaggggtagaaccatgctttttgttttcttttgaattcattacagcacagccaaaagctcaacacacaaaacacactcagtaaatatctgttgaacagaataaaaaccgagcggccggccccaccatatatatccccccctccctccatttcccc

SEQ ID NO: 219513 - DNA, 506 bp, Homo sapiens
gggatgggatttctgggaatgtttcctttctaatggattttctggttgtatttttaaggtggtgccaataggatgtactgacagatcagaagtggtcgtgagagaaggagcaagtagccagaagagtgaagtgtgcactggctgagatgtgggagcaggtgttgttggtttccccggagtaagttaccttgagtgagttaaggttaagatatcccaggggtgaggttgagcaggcagttgtgtatgtgaccctggggaaagtctagctgaagatacaaagatgggatgagatcaccaaggagtaagtgtctttagcaaagagaagagaccaaggactgaatctggatacctcaacatttggagtcagagcctgaaaaggatccctcaaaagtgcccaagaagcagcagaatgaggaaagacagcccagggagtgtggcacagctgctcccaggggtgaggttgagcaggcagttgtgatggacccgaaaatagggagcctcagagt

SEQ ID NO: 219514 - DNA, 418 bp, Homo sapiens
atttggagagaccttgggaatggtgaggactgtgacctcagtggagcacctactttactgagacagggcagctgcttctccatcttgccctgtgctagtcttgctggatattttatttttcaagaaataaaatatggaatgtggaataatatgtgtgacttatcaatttttaaattttggtaggttctacaaattcaaaaaaaccacccgtggcctggctctgggctgaagctgagtcctggcttgaaatcccctgccttaatctctcttcgaagacttttctgcattcatctgagtcctcatcctccaaggcagggctcaggcttgggctcaggctcccagccatgtatccctcctggaccattcctgactcctttccagtatccttatcacttgtaccacatacgttggcctttga

SEQ ID NO: 219515 - DNA, 518 bp, Homo sapiens
actgagaaatctgatacctgtttccttactaatggattcttctaggatttctaatcttgcagggctagtgtgccgcttaggatttaccgatcggtatcacaaggtctcgagtgtgaaaaccctgtgcgcgcgagccagtgaggtgtggagcgcgagttctgcgtcatggtcttaggtgggtcctgccggagtaagttaccttgagtgagttaaggttaagatatcccaggggtgaggttgagcaggcagttgtgtatgtgaccctggggaaagtctagctgaagatacaaagatgggatgagatcaccaaggagtaagtgtctttagcaaagagaagagaccaaggactgaatctggatacctcaacatttggagtcagagcctgaaaaggatccctcaaaagtgcccaagaagcagcagaatgaggaaagacagcccagggagtgtggcacagctgctcccaggggtgaggttgagcaggcagttgtgatggacccgaaaatagggagcctcagagt

SEQ ID NO: 219516 - DNA, 888 bp, Homo sapiens
ttccagcagtatgctaggacctggggataggtagccagtaaaatctcttatgtgccctcagaattcaacctggctggagagacagactcataaacaaataatcaaaaggcacaacagataactcagtgtgaaactgtggctgatcccttgagctagatcctctaggatctcttgcctggtcaaagtataagaatgctgttttagcaaaagacagggttggcattgccagtacctgcattccactttaaacactgaccttatgtcagccagcagaccttggcaactgccttgtctgaggatcctaaggtgaaataaaggtattagtccggtaaacatggattgaccacatgcaggataatgggataggcatatgagggagagaccacaatgaacatatatggtcactgtgttccatgagccgatggcctagtgaatgattccagctatgattaactctgttacaggaataggagaaagattaatttaggctctgtcactcaggcctgattttatggagaaagtagcatctgagctgagccttgaaggacatataggttgggacaggtagaactggagagggaggacagtctaggtggaggaaacaacatagcaaaggttcagggaggaaaagcacaagacattcttagaagattgtgggtggcacaagccttcgggtgtggtccctgctactcaggaggctgaggcaggaggataacttgagcccgggatttccaagctgtagtgcactataattgagcctgaataggccactgcactctagcctaggcaacatagtgaaatctcatctctaaaaaaaaaaaatttttttttgtttaaagcagggtctcactccagcctgggcgacagagcgagactccatctcaagaa

SEQ ID NO: 219517 - DNA, 539 bp, Homo sapiens
gtccaattctgtgctgtcttttatcattttccccattataggttgaaagcttcagatgtcacaatttcccagggtcttaggattctaccctggctctggcagcctaccttcattgttttacccaccaaaggaaatggtagaaactcagctctgaggcaaggggttatggcttctactaaggtatccctaagaatagggcatatgctttgtctgagctttaaactatataaatggtgatgcagaatggcagatgcttgaaaggtaggtatagtctcttaatgcctaaggtagactaacacaagaagatagattcttgatgtgtgtagtcatggactccttggctgcaagtgtagaaatgcaactcaaaccagtataagcaaacctggaacttattaccttttgtaagtgggaagtccaaagctacaactggctcagggcaagtctggatggaaggaattaagtgatgtcatcaggaccttctctttttctctactttcttgtgttggcttttttcaattaggaccttacgtcatggcaga

SEQ ID NO: 219518 - DNA, 97 bp, Homo sapiens
agtggttgccctagggattacaattaacatcttaattttagcctcgttggaactgatgccaacttgctttcaatagcataaaaaagctttgcttcta

SEQ ID NO: 219519 - DNA, 574 bp, Homo sapiens
acgcctgtaatcccagcactttgggaggctgaggcggacggatcacgaggtcaggagatagagaccatcctggctaacgaggtgaaaccgcgtctctactaaaaatacaaaaaaaaattagccgggtgtggtggcgggtgcctgtagtcccagctacttgggaggctgaggcaggagaatggcgtgaacccgggaggtggagcttgcagtgagccgagattgcgccactgcactccagcctggacaacagagggagactccgtctcaaaaaaaaaaaaaaaaaaaagaaaagaaaatagggtctttgtagtttctattaagtaaacaatctccagataaggccatcctggatttagggtgggacctaaatccaacaacgggtgtccttctaagagacagaagaggaaaaaagagtaataataaaaaatggccagtgagcatggtggctcacacctgtaatcccactactgaggaggctgaggcaggagaatcatttgaacccgggaggcagaggttacagtgagccgagatgatgccactgcactccagcctgggcaaaagagcgaaactccat

SEQ ID NO: 219520 - DNA, 283 bp, Homo sapiens
ctacgtgaaagatgccagattccaaagaccgtgtattgtgcgattccatttgcgtgagatgcgcaaaagaggcccctctatagaggagaggccagtaaacgtctcctgcgaagggcaaggcggtaaatattctaggatttcagggctcaacagtctcggtcacaactcaactctgcagttgttgcaagaaagcaaccacagactatacatcaatgaatgggcgtggcagcgttccaataaaactatttacaaaaacaggcagccagctggatctggccgtgac

SEQ ID NO: 219521 - DNA, 553 bp, Homo sapiens
aactcttacaacccaccaacaaaaagaaaaacaacccaatttaaaaatagtcaaaatgtgaatgtactaaaaagcgctaaaaaacaagggcaaaggacttgaataaacatttctccaaagacaaatggccaataagcacatgaaaagatgctcaacagcactaatcattagggaaatgcaaaccaaaaccacaatccctatcaaaatatcctttttcgcagaaatagaaaaaaatccaccctaaaatccatacagaatctcaaaaaacctcaaatagccaagacaatattgaaaaagaataacaaaattggaagactcacacttcttgatctcaaaacttaactacaaagctacagtaatcaaaagagtgtgatactggcataaagagaaacataaagaccaatggggccagatgtggtggctcacgcctataatcccaacacttcgggaggccaaggcgggggggatcatctgaggtcaagagttcaagactagcctggccaacatggtgaaaccccatctctactaaaaatacaaaaattagctgagtgtg

SEQ ID NO: 219522 - DNA, 364 bp, Homo sapiens
agaatgtgtgaactatattgctggtgttctttctttccaaaatatgaatttgatattcagtacttcacttgtaaaattttaggaacaacttttaaaaaataagtatccagaatattttcatgtgaaacaacttttccttttccttttgttctttctttcctataagaaaacgctgttttacgctaatcatgttttgagtagacccttgggctttttctcttgaaattggaaagttaacaggtataatatgcaagtcttgttcagccaagaccttcagtttgttcttgacagtaggaaaatgcttattttccaggctcagccctgaaatttctatgttatatttacgaagatactttaagaaata

SEQ ID NO: 219523 - DNA, 346 bp, Homo sapiens
catgcaagaaaatgctttgaaggggcttcagaaaagaataatcaacatgcaagaaaacgctatgaaggggcttcagaaaagaaatcatcaaagcaaatgtgcaagaaaacgctatgaaggggcttcagaaaagaaatcatcaaagcaaacgtgcaagaaaacgctatgaaggggctttaaaaaagatatcatcaaagcaaacatgcaagaaaacgctatgaaggggtttcagaaacgagaaaccgttaaagaaaagatgcaaggaaacaacactgtgaggggtttcagaaaagagaaatcatcaaagcaaacatgcaagaaaatgctatgaaggggtttcagaaac

SEQ ID NO: 219524 - DNA, 509 bp, Homo sapiens
gatgccagctaccatgttttcttcagctattaggataagtgtcattataaagatccatctgtatttaagaattaatagtaaggttaaaaaccaagaggtgagctttctttcctgtgctgaaagaccctttcagttggtaggcccgccttgccaactggctttcaaatctatctttattaccttttcccagcctgtgaattaatgtgaccctgctgaattctcatccttgttctccggcgatgttttgggcaagagtgtggagtcaggcagtgagtctcaagtcctattccagggtctgggagctggaggctttgagggtcagctctgggaggattcttcctctcttagacattaactcagcttgactcacgcctatgaatccagagccttctgcgattatgagaagctgtaaacataagctatgcatctcacttctgtaccaggatgcgttcggtcttcatggctcagttatgagtatttcttaacatgtcgtaacatttatcttttga

SEQ ID NO: 219525 - DNA, 1716 bp, Homo sapiens
tagaagatacttaaaattctctttatgtgacaaataagtataatatattcaatttatttccatgttaaatatacaaatcttatgaagttcaatatgtgcaaatttttcacatctttctccttctctcactttacctcttctccctcttttaaacttttctttctccctgccagagtgaaccttatactaaaaaattacaagttttgatctgatcctctctcataccccatgtttgattcagagctgtagatgcctctgaatttgcgaatttctcaagggaaaattaactttaagagctttctttatttcaagcatgttgaaaaggattttgcaacatgacttgggagtacattaaagtaagtcagcatgtatttgacgaagaagatatttgaacttttgcagtttattgtacagtgcatggtaattttttcacctttaaaattcagtttacaggaaaattctaaaatcatgttgccattgtgatgtccaataaatttgtttttagcaccagcattattcatacaggggttaaagtattatttgtagaaggtcttaggttttgtttgttttttaatcatttaaagcaatttctttagccagtttccatttactatgtgaatagaagcactgctaaaaattgggaaccctgaaacacagggctgtttattaattcatttttctgtagtaaaattcaatttttcacaaattatatttctaaagaaatatagtaaacataaatttgcaacaattttaaagctccagtttttaggtgactcaaagaaagtcattatgcctattaatagttatttgatgccatcaccaaaagtctatgtgaaaatctcctaaagtcaaaacccctgcctttggttttacagacggttattaccattgggtggagctgcaaggtcaaatttctcctaagttcccctatttagaggaaaagtcactggttattgtaataaaccacccatggttctttatgtacattttgataacacattattatagcttgattttaattttttgcattaatttttgaaatccacatacatctcatttgtttaaattaaggccatgcacaaatattttttttagttcagtgctgaccattaaaaactatcatgcttgatacggtgcaaaagttaaaatgagtatcactaaaaatgccttctttttatgtggtgcaatatgaaatacaccaagactgtgtcttgacattctgatggacccaggtaaagttgttaaaagaacgaataaaactttattaaaataatttagacacctgtgtaccagcaacaattgatttaatagacctatagtgtctatactatcccttagaataaaggtttatgattttcctgatactaagatgcagtcacataatcttttgtgcatattcctatacaaattatttctaattttaataagaaggacgtgactacggaatatttgtacatacttgtcattatgcagtatttatttaaaagttggtgtttttttttttaattttcacatctgcacctcgacttgtggtttagtcatgtaactagcactatgccagtgaccgttgttgccctgtacatagtatgtttgaaaagtaaagggaattccagttgggaaaaaagggcagattagtcctgtaatgaacaccaactaatgtaaatcaaattcattctggtgatggtatttaacactttaaataaaacattttcttta

SEQ ID NO: 219526 - DNA, 1884 bp, Homo sapiens
tagaagatacttaaaattctctttatgtgacaaataagtataatatattcaatttatttccatgttaaatatacaaatcttatgaagttcaatatgtgcaaatttttcacatctttctccttctctcactttacctcttctccctcttttaaacttttctttctccctgccagagtgaaccttatactaaaaaattacaagttttgatctgatcctctctcataccccatgtttgattcagagctgtagatgcctctgaatttgcgaatttctcaagggaaaattaactttaagagctttctttatttcaagcatgttgaaaaggattttgcaacatgacttgggagtacattaaagtaagtcagcatgtatttgacgaagaagatatttgaacttttgcagtttattgtacagtgcatggtaattttttcacctttaaaattcagtttacaggaaaattctaaaatcatgttgccattgtgatgtccaataaatttgtttttagcaccagcattattcatacaggggttaaagtattatttgtagaaggtcttaggttttgtttgttttttaatcatttaaagcaatttctttagccagtttccatttactatgtgaatagaagcactgctaaaaattgggaaccctgaaacacagggctgtttattaattcatttttctgtagtaaaattcaatttttcacaaattatatttctaaagaaatatagtaaacataaatttgcaacaattttaaagctccagtttttaggtgactcaaagaaagtcattatgcctattaatagttatttgatgccatcaccaaaagtctatgtgaaaatctcctaaagtcaaaacccctgcctttggttttacagacggttattaccattgggtggagctgcaaggtcaaatttctcctaagttcccctatttagaggaaaagtcactggttattgtaataaaccacccatggttctttatgtacattttgataacacattattatagcttgattttaattttttgcattaatttttgaaatccacatacatctcatttgtttaaattaaggccatgcacaaatattttttttagttcagtgctgaccattaaaaactatcatgcttgatacggtgcaaaagttaaaatgagtatcactaaaaatgccttctttttatgtggtgcaatatgaaatacaccaagactgtgtcttgacattctgatggacccaggtaaagttgttaaaagaacgaataaaactttattaaaataatttagacacctgtgtaccagcaacaattgatttaatagacctatagtgtctatactatcccttagaataaaggtttatgattttcctgatactaagatgcagtcacataatcttttgtgcatattcctatacaaattatttctaattttaataagaaggacgtgactacggaatatttgtacatacttgtcattatgcagtatttatttaaaagttggtgtttttttttttaattttcacatctgcacctcgacttgtggtttagtcatgtaactagcactatgccagtgaccgttgttgccctgtacatagtatgtttgaaaagtaaagggaattccagttgggaaaaaagggcagattagtcctgtaatgaacaccaactaatgtaaatcaaattcattctggtgatggtatttaacactttaaataaaacattttctttaaaaaaaaaaaaaacgttcagggtgttgtaacttgggaacatctgaatgctgaggcctagagatcggtcaggggtgtgtaaactgggaccatctgaatgcttgagcctagagatcgttcagggtgttgtacctgggacatctgaatgcttaggcctaaacaatcgttag

SEQ ID NO: 219527 - DNA, 1983 bp, Homo sapiens
tagaagatacttaaaattctctttatgtgacaaataagtataatatattcaatttatttccatgttaaatatacaaatcttatgaagttcaatatgtgcaaatttttcacatctttctccttctctcactttacctcttctccctcttttaaacttttctttctccctgccagagtgaaccttatactaaaaaattacaagttttgatctgatcctctctcataccccatgtttgattcagagctgtagatgcctctgaatttgcgaatttctcaagggaaaattaactttaagagctttctttatttcaagcatgttgaaaaggattttgcaacatgacttgggagtacattaaagtaagtcagcatgtatttgacgaagaagatatttgaacttttgcagtttattgtacagtgcatggtaattttttcacctttaaaattcagtttacaggaaaattctaaaatcatgttgccattgtgatgtccaataaatttgtttttagcaccagcattattcatacaggggttaaagtattatttgtagaaggtcttaggttttgtttgttttttaatcatttaaagcaatttctttagccagtttccatttactatgtgaatagaagcactgctaaaaattgggaaccctgaaacacagggctgtttattaattcatttttctgtagtaaaattcaatttttcacaaattatatttctaaagaaatatagtaaacataaatttgcaacaattttaaagctccagtttttaggtgactcaaagaaagtcattatgcctattaatagttatttgatgccatcaccaaaagtctatgtgaaaatctcctaaagtcaaaacccctgcctttggttttacagacggttattaccattgggtggagctgcaaggtcaaatttctcctaagttcccctatttagaggaaaagtcactggttattgtaataaaccacccatggttctttatgtacattttgataacacattattatagcttgattttaattttttgcattaatttttgaaatccacatacatctcatttgtttaaattaaggccatgcacaaatattttttttagttcagtgctgaccattaaaaactatcatgcttgatacggtgcaaaagttaaaatgagtatcactaaaaatgccttctttttatgtggtgcaatatgaaatacaccaagactgtgtcttgacattctgatggacccaggtaaagttgttaaaagaacgaataaaactttattaaaataatttagacacctgtgtaccagcaacaattgatttaatagacctatagtgtctatactatcccttagaataaaggtttatgattttcctgatactaagatgcagtcacataatcttttgtgcatattcctatacaaattatttctaattttaataagaaggacgtgactacggaatatttgtacatacttgtcattatgcagtatttatttaaaagttggtgtttttttttttaattttcacatctgcacctcgacttgtggtttagtcatgtaactagcactatgccagtgaccgttgttgccctgtacatagtatgtttgaaaagtaaagggaattccagttgggaaaaaagggcagattagtcctgtaatgaacaccaactaatgtaaatcaaattcattctggtgatggtatttaacactttaaataaaacattttctttacaggcgtctgcagtgctttctctgacttttctccccacacagccctgagcctgctgcagctcattccctgaactcatgtgtcatttaaagaatgaaatcaccgtctcctacttctcgataacataagtggactgctggtcttagcagcggccctcagtagagcatttctttaaaacgccaaaggatttctgctcacactatgaaaaggtgctgttttttaaaagattgttattttggattgagtttctttctgattaaatgactcag

SEQ ID NO: 219528 - DNA, 479 bp, Homo sapiens
  misc_feature (14)..(15): n is a, c, g, or t
  misc_feature (47)..(47): n is a, c, g, or t
ttttcgactctagnngatcccctcatttcaagaataaaccttacaanaaacctttattctaattgatttaatagacctatagtgtctatactatcccttagaataaaggtttatgattttcctgatactaagatgcagtcacataatcttttgtgcatattcctatacaaattatttctaattttaataagaaggacgtgactacggaatatttgtacatacttgtcattatgcagtatttatttaaaagttggtgtttttttttttaattttcacatctgcacctcgacttgtggtttagtcatgtaactagcactatgccagtgaccgttgttgccctgtacatagtatgtttgaaaagtaaagggaattccagttgggaaaaaagggcagattagtcctgtaatgaacaccaactaatgtaaatcaaattcattctggtgatggtatttaacactttaaataaaacattttcttta

SEQ ID NO: 219529 - DNA, 763 bp, Homo sapiens
cttttcttcctgcactaggtcatgcaagctcaggtttctgagtgaatacagcaaaagagaaacataaagcagtgttttctttcagacagataatctgactgaatttctctcttcttttctgccttggctgacttgatgggtagtataaaatttccacagactattctcaaaatcaaaatgctaagatgggaaaatagtactcctttattgtctttctgttttatctcctggaattagtagaagtactcatttattgaatcagtgttatatgtataatttttttttaatctgacaactaccccagcaggcatttccctgttttatagaagaaaacactgagacctgtgaggcaccttcttgagatcatgaaactagtgagtggtataacctggatgtacacccaggcctgtctaactttctatagcccatcactttctccctggcactacattactttccagaaaaaagggcagtatggtcagtcatcctggtgatatatatatatatatatattattttttttttcctaaggcaaagtcttgtgcccagccatctggtggtatattttatatcacaccaaagcccatatactccagtctcttggaagtgtattcaacattctgtgaacctcagcgtaaaacagttggcatgttagataagtaatcatgagactgagcctaaattagggccaggtacggtggcttatgcctgtaatcccagcacttcgggaggctgaggcaggcggatcacttgagttcaggag

SEQ ID NO: 219530 - DNA, 288 bp, Homo sapiens
acttatttgctttttctcagctatttctgtttgctggtatttacttttaattttatgagttttttctttgtttctgttagttgctagtttatctaactggttgtcatttttcagctggattatattttctttatatattttgtatttttctgcatcacagtaaagcacctgcctcaagtaaagcacctgcctcaagtaaagcacctgcctcaagtaaagcacctgcctcaagtctgcctcaagtaaagcacctgcctcaagtaaagcacctgcctcaagtaaagcacg

SEQ ID NO: 219531 - DNA, 515 bp, Homo sapiens
cgagacagaggcaagaacaggtgctgagaccaagaggaagacacacagatgcaagggaccgacttcccaggccagtggcaatggcgtggatattaatgacagcctggttatgcctgcaggagatccaagagggcgggaagagcggaccccactgtcagcactgggaccgcagcaggcattgggggaaggcaccgaggtcttccacatgattcctgtgctgaattctcagttacagggagaaaagtactcttgtaataatatgccaaaaaaagttaacacaagtaaaatcatccctttaacatttaattcagcttaagccatgagacccctatggggtaatccacaatgctaaggcccagaatgaatgagactcctggcatcagagtcctgccagggaatagaagaatgaaaatccctccaaaccagaggcaccgctgccctaaatgcaaaatcacccatgcaactcaaacctagagaaactcagcagccacagttcaattcctgctgattcttta

SEQ ID NO: 219532 - DNA, 558 bp, Homo sapiens
gcagatgacgcaggccgggggcagtggctaacacctgtaatcccagaactttgggaggctgaggcaggcatattacctgaggtcaggagttggagaccagcctggctaacatggtgaaaccctgtctctactaaaatacagcaattagccgggtgtggaggtgcacgcctgtaatcccagctactcgggaggctgaggcaggagaatcacttgaacctgggagacagaggttgcagtgagccaagatccagtgctttggcaacagagaaagactcacacaaaattaaaaaaaaaaaaaaaattaaaaaccaagcagtgatgctgctactttatagtatgagaggctcttctgaatacccatcaacttcagagtatttggatttgaggttggcagggcagttgataatttcattcacagatgaagaagcttgaggttcagagacattagttatctcacccaagatcaccaaaccagttaattgcggagtcatgattagatcccaggtctatagtacaagaatgcttaccacttcatcacagggtctcattagcatatgc

SEQ ID NO: 219533 - DNA, 347 bp, Homo sapiens
agctgtccttccacgacactgttggatgaaagacatgtctccacccaaattcttttgcttgacccactatggagatttttctctggcttcttcagtctgaattctagacagggcttgaccggcgtaagtaagcaagagaatggcttcagctgcacacgtgagggcgcagagaactgactactacccacgcgggaccctgggtccacggggacaaccccacaagactgcagctaccttctgcccgatgaatcttccccagtcttttgtctctgtggtttggtgcttaccttttttttctttctgcctctactgaacttcatgaaatatgatcttttaatagacactaa

SEQ ID NO: 219534 - DNA, 540 bp, Homo sapiens
cttctgatctgtggattgcaaaacccgtgggaaaaatgtagtatccaggctgggtagcacagtccctcatggcttcctttggctggggaagggaggtccccaggctccttctcgggtaatgtgatgccccaccctgcttctgctcaccctccgtgggctgcacccactgcgtaagcagtcccagtgagatgaactgggtatctcagttggaaattcagaaatcacttgccttctacattggtctcgctgggagctgctgacctgagctgttcctattcagccatcttgccagatcctcaacttttcattcaataagtcttgatatatcatccctctttgcctttgtcatgcatttctctttctcatgaattagccatctcctaaactcattcataagatcactctttctatgaagctactgcttaattttgtttagtgaagcctttctaagttatgtgagtccaaacatttatcattcctttgaatgtaacatttattacaaatcacttcacattatttcattttgtgtctatattgtta

SEQ ID NO: 219535 - DNA, 805 bp, Homo sapiens
tccgggccagcatcctagagcccggggtggagatctcttaacaagactgaatcatagaagctaggcgtcttagtccgttctcatgctgctgtcaagaactgcccaagactgggtaatttatagagaaaagaggtttaattgacctcacagttctgcatggctggggaagcctcaggaaacttacaatcatggcggaaggcatctcttcaaagggtggcaggagggaatgagtgcaagcaggggaaatgccacatgcttataaaaccatcagatcttgtgagactcactctttatcacgagaacatcatgggggaaactgcccccatgatccaattacttccacctggtcccacccttgaaacatggagattattacaattcaaggtgagatttgggtggggacacatagccaaaccatatcattaggatgcttgagtcactgttttggagatagttctgaattctgggcactaaggaataccgtttggacactgatccttttatgttaaagatggtgaactggtgagttgcagtgttctcctttcagtttgttaattgggaatcctatagttgagcctaaattttcagtgttttgcttttttttttttaatcataaatggcaaatattacgcctacccagaatacggtgctttgaaacccaaatgttaaggagataaatgggtatacctaactgcttgggatgaacaagattttggggaataggaggatggcttctttagagacctaacagttatttgtgtggcctggaaaagtgggatagctcattctgaatcattttcaaact

SEQ ID NO: 219536 - DNA, 507 bp, Homo sapiens
ccaagatcacgccactgcactccagccagggtgacagagtaagactctcggaaaaaaaaaaaaaaagttactagttagttgactttgaattcatcaaaagagaaattatccaggtgggcctgacctcatcacacctatcctttcaatatgggcatagaggctagagacagcagaagtcagaaatgtaaagcacagagggcctctgtgcaccctgctggctttgaagatggaggagcaaggtgtgtaggtggactctaggcactcagagctgcctctccctgacagccagcaaggaaacaggggcctcctttctacagccagagtgaactgaattctgccatcaccacatacacttggaagaggaccttgggctccagatcagaatgtagcctgaccaacatctccattttattagccttgtgagtccatgaccaaagagccctgccatgctgtgccagaacttctgacctacggaactgcaagctaataaatgaactgttttaagtt

SEQ ID NO: 219537 - DNA, 536 bp, Homo sapiens
gctaggaaagaaggagggggcctctctaccctccgtaggcacttgtcagtttactgatctcttttgtggggtgaggataggagtgtggcgtggaaaaaacagatcccagacagacagcaccctcgagttcctttcccttcatgggaagagatgctgaatcagagaagggtggctgagacatcttctgacaagatggggactgggaagagtcaggaactcgtattctttctcaacagttctttttcattagacttgccaagtgcccgctttgtgcccagccctttgcttggctttgtgagattgtaggaggagacagtccctgccttgggaacaggcttcatcgggttggaaaaacaagagcaacatacttttaacaaccgcatgagatacgtatgaacaagttttgagttgaacctacttgcccttgttaaagcaatacaatgatttcaaaattgtaggcacttagtaaatactggttaatcgactggttgtttctattttgtcctctaggctgtgaacatttcaaagatggagac

SEQ ID NO: 219538 - DNA, 427 bp, Homo sapiens
ttactggagaatggtattagaaaccagtgtcttggagctaggcgtgctcgttgctcctggggtgccatttcttggttctcttggccaacagagtaaagaacgaaatgtgtgtatactaacctgcatatgcatatatatctacaaatatttctatatgtaaccatctgtatctatatttaacagatttcatattcttactggcataaaattggaaataactaagtgttttaacatgaggaatggctacaactatgttaatactacctccatgatgcaactgttataagggacaggttggaaaactgtggaaacataatactttacattaaaaagtagtattttttattgtagagtctccaacaaaggtctctgttggagttacgcttacaatgtgatagttgtgtgtgtgtacggatatgaactttaa

SEQ ID NO: 219539 - DNA, 603 bp, Homo sapiens
tcagctgcgatgccatcagtcactgtctcttctgagagtcccccagacttatgagacccttgggtgtgtctgtgtgactgcctccgacagacttgacagtggtgcatgcttgtcacatgtctctcttctgtcaaggttctgtagtgtttgcatgtgactccctcagttcaataacttgcatttttccgatggcacagttacccaccattgcaggtaaggtttcactgcttctctgtcttccttcaagttactccatttccattgtaagaggttaacataactttaacagattagttctagtttaagatgtcagcccaggctgggcgcggtggctcacgcctgtaatcccagcactttgggaggccaaggcgggtggatcatttgaggtcagcagttcaagaccagcctggacaacatggtaaaaccccgtctctactaaaaaaaatacaaaaaattaactaggcatggtggcttgcacctgtaatcccagttacctgggaggctgaggcaggagaactgcttgaacccaggaggtggacgttgcagtgagctgagatcacgccactgcactccagcctgggggacacagcaagactcagtctc

SEQ ID NO: 219540 - DNA, 441 bp, Homo sapiens
tagaaaatgccatctttggataagagttatatttcttgtgattcttttagaagaaatcttttctgtacatgtcagacataagatactcataaaacatatttgacaaaagtaaaaatcagtgctttattttaggatacatacagtgataccctacgcagaaatgactgatattcattaagcaagctgagtacaaactaaatggttaaaaaaaaaaaaaactatggaaaacaactaaaagaaaatgtagaaatctccaaaaacaatctcaattttaaaactaagactgggctaaaagatactatagtacataccctgtaataaatgacatttgaaaactgaaaaaatactaaatttttctctttactattaacagccttcatgttatggtcaataataaaacaaattatgaacactatatctaggggggaaaaatccaaagta

SEQ ID NO: 219541 - DNA, 684 bp, Homo sapiens
agcaaaccaaggccagacaggctaagtgacttgctcaaggcacatgggaagtggcatgtttgggggttcccagggccaggccaggatcggagatacgaacatgcaataaaaagtttcaaagtagaaaacaaaaacaaaaccaaaaaaccctccagctcctcagcttgcagctcctagagtagcttcctggacactttcctgcttggtcctggcggtcacatcaatgtccatgcacgcttccccaagaaccccacagaaccaattgttgaaagtcagaaatttagtgaagacacaatcatccaaaacacttgtttagcaacatgtagaacaaagaactataacagttgactattcactttttagtgtttgtgttgcctacatgattttttgcattggagtgacacagttttggcctaggcatgggcctccttctctcccctggccccttccttctgacttcctgcggccgctgtacttccacgggttcccctagcagcctccttactcccctttgctctcaagtctcagcactcaaagcaggcaggctgcattctgctttgcactcaagtagatggggtcgttaaagccacactgccctgagtcctccacagagtctcagttttcaaattccatgaatcatattctcggctgtctttccccaaagctggtggaagccaaaatgcc

SEQ ID NO: 219542 - DNA, 808 bp, Homo sapiens
tccggaccagatccaaagctaggccaaattcccagggtggaaacagggctaaattagacttagtggttagttacagtgaagtttgccaggtattcagaggattttgactcaatgttgtggtttcatcacaaacttaactccccccaaaaagggaggagaagagaatctctactatgggtatattttctcttctgtaaatgtagctgaattacaagtcttctctccaagtagtgatattcatacataggaaatagaactactcaagatacgttaactctatgataacggaagagaataggatccaatagtgcatccgaataggacccatgtacaaacatagattctacatcaattttaagtacagagaatgatgagtacatctttggagccactttaattctttgaaaagccgaaagtctaaaatgggtgacctaattttataagccagggaagctaaattgtaacattataattgataattctaaataattttcattggttcaaggaattaagataaataatgtaagtagtattttacacagtcactcccacagctagcccatgtgacgactttgtaggaattagaaaaatatacccctttctcagacctatcttcttcaaaacccagctgaagtgtctcttctgtaacaccttccctcatcacttcaagcagatttaatgttccaaatgtttggagtaaataagtgagtaaatgagtgactgaatataaaatacttacagataacatgcagagttagtggaggtaacatgtatgaattaggccattaggcattaaacctggtactgt

SEQ ID NO: 219543 - DNA, 600 bp, Homo sapiens
atttattgtacttcagaaataccactaaacccagcttctcttagtatctttatagccacagaaggtcactgaaaggctttaagcacaaaagtggtacaggtagaattgtttcaagaatgattactatgcttgcagcaagaggaatctgttgaaaagttggaagtacagagacaggctgggagttattaatgaaatccaggaaagagactatggatgcttgaactaaggtgatggcagtggagacacaggaaaattaattcatttcatagataagttagtaatggacttgatatgagtggtgctgaagctaggaagagctgtgaagggtgagtctcaagtttctgtcatagcaactgggagattattgtgcaattttctaaagagaatcgggaaggagtaatggttgcttgagggaaagattgtatgcctgcagtcatggatatgttatattgaaggaattttggcataaaagtaaaagtgtttataaataaattgtataaatagatccaattagaagaactgaggtccaggctattgatgcaaatttgaaagtggttagagtattgacgcaattgatgccatgggggatggagcacccat

SEQ ID NO: 219544 - DNA, 467 bp, Homo sapiens
ctaagcaatagtacttgttttatacccctttccagtcgtggagcaccgacggaaaccatcattataaaacagtattgttttttatattagtaaggatgaggttttaaaagacgtaattgacattaaacatgattgaagccctaattttgaccaaacgatatttacttcatgttttgagagatgatattaacagtaacaaggatacttgtacacagctttcttccaaaaatgatcatgcggctaagttgccaggagcaatagtaccaaaagatagtttgggacagaatgtgaagattttcaaattaaatattaaaaatgttttctctttctgaatggcttaaagttcttaatacattagatattctgtggtaaagaatccatatctgcaagttatttaaaaggtattagtacacaagagtataggtatataaaactaaatgaagtcaatcatattgattatcccccca

SEQ ID NO: 219545 - DNA, 339 bp, Homo sapiens
gactgtaagcattttaactcaggattataagtagttcctacttataagacgtgaggtgcagtggctcacgtctgtaatcccagcactttgggaggccgaggtgggtggatcacgaggtcaggagttcgagaccagcttggccaatatggtgaaaccccatctctaccaaaaatacaaaaattagcccggtgtggtggtacacgcctatagtcccagctactcaggaggctgaggcagaagaatcgcttgaacatgggaaatggaggttacagtgagccaagattgtgccactgcactctagcctgggcgacagagtgagactccgtctcaaaaaaaaaa

SEQ ID NO: 219546 - DNA, 615 bp, Homo sapiens
cccattcttctcctgtctggtctactcctcctctaggaagccctcgcagatgatccggcccttggctgcttctcttctaaccatctctccttcaccctgcctagtatctggagcccagggcttgggaggacttgggctaccaaagagacagggggttggccaggatggccttcctgttctgatggccccagggcctgcccaaccctgacctcaggccacaactatgactccgcgggctgacggtatctatgtcaccaaaagttccccttcaaaggctctcaaggctctggctgattgactctgattcacctgactccgtggacaggacaagggtggggcggagtgaaccttgtgggtggcagggggttgggacaggcagaggcagggccttcctggtggacatgggagaagcaaagatgggcaggacatttggcaatgcccacccatatctgttcccatcctagtggtcccaaggctcaaagaaactacagggcatctgctttcaaagctcccataccagcacaggtcaaaagggagcagatgcccagagagggaaacaggcacaaactcaccaactgtggagaagggtggctgaggagaagccttcacaaatgg

SEQ ID NO: 219547 - DNA, 602 bp, Homo sapiens
tagtgttgggattacaggcatgagccacctccacacccagcccccagaatatataaataattcctacaatttcataatacaaaggcaaatggctcaattttttaaatgggtgagtaatctgaatagatatttctataaagatgtacaaatgaccagtaagtgcatgaaaaaatgctcaaaatcgttagtcttcagggaaatgcacatcaaaatcacaatgaaatacaacttcacacttactaggatgactggaatcataaagtcagatgatgagttttggcaagtatgtggacaaagcagaatcctcagacactgatggtaagaatacaaaaatgatgcagactttttggaaaacaatcttgactgctcttcaaatgattaaacttagtttccatatggcccagcagttccactcccaggtatatacccaagaaaaataaaaacctatattcacacaaaaacatgttgatgacagtttatagcagcattattcataatggccaaaaggtggaatgtccatcagctgatgaatggacaaacaaaatgtggtgtatccatacaggggattccttttcagccatgaatgggattaatacatgctc

SEQ ID NO: 219548 - DNA, 330 bp, Homo sapiens
caccacacagtgagcactattctaaatactcggattgaaaaagtctctctgccttcaagaagttcaaaagagcaggtgattcacaaatgacttgcattgcattcacatatgggtaagaacagatgacatgggagaatcccactctctatatatctagaccttaactccatccacagcccacctaccttggaaagagggactcagctgggtgatgaatgaaggaaatgtttggccacacttggagcaatgtctttaggaataatacagagttgccaaaatacctgtcaatgattgtagaaacgtattgagtgggaagggagacaccgcgtt

SEQ ID NO: 219549 - DNA, 449 bp, Homo sapiens
cctgtggggttccctagaggaggcatgagctgactctgaagggcaaactgcagttggcctggcaactctggagaagagccacccagcataggagacggcagtgcagaggcacccagggcctgatgctgggagctcagagcagctgggggtgtgtatgcctgaagaatggtcgtagatgacactggagggtggattagatcaaggaaagccatttgcagtgcgggagagttagtgcctaccccagagtctggagccaccgtatgtgatcaggttcacattttggaaagatcactgtgggaacaatatagaaagaagatgatttaggatgaggttagatttgggatccagagatcagttaactgtccccacagttagccatattaaagtggttaaggaaattgactgccaatctttagtttctttatcaataaaatgaataattcctatga

SEQ ID NO: 219550 - DNA, 574 bp, Homo sapiens
ctagaattcagcggccgcttaattctagaactactatgcagccattgatggtatactgccctttaccttgcctagtcaccctcagcatgtctgactcgactctaagggacctcaagggtgaggtcccttaaagcaagagtttcatgatctccagtgtgttctgagactcctgcagtgcccagcgccctcctcagtgcacaggtgacagacccctacttccagatttcccaagaacccttcacatggccactgtcaggctggataaaagccagctacatctctctgctgggaggcgcacagtgcagtatggagttggcgtgacttgtggttttgcccacatcataaccaagtccctggcatagtggaattactaacaatgaagctgtatctcacatttgtgattttgtttgaaaggattctgctcatcagctcatccattttcatcaagtatctcagcgtgccccacgtgtgctaatgtaaagcgtacggattaaattctaataggatcagcaacatacccgcccagggacaaaaaaatctagcccgtgtggtcctaaggcacatgcattatgtt

SEQ ID NO: 219551 - DNA, 521 bp, Homo sapiens
tatattcttaattgaaagactttaatgaaatcacttctccccaaaattaatctttgtaactagtgcatccaaagtaaaacccagtaaggtttgatttagatattgacaagctaattctagaatttatgtaaactctaaaaatattaaaattcagttaataatttattgaggaaggaaaaatatattacaggaaatataagaattaatgcaatgtggtattaacaaagtaataaataatcaatgaaatggaataggtagactacagtaaggaaaatataagaacccatgatatgtaagaaagctagtattatagatcagtggtgaaaaataaatttgccaataaatgagagtgagaaaactggctatacatatggaaaataattaaagtgattctttaccttatataatatttaacaatcaattccttggcaatcaatatttaaatgtaaagccaggcaaaaattacagaaaacccgacagtaaaacaaagaaaatggcttgcacatgtgctttataaaatg

SEQ ID NO: 219552 - DNA, 569 bp, Homo sapiens
caggatggttgaaacagaaatgaccagcaaaactgggagacgaggctgagccacaggccccacagggtgagcccagggggccactctcctagcatctccctgcggcatttttggacaggataccagcacccgccatcttcacagcctggaccagggtggcagaccctctgtggctcccgctggcttcagaattaatgagccggctccctggatccagggcccaggctctgcccacttctccagctgctgaacaaacctcccttgcggttccctaaacgggctgagctacttccttgccacatgctgagcatttgtcgtgtattattagctcagctgggaacaccagggtgagcttgtgtgtgtagaaaatatttctttcagaaaacacataaaacctgaatgtattacctaataaattgttgtgaagccggtatccacagaatccactgaggccaagactaaggacattttcaggccgggcgcggtgtctcacgcctgtcatcccagcactttgggaggccaaggtgggcagatcacctgaggtcaggagttcaagaccagcctggaca

SEQ ID NO: 219553 - DNA, 402 bp, Homo sapiens
aaaaaaaaaagtgccctgctagaagagtgttttctatagtgagcattgagtgaaattttccccgtttagaggtaatattctgttttcaaacatttctctatatatgtgtttttcgtgtgtatttcaaagaaaatacttgaataatttgtcctgtcctgaggttttatttgtttattttgctttaagagttgatagcttttaggaaagcagggccttaggaggaaagtcgtcttttagactgtgtcctcaggatagattatatgagagaaaagcaacttaggatagagaaaaccctgggttgtgtaccttttgagctaaaataagtcataattcatgctatgtattagtcagcttttgctgtgtaacaaactataataaaatctcaggggcataaaacgatac

SEQ ID NO: 219554 - DNA, 417 bp, Homo sapiens
agtgctgggattacaggcatgagccaccacacccagtctaatttttaaaaattatttaagtcagaccagtggcgtgtacctgtagtcccagcaactccagaggcttaggtgagaagatcctttgcgccaaggactttgaggctgcagtgagctatgatctcaccactgcactccagcttgggtgacagagtgagatccatactgtgaaaaataataatacataaaaaattaaacagggcgcacagtggcccatgcctgtaatcccagctctttgggaggataaggaaggcagagtgcttgaactggggaggcataggttgcaatgagccgatacagtgccacttcacttcagcctgggtgacagagtgagaccctgtctcaagaaaaaaaaaaagtatttatattactttagtgtcg

SEQ ID NO: 219555 - DNA, 404 bp, Homo sapiens
agactggtctcgaactcctgaccttaggtaatccacccacctccgcctcccaaagtgctgggattacaggcttaagccaccatgcccagcagttttgtcattttaaaatgagtttgttggccagggacagtgcacacctgtaatcccagcgctttgagaagccaagacaagcagatcacttgaacataggagtttgaggaaagcctaggcaacatagtgaaaccctgtcactaccaaaaatacaaaaaattagctgggtggtgtgcacctgtagtcacagctacttgggaggctgaggagggaggatggcttgagactgggaggcagaggttgcagtgagcttgtgagctcagaccactgcactccagcctgggcgatggagccagaccctgtctcaaaaaaaa

SEQ ID NO: 219556 - DNA, 426 bp, Homo sapiens
cttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggagtcatctgaggccactgctatttcccaagagaagagccaggaggaagaaagaatggctgttgggcttcttaaagccatgtaccaggagttggtgaccttcagagatgtggctgtagacttctcccaagaggaatgggattgtctggattcttctcaaagacatctgtacagtaatgtgatgctagagaactacaggatcttggtatcactgggtaaggatatcttc

SEQ ID NO: 219557 - DNA, 801 bp, Homo sapiens
tgtctgctgtgggcccagcagctgcacagacccctcttgttgggagacaagacagggctctttctctcccgtgacctcagcctcatctccaatcgtggggaagagagaaactgaaattcttcctgtgactgaacacatgagaatgcaacagttacttggggtaacaggtttcctgtgggtcctgtgtgaagagtatgcattcattccagtgtcggggaggggagaagaatgaggaggaggcagtcccatgtggatgtcagtgtgatgattaggatgcctgatgcttccgaaacaagaatacactttacgaaaatgcccattgaaaatactttttcctttctactcttgtgctaagagtgcctgtttggaccccatggcttcgtaatgcaatggcttttacccttgtcccacggcccccctgcccaactcaagaaggtgatgaaataggctgcagaagttcccagccagggtattgtgaagatgaaagcaaagatatggcaagagctcagaagagtacctggcccatattgaagtgagcatggctcaagagctttcagaaatcttttaccacacgtgaagaagatgggagtatggccattaccatgtattagaaccggaggctccaactctggttggggatctctctgggtctaagatgcaggcgttggaatgggactcctgggtaaatggatggagtgacgtggggctttaattgcactggggagttggtattcattaagcagtcgtcccaaatatgggccccacaaatgggccggggcagattctcccacctccggggaa

SEQ ID NO: 219558 - DNA, 802 bp, Homo sapiens
tgtctgctgtgggcccagcagctgcacagacccctcttgttgggagacaagacagggctctttctctcccgtgacctcagcctcatctccaatcgtggggaagagagaaactgaaattcttcctgtgactgaacacatgagaatgcaacagttacttggggtaacaggtttcctgtgggtcctgtgtgaagagtatgcattcattccagtgtcggggaggggagaagaatgaggaggaggcagtcccatgtggatgtcagtgtgatgattaggatgcctgatgcttccgaaacaagaatacactttacgaaaatgcccattgaaaatactttttcctttctactcttgtgctaagagtgcctgtttggaccccatggcttcgtaatgtactcccagggaggaagaggctacagcactggcgcactcccagcaatggcttttacccttgtcccacggcccccctgcccaactcaagaaggtgatgaaataggctgcagaagttcccagccagggtattgtgaagatgaaagcaaagatatggcaagagctcagaagagtacctggcccataagaaaatgccagtgttggagaaaatgggagaggaagctggaaaagcctgggggagttatcatcagtgatacatgtctgaccccaggccttctctagaagaatggcaaaaggaagttctttaaacagaaaggaaataataaaatatggaccttcgaatgttaggaagaaagagaaaatatgagaaatgtttatttataaaatgtgtgcaatgagcaaaaatatggttaaagac

SEQ ID NO: 219559 - DNA, 527 bp, Homo sapiens
aggctgtaggtcaagatcaaggtatattacattataaaccgggtgagagtgagctccttgtcttgcatctttctcttcccttctgagtagggtgcctagtatgcagcaggtgctcaataaatactgagtgtaggtctaagagtgagaagttgattggtctgcattcgaatcccctccatgcctgatcttggggcaccccaaatgagaggtcttccctgtctgggggcttccttaggtcatttcatctggcatctactcgctttgggtggttaaactcttacaatgcagcaaactgctactgtgcccaacttgtttactgcagagcagcctggaaagacttgagtgaggtttgagctgcacagttctaagagttatttcttcactcagaaaatatttcctgagtgctgtctctgttcttgtgattgtgtcagacgtggtatgcgggagggtcacatgagcaaatgtgagtcaatgtccctgtcctcaaggtactaacagtttagtttgggagacaacacactacacaa

SEQ ID NO: 219560 - DNA, 263 bp, Homo sapiens
ttttttttttcactgtaaaagatcaatattctttctagtcaaattccagaaataaaaagaagccaaagaatgagttcagtgagatcctggattttccctttctctactttttctgcagaaagtacgtttttgctctactagttgttattagaaagaatatattatgtaaagtgatggaaactacaattgatttataagagtttttgttatttctgataatttattatgcccctgagagtacaaaactacttaaaaatgctttt

SEQ ID NO: 219561 - DNA, 514 bp, Homo sapiens
aataaatctgtatcacaacctggataaatgaattttatacaaaaactcctcaaagatgtgaagtgtgtggcagcctcctgttttgaagcgatttgaatatctgaagtatcttcagttgatcacaatttagtatttccaatttaatcactatgatgttccgctacctggactttgcaggtaaaggggcccaagcttgattctcagattaatcatctgaaaaaacagttaattctcggtcgggcgcggtggctcaaacctgtaatcccagcactttaggaggctgaggtgggcagatcacaaggtgagaagttcaagaccagcctgaccaacatggtgaaaccccacctctactaaaaatacaaaaatagccagacgtggttgcacacgcctgtaatcccagctactcaggaggctgaggcaggagaactgcttgaaccctggaggtggaggttgcagtgggctgagatcgcgccactgtactccagcctgggcgacagagcgagactccatctca

SEQ ID NO: 219562 - DNA, 669 bp, Homo sapiens
cacaaatatgaagtttttttgtattaaaatacaggttaacgaagagatctaaccagatagttgcttaaacaagaaagatcttcatttttgtcttttagtgtcagtttcagtatacacaatccaaatttgatgtggtggctgcgttgaagtcaggaaatcagactcgctctactatctcaaaggagagcatatctcgtcctttgaaggaagtttcacacattaattttattcattccattggtgaaaacttgtcactggccatacctagatgcaaacagcacttggaagcataatctttagctgaaggccgtgtgcccaactaagacttacattactaaataacaagcaggtgtcttagtcaactcggactgccataaccaaacaccgtatacaatatcacttaaacaatgaatatttatgtctgcagttttggaggctgggaaatacaagatcagtgttccagtagatttggttcctggtgagaactcttttcctggcttgcagatagccacctttttgttgtattctcacatggcagagagggagagttttggtttctcttcctcttcttgtaaggacactaataatcatgggggctccaccctcatgactttatcaaaacctagttacctctcaaaggctgcacctccaaatgccatcacattggct

SEQ ID NO: 219563 - DNA, 475 bp, Homo sapiens
cagggcaggagagcagaaaccatgttacctaccatgaattaggaaagggaaattgtgaaaaaggctctgctctggagactggagaaaaggattctataaacttagttgggtagggaaggagctagaatcccagtaatgaaactgtatgcttatggaagtatgtggagtgatggagaaacaaatgctgtaattattcatcattcatcactacatttgaaattatctgaggaaaaaggaggaaataacatggataacatgtttttctctctctcatacatacacacacacacacacaattgtaatggttattgacttcacaatccaacttcatcttctatatgtttaatatgttttatccacctggataccttaacagaaaactaattctggatatggaactatagagtcaataagaaagacatttttaacatgctgggatgaatgaagttctaataaactactataatcacaccta

SEQ ID NO: 219564 - DNA, 499 bp, Homo sapiens
ttagctgccgaagatgttttgaatgtgctctgacatcttgtttcataagaggatctcatccgggaaaagtgtttaaaatagatttctgtataaacctgtattttaaatatacttgaagtaaattgcaggacattatgttaatgcattaacgttaccttcgggtatctgagatacacataactgcccttgacttacccactgtaaatattgggagttttaaaagatcattaggttttcgtcaaatggagtacacctaaaaagtctacaaaaacggaagaaagtaattgatagaaggttctccaactgtggccaactcaagtcccagtgtgctagtgagagagcagttgggcttccctgtccccacagctgcctgtgaatttcggcccttgaagcagggagagggggagcccgaggccgtctccactgtgaatgtggcccatggagatgtctcgctcttgaggagaaaaagtcacagccaggcagcaggaggggtgaacat

SEQ ID NO: 219565 - DNA, 146 bp, Homo sapiens
gcctaggaaaatagctacccggaatctaattttagtaatgtttttgtttcaggaaaaatcgtcttatctaattttacgtaataggggttcagcgcagtagagtagttgatatcatggtttttccagccagacaacctgggttcaga

SEQ ID NO: 219566 - DNA, 303 bp, Homo sapiens
tggggacctctgacttacttaaagcaatttaaaaactcaccagagctcactatttaaagggacccaacagcaaatcctctaataaggtaacaggagtccctgcttccccgcgttggtctcaactttgtcttctgcattgtagctggtctctaacgtgtaggagccagaacggagaggtctttccttagggcacctgtagagtccctcctgaatcaaggcttccatgtggacctttatttttattttatttttttgagacggagtttcgctcttgttgcccaggctggagtgcaatggcgcaat

SEQ ID NO: 219567 - DNA, 178 bp, Homo sapiens
agagtatacttcagaaataatttagtcagtaggtttatgtctaccaatatatatcctatgagttaatataagcagttcacactaacaactgtaggtgatgtatccttcttttagttgctgatactgtgagagaataaggcattttatttaattaaagaatgagctaaaatagcaatgt

SEQ ID NO: 219568 - DNA, 444 bp, Homo sapiens
aaaatattttagattgtggatagattttgttaactgtcttgttaacaaaaagattaaactaaaagtttttttcttttactacatataaaatggagaaaagaaggtatgcctacatttgaaccaaaatattgtagaagagagcaattgcagcttgagaaaatctagattcaagatgtttgagatgacatgctgcagaggagggcacgcaggacagagatctacagccagacagcagagagccagctaagaatgcaactgtgagccaggacacgtttgtggaacatgttaacacttcctggggatgtctatagtcattgttaaagaagactgtgataatttactaaatactcaagcaatgataaggagcttcaggcttttataattgggcattaaaaaggattgtggcgatgagatgataaccttgaagaattttgtattatattt

SEQ ID NO: 219569 - DNA, 760 bp, Homo sapiens
tagccgggcgtggtggtgcacgcctgtaatcccaactactcgggaggctaagacaagagaatcacttgaacccgggaggcagaggttgcagtgattccgagatcacaccactgcactccagcctgggtgacagagtgagacaccatctcaatatatatatatatatgtaaataaataaataaagttttacatcactttttttcttgatcaaagcaatgctaggtaattaaggacattgttggcaataacagaaatgtgtctatgaaaaggttcttaagaaggtgactgtaacctcacattctcctttcattttctcccccatctctgcttctctctagggtgaacacagttggtctgggtgggattggggttgtgctgtgtggggcagaggctgttggggattcgtgatgggaattcctaatagtgacccttgggtcccaggaacaggagacacgggccagtcaaaggcatgggaagaagctaggagaagttaggattcgagttaaatccagtgccaacagggtgaccagttgtctaggtttagccaggactgagggctccctgggatgtgagattttcaatgtccacactcagaaagttctgggcaaatggggacaagttggacacagaagcagaaaaaaaatcaaggagggtctgcagtggaaacgggcattgttcactctgcagaatctgtattcttgctgtcaacaatgccccgaacttcctctggaatctgctcctcacccttgagtggctctca

SEQ ID NO: 219570 - DNA, 493 bp, Homo sapiens
gtagttatatgagaaagagaagacagggtggacattaggaaccttggtcactcacagcaagttgtcggactttatcttgagataaaaatagggttgcagaaggacccatttgtaaatttgatagtcacctgctgacaaaggcctttgccaggcattcctgcagtggaggtgggctttgcagagggggctcactgaggacctgctatgtgccaggcactaggctgggtgcttcacttgcctcattcctcaccacaggcctgcacagtgggacccatgttcctccttagacacaggaggcttaaagatgtgcagggacttgcccaaggcagagcattcgaatccacatctgtgtgattgcaaagcccatgttttctttccacagctctggccatgtcagcacacaccatgaatgctacagctgctgcacagacacctcactttgcctcctgtgtactgtgtcataaacaaatgaataaactgaatttgtacttta

SEQ ID NO: 219571 - DNA, 788 bp, Homo sapiens
tctttttaaaaacaaatcagcccacagatatttattgaaaacctatgggagaagcattgtcctaagtatatatggagcttacattctaatagagggaactaaaaaatacataaggtcaaaaggtaataatttaagtgactcaaaatgagctgggagctttattcagctgatgtgcactgggagcacctgaagactgggtaactctccaagttaaagcaggggtgggattttatagggtgaggagaagatgggggtacctgtccttggagattggttcagttagtaattttcctcattggctgctgtaaaacttgctggtggtgaggtaggagattgtttttgttgttagtcctctgctcatgattactgggccaataccactgcaatgactgtcagaacaattcttgtgaaagttgtttttataagccttgtagtttgttgaagttgaggttcaagggcagaagtagggagaaaaagaataaagggaattaaaaaaggaagaaaggcaatattaaaggcaattttgtttgtttaacacaatctattcaaataaaatatctaatgatttgtaaattgagttaacaaagtaatttcagggaaacatggaagagagtctttagggaggtatctttcaggaggcgatattcaagttgaaacctgactgttgagaaggagaaagccatgtgacgatatgggagatttagcagctgcaaatgctctgaagcaggaataagctcagcatgttcaaggagaagaaggaacaagagaaagagacatgtgagacaaag

SEQ ID NO: 219572 - DNA, 285 bp, Homo sapiens
gataacaaaaacatgtctacttaaagaactatatataaatgctcataatagttttaccagtaatagtcaaaaacaggaaacagtaacagtcaaaaacagaaaacaactcaactgtttattaacaggtgagtgaaaaaacaaaatgtgatacatttatagaatagaatattacttatcattcaaaggaactgctgatatatgcaacattgtgaatgaatcacaaaatcataatgctgaatgaaaaaagctagacacaaataaaaaacacacaaaagtaatttacag

SEQ ID NO: 219573 - DNA, 488 bp, Homo sapiens
agtagggaccccaggaggccactgtagtgttggatattcctggatcagagtttctcaaatcattctccacaggtaatgtctattctccaagagagttttccttggcctgtggccaggctgctcaaatagaatgcagaaacaaagaatttgcctgaattctgctagccactctccaaggtcttctcctgcgatgggtggagggactttcagggcaaccctgttctaagtaggaggtgaaggtgatatccagacaaatccttcctgggtatttgctcgggggaacttgggactttttggcagtattgtctatggctctggctcattaattcagccctcgtgttcccgtatctgcaagggcataactgcagtcccctcagttctctgggtaatgtgactctcactgcaaacctcaacatggaaagctcttgctaaggtgggaaggtctcagtcctccaaaggaaacgaagttgtggcagcctttttactag

SEQ ID NO: 219574 - DNA, 497 bp, Homo sapiens
gtcagggaacagtggctcatgccagcactttgggaggccaaggtagtaagatcacttgaacccaggagttcaaggccagcctgggcagcagggtaagaccctgtctctacagaataattttaaaattagctggtggcatgcgcctgtggtcccacctcctcgggaggctgaggtgggaggatcccttgagcccgggaggtagaggctgcagcgagctgagatcacaccctgcactccagcctggcagacagagggcgatcctgtctcaaaaaaaaagatttaacagacaccacctactgtccccagcatcttacagaacaaaagatcggcggggcacagtggctcatacctgtaatcccagcactttgggaggcctaagcaggctggtcgcttgagcccaagagttcgagaccagcctgggcaatacagcgagaccccatctcaatttatattatttaaaaaataattaatgtaagagaaattaaaacagattttta

SEQ ID NO: 219575 - DNA, 387 bp, Homo sapiens
tatgtttaacattatttatttatttttaattttttttgtagagatggcatcttactgtgttgcccaggctggtcatgaactcctgggctcaagcagtcctcctgcttcagcctcccaaagtgttcggattataggcgtgagccaccatgcccagcccaaatttaaatatataactaaacacatagcagctaacaccaagcctttaaaaatatcattaataggccaggcgcagtggctcatgcctgtaatcccagcactttgggaggccgaggcgggcagatcacctgaggtcgcgagttcgagaccagcctgaccaacatggagaaaccctgtctctactaaaaatacaaaattagccgggcatggtggcacatgcctgtaatccca

SEQ ID NO: 219576 - DNA, 476 bp, Homo sapiens
gaactgaagtcagaaccatttagtcatttatcacacaaaccattccatgtaaaattgaaccttgtcagctaaacacttacttggtttactagttgctgattacacagcagtttaattgcagcacacacacataactagactgtgtattgaagacattgcttttgctgtatcccatatttttcttcactttgcctaaaataaagcctattatttatagtaatagtctaaaactttcaataaattgataagtaaactaattatcaagtatttctatgtcggctttctgatgcctacagttttgttaagaacaaacagctataaattcctagccaaaaattcccactggtctaaaatttgtatatggcctactaaatacttctcataaattatgtcatgacagcatgttatttctacttactgaacatattactgtactcacactaacgtataattttctttctttaaaagatgagaaa

SEQ ID NO: 219577 - DNA, 328 bp, Homo sapiens
cgaccatggcttcctgtgcaagcttatctgcctccatggcttctgatactgtctaaagactaatattctgaaatgtctgtctacatcccaagcccagttacagaatagtgtatcagtctgtgcttgctgagcatctttgcctggatgacacagaggcccctcaagcctctcattgtcccaaactgaatccatcttttccctcaaacccattcttcttgcattccctttctatgtaaaggctccacaatcacctagttcagtagaaatgtaggcttttgtcttcctaactacttcccgtctttctccctcttgtccagtctgtcgacgc

SEQ ID NO: 219578 - DNA, 526 bp, Homo sapiens
agaccccatatctacacaaattttaaaaaataataaattagctgagtatggtgacgggtgcctctagtcccagctactcagtgggctgaggcgggaagatcacttcagcccagtagttcaaggctgcagtgagctgtgatttcacctctgcactccagcctgagcgacagagccagagccaggaccctgtcttcacaaaagaaaaaaaaaaagaaaagaattttcattttaggggaaaaaattgacttgggtgaatgtgggtaaagataaaaggggacattgtgttttagactttaggaagacttttctgaaataaaggagaaagtgttattgtaaacatacgctgaagctgttctgtcttgtcagtttcctaaatgacattggatcaggaattatttttctgtatatacatatatttttaagtataaattgtatatttatgttgtacaacatgatgttttcgtatatgtatacgttgtggattggctaaatcaaggtgtttatacattacctcacatacttgtca

SEQ ID NO: 219579 - DNA, 182 bp, Homo sapiens
tttcgagttctttcttattctccagggttcctatcactgtgatgtgtacataaggggcagctctgaacttttattttacaaacaaacttcctgacatgggccggtttggattcttaactggggctcctatcatggatggaactgagtttgggatggtaagtgctgtatgcctcccagcttcg

SEQ ID NO: 219580 - DNA, 461 bp, Homo sapiens
ttcataggaagtagttgattgagccaggtgtagtggcttgcagctgtaatcccagtgtggatgagggggaaggatggcttgagtccaggagttggaggctgcagggagccatgatcaagccactgcactccagcctgggtgacattgtgagactctgactcttagaaataaaaaagctgaccaggctcagtggctcatggctgtaatcacagggcttcgggaggccaaggcaggtagatcacttgaggtcgggagttcgagaccagcctggccaacatgatgaaaccccatctctactaaaaacacaaaaaattagccggccatggtgggagctgcctgtaatcccagctacttgggaggctgaggcagaagaactgcttgaaccccagaggcaggggttgcagtgagccaagatcatgccatttcactccagcctgggcaacagagtgagactccatgtc

SEQ ID NO: 219581 - DNA, 405 bp, Homo sapiens
tccctctgttgtttaatttacttacccatttttatctctattcctctcatatttatttcccttcttttaaaaaagtatctttataaaatatcgttgtttttcctacacgttttttatttataaaaatccaattgtcccatttttctctttttttaaaaagatccagctgtgatgttttatgtatattaaatccattacttttaactgtttgatcatttctttgacatattactaaatattggaattgctggtttgttggctatatatacacttgatttgactaagtactgcacattgctttccagaatgactgctctggtctacgttcccatttgcagtatgtgatcccatattgctgctaacacttggcattatctagcattctacttcttgctagtctgataa

SEQ ID NO: 219582 - DNA, 402 bp, Homo sapiens
ccaaaacttcattaatctaccaaacctccttttcctcagaacaccttttcacatcctgagaatctagcattagaaacagtctgggtgctgggcccatccctgccacaaatgagaaccaattcctgggaatgatcatgaaaccttccatgcacaagcctaagagagagagagagaaagaagtgagcctttagagctttacacaggaaaggacctgaccagatacctagatcataaatccaagcaaggggcacggcgatccagaacatagctgtggaggtgggctgctccgagtggcctttgctgaagtacacaccttgcagagcctgctccctcattggttgaataggatccatgatgtctgtcctatctccgttacaggattatttggggcaggtcattgag

SEQ ID NO: 219583 - DNA, 227 bp, Homo sapiens
ggttctgcgtgtggcaggtgtgctggactctacggggcgtggctgggtggagctgtgtgattctggggtcctgcgtgtggcaggtgtgctggactcttcggggcgtggctgggtggagctgtgtgattctggggtcctgcgtgtggcaggtgtgctggactcttcggggcgtggctgggtggagctgtgtgattctggggtcctgcgtgtggcaggtgtgctggact

SEQ ID NO: 219584 - DNA, 435 bp, Homo sapiens
ccctgtgttgcccaggctggtcttgaactcccgtgctcaagcaatctgctcaccttggcttcccaaagtgctgggattacaggtgtgagcgactgtacctggccaactgtatgtcttttgattagagagtttagttgatttacaatcagtgttattattggtaggtaagcactactcctaccattttatttgtcttctggttgttttttggtcttctcttccttctttccttctttcctgtcttccttttagtgaagatgattttctccaatgttacgctttaatttctttttattttttgggtgtccattgtacgttggacatgcacacaatggacacacataaaacacaacaattagtattcggcttgcaaatactatctcgtaacccattattttaaatggatgacaacactgattgcagaaataaacaagc

SEQ ID NO: 219585 - DNA, 674 bp, Homo sapiens
ggattaaagcctgagatactgttggatctaagcactgcatatgtacattttgagattttttttctccagtcattattgaaggaaaaaatttagtctctatttttccattgcaaatgttctagaaaaaaactacttataaatgttaggtatattttagcagtgctgtataataaagacatattactgctgctggagaacttacatttattggttaatacttaaagggtatttttccataaataaattactgcaatcaccattaatgagtatttcctccaaatgattcttttttccccaagatagaaactagctctggaagtatagtaatacacattggtcatataagtttcatttctgtttccattccttgccaaaatctcctttgccaatggccctggctcttcttttgtaaaaataaccctgtagactccatttaattgtcacattggcctaaagccatcaagggcagttagcctcataccaagctgcagccatctgtcagaatatgctaaaaatcaatgaagatggttacttgcactctcctgccccggcatgattcctccacacaattctgatttgtctttgtgaactgaagtggtcatgttaatcccaacaccaggttttctctagtgttgataatcacagcaaaacctttgagtaagattcattttggt

SEQ ID NO: 219586 - DNA, 408 bp, Homo sapiens
gcccctcatctcgctagtcatgtcacagcagcaggaggaggagagccggtcgggtgatgggctggggtgggggcagggaggtgagagcagggaaggcaggagggtggaggcgatgatgaacttattgtgagttataccaggagaagtctctccggaacacccctgaggaaatgttccacagttattcagaaagatgagtctggggttctggaaaaggaattggagtggagggagatgggatcgaggtggtgagcctgaatctagccattcaacagatatttgaatcactaccacagaaaaagcatgagacccgggagagaacacaaaaatgaccaagactggcctgtcatggtggcttaggtctgtaatcatagcactttgggaggccaaggtgggcagatcacttga

SEQ ID NO: 219587 - DNA, 462 bp, Homo sapiens
agataaggttacattgtatttgcatttccatattatacatatatattatacatgtatgtattgtatatgtatatatgttaaaggaaggcaggaacttcctcaactacctacagaactcagcgttcaagttaactcattcctcaggaattctgaatagccaagatcttttatgaccgagaagaaatacgccaaggacacgcctgtaatcccagcactttgggaggccgagataggcagatcgcctgaggtcaggagttcaagaccagcctggccaacatggcgaaaccctgtctctactaaaaatataaaaattagccaggcgtggtggtgggtgcctgtaatcccagctactcaggaggctgaggtaggagaatcgcttgaacctgggaggcggaggttgcagtgaactgagatcgcgccattgcactctcgcctgggcaacaggagcgaaactccatctca

SEQ ID NO: 219588 - DNA, 601 bp, Homo sapiens
atatccaacagtctcagaataataccaaagctactactaacaatgtgagactgaaaacaggcagccctttttaaaaatcagagtaaaaaattctgaaaatgaaagtggaaaggaaccccacaggaagggtctgtgctgaccccatgtgacagtgtggccgtttgcattactgctggaattttgaagactactacatattccgtcagtgtcaggattttgttcttcagtgtggtacttttttttttttttttttaagatggagtctcactctgtcgcctgggttggagtgcagtggtgtgatcttggctcactgcaacctccagctcccgggttcaagcgattctcctgcctcagcctcctgagtagctgggattacaggcatgcgccaccacacctggcttatttttgtatttttagtagagacggggtttcactatgttggtcaggctgttcttgaactcctgacctcgtgatccgcccacctcagcctcccaaagtgttgggattacaggcgtgagccaccgcacccggtagtgtggtacactcttaaaatcatagttcctgctgtctgggagtttacatatgtctacagagtggaaga

SEQ ID NO: 219589 - DNA, 759 bp, Homo sapiens
cctcttaaatactaatctgttcacctgtatgtgtctctgaagttttccctgttctttagagatatgagaaaaataaagaccctgtagaaagtggctccataaagctataaagctggtcactaatttattccatgtaaggactgtattttattctgagattgtgtccttcttactttttaacgttaaaattttcttctgaaatgatggtgatagtgtatggtagtgttattttactattattactttgcaaagaagaatatagcagcagccccacattggtcttcacatttgtcggggcgggggcaggaactcttggcttcagagaacaatcacctcaaaaatttacttctacttaacctgttgaggaacaacgtaaattgtccaaatgggaaatagtaaaaatatttgagtctgacctagagcaatgaatggagaagagaaaggctttagataatctcttcaatctaggggattgagggcagaggaaaattatctaagagaggatttggtggacggaagccagcagaaactgttttgctagaaaaccacagaaaaaattgtggtaagtgctgaaggtatgggaatgaatctctcaatccaaaggtttctaactttattaattaaaaaatattttcattaggaggcaatatacttattatttagagctatgtaagaaactatattaatatattgagaattacatgatatccagagaggacaaggagtagacagaagatgatgagagaaagtaatgaaaag

SEQ ID NO: 219590 - DNA, 339 bp, Homo sapiens
gaagttcttagttaagaattcttactagattgtctttccaactctatggttgggttaaaataaagaagccataggcttcagaaactagatatatttgagttccaaatctgtgtctattacatgttaggtatgtgaacttggggaaaacattaagtttgttgattctcagtttcctcttctttaaaatttgcagatattatcagtatcatatgtttatgaggagaattagatgacataacatatgcaaagtttttgtctctagtgggtacttaatcaatggtatttttcttcctttttccattctatgactctagaatggaaaaagttcattctagaacc

SEQ ID NO: 219591 - DNA, 512 bp, Homo sapiens
aaatgaggtgatacatgccaagtacttagaacactgtctgctacagggtaagtactcaataaatatcaactaatattattattaataatagcaagagtattataaaaaacactagcttcccttatcaatgacaatcattattaatattttcttatgtattactccggaaatgttatatgcatacataaatatatgtatgatatacttatggtttttgaagagcaaatggcagcaaattacgcatgttttacctttttcattcaacaatatgcttagagacctctgcctaacagctcatgcagctctaacgtattattttaatggctttattgtcatggcaataccatgatttattgactagtttcataatttttggccagccctgcccccaccattgataaatatttccagttaatttgccattcaatgaagtttgttgctgaatgagtgtgctcatcacagatagttctgtcttcctcggtagaagggagcctcaacttactctttaaacc

SEQ ID NO: 219592 - DNA, 385 bp, Homo sapiens
aaatactgcatgtttacacttatatgtggaatctaaaaattttgaacggatagaagcagtgagtagaatggtgggcgtgggagtttgggggatctggggagctgttggtcaaaggatacaaaggtttagtttgacaggaggagaaaattttcgagagacttgttgaataacatggtgactccagttgacccacaaacaatatgggtttgaattgtgtgggtccacatacaggcagattttcttctgcctctgacaccccgagaaagcaaaaactcctcttcctcttcctcctcctcagcctactcaatgtgatgacctttatgatgatccatttccatttaatgagtagtaaataaattttctcttctttctaattttgttatta

SEQ ID NO: 219593 - DNA, 744 bp, Homo sapiens
  misc_feature (738)..(738): n is a, c, g, or t
agtgaaggccgggtgcggtggctcacgcctataattacagcactttggaaggccgaggagggcggatcaccaggtcaagagattgaaaccatcctggctaacactgtgaaaccccgtctctactaaaaatacaaaaaattagccgggtgtggtggcgggcgcctgtagtcccagctactcgggagactggggcaggagaatggcgtgaacccgggaggcggagcttgcagtgagccgagaccgcgccactgcactccagcctgggtgatagagcaaggagactctgtctcaaaaaacaacaacaacaacaaaaattaatgataataccaaatgttggcaaggatgcagatcaactgcatccagtggaatgcaaacttgtacagatactgtagaaaatatctggaggccgggcgcagtggctcagcctgtaattccaacactttgggaggcagaggtgggtggatcatgaggtcaagagatcgagaccatcctggccaacatggtgaaaccccgtctctactaaaaatacaaaaattagctgggcatggtggtgcgcacctgtagtgccagctaccagggaggctgaggcaggagaatcgcttgaaccagggaggcagaggttgcagtgagccaagacggtaccactgcactccagcctggtgacagagcaagactctgtctcaaaaaaacaccctacacatggcgccggaattcgagcttactggcccttcggcctgngagggg

SEQ ID NO: 219594 - DNA, 588 bp, Homo sapiens
ctctgcctttggtcattcctagtatcttcagatcattgctttaaataattttatacagttttataattattatttgtgggaaaatcactcaattttatcatgctgctattattggaatactcacccttgatacgagcattttttttttggctgggtaatacataataccctagtgcttttcatattaacaaagagtagcacaagagctccttttagaaggttttactaaccttcaggccaagtaagttatctctcctttgagcttcctaggtaccctgtgcataatttcttcaaagcccatattctgtattcatgtctgtgtcccaggatgagcacagagccttgcatattataatcattgaataaatatttatggaaggaaggagaaaagaaggaaggaagaaagaaggattagagggaaaacagtaaggagatagattatgtccactttgatgtggacatggtaggaactgtaggaaagaaagacgggcaataaaacaaggaggaggtgggggctgcctaagagatcacagttcttattgtaacttgctttctattcatcctgccctccctttcataccctagatt

SEQ ID NO: 219595 - DNA, 603 bp, Homo sapiens
gtttcaacatttcaacatttctgaacatctgaagtcccagctacttaggaggctgaggtgggagtattgcttgagtccaggagttcggggccatagtatgcgatgctgattgggtgtccacactaagtttggcatcaatatggtgacttcccaggagttggggactaccaggtggcctaaggaggggtgaatcagcccaggtcggaaatgaagcagaccaaaaactactgtgctggtcactagtgggatcacgcctgtaagtagtgggcaatatagagacctgggcaacatagagagaccctgtatgaaaaaaaaaaaagaatatataaaaaccaaacatataatctgcctccatcgctacccattaatctgttatgcctctgtctgtatgcctcatctccatgaatggtaccactaattgcctagttacccagagaggtcacaaaacacagatttacaaaaatctttccctcctcctcaccatgcacaatcaatcattaaaatacctcagagctttgagatattttacagatttgagatattttactgattgattaaatatgggtggtaaggaagagatattgattgaatattttagtgatt

SEQ ID NO: 219596 - DNA, 220 bp, Homo sapiens
cacatctgcctgtcttcttctgagcctccaaactgttccaacgtctgcctattacccagttcaaaagtcacttccacattttcaaattatctttgtagcagtacccccatctgccaattatctgtattagtccattttcacacttctacaaaggtactacctgagcgccactgcacttcagcctcagccaggggaacagagcaagactccgtctcaaaaa

SEQ ID NO: 219597 - DNA, 419 bp, Homo sapiens
gatgggacccctacaaaaataccacttgttgaaatattgagttagatatggaagggggcagtatggcataatgacttaaggtccagtttctgtatacaagtcttagctccatcacttcttggctattttaccttcagtgagctacctgactttagttgagcctcagttttcccatctgtaaattgggtatatatttcataggattgtttgataaaatgtaagataaaatgaaataactttgtaaaatgcttattacattgtctggcacatggtatttcctcaataaatagttgacttttattatgatggcctgtgctttgacctgtttataagtttttgctgattcattagatacattcttgcctccttcccttgtaatagtagaatgtatctcagtacaaaagctgaatggagtaaat

SEQ ID NO: 219598 - DNA, 370 bp, Homo sapiens
ggtcgaccccaggacgcagaggttgctgggactacaggcatgtgccaccacacctggctaatttttgtatttttattagagacggggtttcgccatgatggccagactggtcttgaactcctgacctcaagtgatcctcctgcctcggctttcaaagtgctgggattacaggcatgaagcactctgcccggctcactatctttaaaattgaaatatattcttttaattattttaacacagaagaacaataacataatgagtattactgaccattacatgattattactgaaaatcattttgttgccatggcagagggtgatgtaaaaaaactatccattctgggtgtcaaaggcactaagaagtctcgaa

SEQ ID NO: 219599 - DNA, 769 bp, Homo sapiens
aggacgtgtgggctgcgtaggctggaccgcacaggctgagccatagagaggagccatgtgtttacccagcctgagcagagcaggggtttggccttggctctgggtggaagggaattggggatgcagaggtaatctggaggaccttaatggctaggctgagtgggaggtttgaatttaggcattgtacactgtcagaaattagagctggaagtttgttttttttccccaagggaataaccctgccaggcttttctagtgggactaatgcagatgggtgctgattgtcaggtgtgggttatttattattcagcagaggttgcctggccttttgttctctctccacttccttcgggtaccagccaccttttcttcatcccctctgccctggagggtcagcagggcaagggacataagtaaaagctccagctgttgtggtttttcttttggttcttttgtttgtttatttacttattttttagagacagtggagtgcagtggtgcaatcatagctcactgcagcctcaaactcctgggctcaagccatcctcctgcctcagcctccttagtagctaagattacaggcgcatgccaccctgcatggctaatttaggtggttttaattgtgttatttaagaggaagtggcagagtcatttgaaattaatggttgagaagaggtttttaagtgaagggcagattttatctgtgtatcatttcagggtacctttattgcaaaatgacagaaacttagctcagatcatcttaggtaga

SEQ ID NO: 219600 - DNA, 461 bp, Homo sapiens
ttttgttttaaattctactttttaaaaaacatttattagcttgttccttttctacttcacccctcttccttcctccaaccccaaatagcctaagacaatggagtcatatagcccaacacttggtctatatacagcagtccactttctaggcaaatgcagttttaaaactgtgccataggccaggcactggtggttcatgcctataatcccaccactttgggaggccgaggcaggcggatcacaagatcaagatactgagactatcctggccaacatggtgaaatctcgtctctactaaaaatacaaaaattagctggacgtggtggcatgtgcctgtagtcccagctactcaggaggctgaggcaggagagtcgcttgaactcacgaggtggaggttgcagtgatctgtcacgccactgtactccagcctgacggcagagcgagactcccatctcaaaaaa

SEQ ID NO: 219601 - DNA, 327 bp, Homo sapiens
tgtctcccaacagtgaactactattccacagtctacccataaccaaagtggggtcattaaactttattttcctgtccaaaagtaatgaagtctctctggcatttccattaaatgtaagaatcagaactggtgtcatctcatcaggctcatcttcctccaaccaagatgttctaacccaaactgaaaatcttgaaatatctgtttaagaatctttaatggcttcctattgattaagaaataaatctaaacgcctcaaccaggcatttcgaaggcttccaaaatctgggaccattatgcatacgaaattgtatcatttaccattcttat

SEQ ID NO: 219602 - DNA, 795 bp, Homo sapiens
acccagtcaatggtattctgttatagcagcccgaactgactatgacactactctattaagaaatgctgaaatgggttttcagaaattgtggtatataaagttggtatctaccctatgacagagccatttcacatgtaggtccttagtccacagaaataagtataaatcctgatagggagcgatttgtaattgtcccatactggaaacaactcaaacatccatcatcagaatgaataatttggggcatatttatacaacagtttataaaacaatgaaaatgagcaaactactgttacacgccacatgggtaaatcttacaatcataatgttgagcagaagaagctcgacagaaaagaaagtatactgactgattccatttacatagagcttgaaaaaagaaaaagcccaaacagtcaaaactatcatgttagatatttggagaagagagcagcggtagtgattaggaaaggccaggagagggcttctattttttgacatgggtggtagtttcaggatatgctcacttgatgataattcatccagcagtacgcttataatttatttgtttttctgtaggtatatacaggttgagcatccctaatccgaaaattcaaaatgctccaaaatctgaaacgttgtgggtgctaacgtggtgccacaagtggaaaattcggcacctgaactcatgatagcatgagtgacagtcaaaacccaataaaaactttgatttgtgcacaaattatataaaattaccttcaggctctgtgtacaaggtgtatatgaaacataaataaa

SEQ ID NO: 219603 - DNA, 638 bp, Homo sapiens
gaggggggagggatagctttaggagatatacctaatgctaaatgacgagttaatgggtgcagcacaccagcatggcacatgtattcatatgtaactaacctgcacattgtgcacatgtaccctaaaacttaaagtataataataataaaataaaataatatatatatagtgctacactcatagtggatggtcattaagcgatagatagttgttcaaccatccaatcctttctttgcagcccaagaaatagctaggcactgtcttcatgtcttgaagcaggattctcataaaggatgcttcagtctcacatggcatggaaaattctaactagttatgtataaacactaattttgggtgttttgaatcctgaatctgtcacatttttgtgtgtgaccctcccgccaaccttggacaaattacttggcacctctgagcctccatttttgcacctataataactcaattcctgctgtggttatgattatgctgctatttctggtaactactccaccttctttttcatttcagatcaccaaccacttctccacatgatccctttgctgtgtctagagttaggtatttctcatccttagccattggctggtaaagtaccagacaaatgttattcagtaaatact

SEQ ID NO: 219604 - DNA, 217 bp, Homo sapiens
taacggtgacctgagtgtagtgaccagagtttgcaaaaggcacttgtgtgttgtctttaagacccaaagttactgtgctgccccactccaagaagggcataaatgttgagtctcccaaaggcaggaatctttgttttgttgactgatacatcccaagcacccagaacaatgcctggaacatagtaggtactcaataaatacttttagaatggatgaa

SEQ ID NO: 219605 - DNA, 420 bp, Homo sapiens
gaatgagggtgatgtgcataagagattgtgcagctgaacagaaggaacaccgagtcggctgcaacttcagggaccctgccttggttcagcccagggacctcggcccagtcactaacctcctgatgcctgcatgtggcagcagctggaccatagtatttgtgtttgctctctctctctcttttttttttgagacagagctttactttgtcgcccaggctggagtatagtggcacaatctcagctcacttgcaacctccgcctcctggttcaagtgattctcctgtctcagcctcccaagtagctgggaatacaggtgcatgccactatgcccggctaatttttgtgtttttagtggagatgggatttcaccatgttggccaggctggtcttgaactgctgacctcaggtgatccacccgct

SEQ ID NO: 219606 - DNA, 158 bp, Homo sapiens
aaggaatgaggggtaaaagaaaatcaaattagatattgtcagctaaagacaatttgaaaaggttaactgcagaactcccaaattggatctatttgagaataatgaaaaaagttggtaggaaatttagtggttatctggttcttcttgtctgaggcata

SEQ ID NO: 219607 - DNA, 444 bp, Homo sapiens
cttccttttagctctcagcttgcctaggtaccctgtaaggtccagtgacaagtcacctcctctgcatgtccatagcaactgccccacaacgtgtcattcaacaaacattcatggtgcacccactacacccctagccttgtgtgtacaacactgcccctcaccatatctcatttaattagaataagccccatatccacaggtccatgcatagaaaacagcgctggaaaggcaccactacatctgacgaaactgaactgtgttcggttagggggtggaggggagtggttggcattttcttctatctactattgtgcattttgcaagtgtcaagtgaacctgttacacttccacaatgagggaaaaatatcagtgttcttttaaaataatgtttggattcctaatttaaataaaacgaactctttggcagctccctgctcctagcac

SEQ ID NO: 219608 - DNA, 451 bp, Homo sapiens
aaaaaaaaattgtggaattagatagtggtgatggcttagctgatgagggtgttgttcctggtgggagggggccctctcctgccctgctcatatctgcctacttaccataacccctggaggcctgtggtgccagtcactgtattcctccattcctatagttcctccaaactggaacttgcatctagaatttttaacagattcaactcctagcgtttagcaacagaactgcctcataatcggtgttgagttcttccaccaggaactatataatgcttgtttgtctctctttgggggaagctaaaaagttaatgatcattgatgagatctgtcttcataaggagttgcaaaatggtgataatgtaattaaaaaaaaaagatagtggtgatggttgcacaactcttaatatacaaagccactaaattgtatgctttgaaagggtgaattttgtgg

SEQ ID NO: 219609 - DNA, 204 bp, Homo sapiens
gcctaatgggcttacctgaattaaactcaaagaaatcaagcaatcttcctttttgttgatgtcctgtaatatggaccagctaccactgtgccctcaagtcatactactttttctttctttctttttttttttgagacggagtttcgtctgtcacccaggctggggtgcagtgagccaagattgcaccattgcactccagcctga

SEQ ID NO: 219610 - DNA, 503 bp, Homo sapiens
taccttaaattcatctgcaaatttaatttcctttgccttgctgcatcacataatcacagattatgggaattaagatgtggacatccttgttagggaggtggatgtagttgttattctgcttactgtatgtatgttaacactctcattcttattatcttactcttcatagtattattataaaataggtgtcattattctctttttataggtgaggaaactcaggcccaggatttgctccaaagaaactagtttactacaaagtaatggatacatagacactagagccatactgtttgtatttaaatctcagcttccttttttgtatacctgaatttcctcatttcctaacatatttatttataaatctgtagtgtgcatcaattgcccaggaaaataaagcccctcattgttacattttaaagttgttttattttgatatttttatttctaatcaatacttttccttattctaatattacaagcgtattttatttcaagtatat

SEQ ID NO: 219611 - DNA, 320 bp, Homo sapiens
gcttctgggaattcacctgctgcctcttggttggcagaagctgcttctcatgttatcttgacatttaaaaagccaaacctctttctaaaattatcaaaccatcccttgctggcattaaattctccagctttagatccttcaccttccttttgctttaagttgtcatataatgacactgctttttctggaatcacattggagtctacagctatggctttttttcgttagacccagggacagattggaaaggtatgcctttcttacagcaaccctgcaccctcataaaagctgaattttcaatttgataaaaatgtattttg

SEQ ID NO: 219612 - DNA, 447 bp, Homo sapiens
tcttcagagagtgcggctggaaacgcaacgttacatgaaatgtttccaatttgctttcagccaaattacctcttttgctttaaagggcaaacttgttttctttgattatgatgacacccatcatttcttgacagctcatttgggtgaacaagataaagcccgtggaactaggattgaggggaaatgcatctgactctgacgacaaaaatgactggagaatctcttttccttgaatcctaatatgatcatttcatgtcctttttaatgccaccaaccttaatatttaaatcatttccaacttaagcatctccgtttaaaattcctgccctgagagtgaagcaaattgttaatggatgggaaactttaattggatattccctttatttgtcattaattctgctgatgaactttataaatggaaatatatctttatcatgcaaattatac

SEQ ID NO: 219613 - DNA, 356 bp, Homo sapiens
aaaaggagtatgggaagtttggttttttgaggggtagcaggatagggcagggcagctgttgaaacacaacagagcagacagagcacataggactgatgggattgagtatggaaaatgaaaaatagaaacagcatggagtgcttaaaattaaagggaagaagttgagatggcaattagtaactcctcttcggcaagcagaagttaacagacatgaggaggtgatgacctcccaaatatcaaaaactcctggggtaagctgcatgtgaaaaaaaaaggatttagtgatctttaacaatatttgttaactatttgactctgtacacaacattgcattaaacagaaagtagaattttaaa

SEQ ID NO: 219614 - DNA, 298 bp, Homo sapiens
gcacctgtgagacacttatgcaatgtccaggaagcggctgggaattccaagcttgctgctgagcagcactaagtgaaatacgctggctaatgtacaggcagggatgaggctcccgggaggacgcccttctcccttgctgaaactgattcagcaaatcctgttttcttctgtcattttacctaacactttggcagcggatggcactccctccctcctcctggccactgccacataacaatgagcttgccagctccccctcctacattcagcctatatacgctgcacatcccaggacttg

SEQ ID NO: 219615 - DNA, 543 bp, Homo sapiens
ggtctttcagacatcaaggaaggcataagatcacttcccagtctgagaaggccatcatatttaaaaatgaagaaaatgccaaaacaggttcataaaaatggtggtctatttctgctgcaaccctagtatgagatggaggaaggactgtggagctgatggaccaggaggtagcagagttcttgattgaactctgcacactcagaatctgcactgacgctagatttgacaagagaataagggaagaagggagaaagaacaggactggttattcaggttttaaaggatttaaagattgtgacttatacacatctttaaaataaactacttaccaagacttgaggaacatatagcttgggcagctgtaacgtttgttcctctcccattctttcccaacatgctgcttccccttcagttatcaattgacttggacagagtcctgttttatttgaagtcaaaactggctgcataccctcctaatctcaataatctgaaataagagaatttagtgagcctgtgggttttgtgtgtgtgtgtgctcatgat

SEQ ID NO: 219616 - DNA, 607 bp, Homo sapiens
caccagcttgagataaaagaagacaatagatcctaagtcttccacttggttccctatgggttttgtttgtttgtttgtttgtttgtttttggtagagatgaggtcttactctgttgcccaggctggagtgcagtggtgcaatcatagctcactgcagcctcaaactcctgggttcaagcaatcctcctgcctcaggctctggagtcactgggattacaggcgtgagcgactgtacctggcttcgatttcctgattaaattattctctctgcagccagtttctttattccagcctgagtcattttcttgccctgggtgacatttttccgtcttggacatctgtcgtattgaaagcaagtcacttcatttatgtctgtcctcgacttctgtttgatacacttcccatgtctccaagtcacggtatttctgaaacaattcatattgcttttcattactaaactttttttccaaagtactcctctgcagccttcattcctgatatctttaaatttatctagaaggtcttatatgctagatctacatctcctttagacacttatcattaacccaatttagggtaacagaaattgttttttacattgagcact

SEQ ID NO: 219617 - DNA, 834 bp, Homo sapiens
ctctctgggtgcagtagctagaaggcttcaggtaactccaaagccaacactgggtgaggcaacacacgccgcctcaggactcagcatttctttcaggctgcgttttcgtggcagacctacccagattgatggagaaagtttggctggcggataagaagtaacgcggaagatgtgtacgtgagagcgatttcacttcactcactttctcatttaaaggttggatgttttacagtggtatacatgattctccttctgtaatcaagagtgggaagtcgcttcccccaatccccgcgcagcccttcttctcccgccttagccatgcaaaatacctagaaagaaaacactaaaactgaacttttttccaaatacagcagtagctttgaaagcattctttgctcctctgttaacagcagaatgtaattctgaccactgcactgatggtttcttaatcatgcagtatgaagatcagcttcaaaataagtcttatgaatgaatgaatgaaagccagtgcagttagttcatcatgactgcagacattagaggactttgaaacaacctttggtgtacattgtactgtttttgttactgatattgtatgtattcatatgcattgtggatcatgcaccatgaaacttgaaaattgttccaacatctcaatggccacaacagtttggtagcttttgcctgtaaacgttgtatgtaaacatttgaacgtgttatactaaattactaaactcattttttactaaaatcatctggttcgacatagtaagtaacgtgcagtaagccaccacgtcgaaatgaaaaaaaaaaaacagattatttcccatcaaa

SEQ ID NO: 219618 - DNA, 179 bp, Homo sapiens
tatgtatcttttttccaaaaactcatatgctgggtgtggctgagtgaaattctatgaaattctccatcagaaattgtgtgtaaaaagtgagggaatattggagctgtaatatacagcaagatacagtgaaagggcactgaaccaatagccatagactcactagatgttagaactgaaga

SEQ ID NO: 219619 - DNA, 441 bp, Homo sapiens
acccttctctttagcctagatgacttccttgtaaaatcctatgcacttactcattcggcaaacatttactgagcacatacgtaccaggcagcacgtaaggtattaaagacaccactgtgaacaagcagatgagatctctaatgtctggttccataaaggaagatcttttcttcttctctcttcaacctccatagaaatggaacccactaagtctaaaataacagaccgaacatatggcttcctttaactattcccgatggcagcattttacttggttaagatgagagccagaaatatttcgtgtcctactagtgacaaataatgtggtttcatggataaagcactggtttcagtctagagatctagtttcttacttttgctatcttttattacttaagtgtatgaagaatcaaataaaagccacctcttcagagaccttgt

SEQ ID NO: 219620 - DNA, 539 bp, Homo sapiens
tcaggggacagcacaagatttcatgatgctactcagaacagtgcacaatttataacttaagaattatttctggaatttttcatctaatatttttacactgtgattgacctctgctaactgaaaccactgaaggtgaaacctctgataaggaggagactcttttagctttaatttatcatttccttgctcaaaacatcttcagtgactaacaaataagactcggtgttcagagtcctctcgcttcctggctcaaggcttctttctagcctccttcctcactgctggccagtaaccattctctgcatcctcaaaaggagtagtttcctgccctgtaaacacatccagagagtttctccctttgcgtcttcgctgatattgatcctgcctgcctcttcctctcttgtgattcctcttctcacaaatgaagggctcctcccagataaacctactcattcttcacaacatcccaaattttacattcccctggagccttcctaggtattttctatattatctcccgtcctcattccttcctggat

SEQ ID NO: 219621 - DNA, 449 bp, Homo sapiens
caggttcaagcaattctcctgccccagcctcccgagtagctgaaattacaggcacatgccaccacgcccagctaatttttgtatttttagtagagatgggttttcaccatgttggccaggctggtcttgaacttctcatctcatgtgatctgcccacctcggcctcccaaagtgctgggattacaggtgtaagccatcgcgagcagcctgaaacatcactttatgaggaccccatagaattttagacctaaaaggaattttaaaagatgatctagttcttacttttaaaatgaagaaaatgaggcccaaaagaatagtaacttaagaagtctgttaatgcaagaacaagaactagcaaagctctcttaaatgaccacttcagtcttcactgcaaagtctgacagcccaaacctcaggtcgacgcggccgcgaatttagtagtagtaggc

SEQ ID NO: 219622 - DNA, 413 bp, Homo sapiens
atctgctgtagacaggacctctcagtgatgcatgcagtcactgcccagggtgcagctggggaagtcacataccgtttcaactcaaactggtacactgcaattcagttctcataaccatctggagttagtgcagaccccataagttaaagagtatggtctccagcaagatggtcctcgcttcatactcagaggctgcaaatccctgagcttcccatgacgttcctgaagctcaaaaattcactagaatgacacagaattcaggaaagcattatacttacagttttattgtagaagatacaactcaggagcagctgaatgaagagacacacagggcagtttctgagagggtctcaaacagagcttttgtgctctcttcttgtagaataagggcttgtcactattacctggaaaaa

SEQ ID NO: 219623 - DNA, 184 bp, Homo sapiens
agtcccagctactcgggaggctgagacaggagaattgcttgaacctgggaggcggagctagcagtgagcccagatggcaccactgcactccaacctaggcaacagagaaagactccgtctcaaaaaaaaaataaagcaggataacaggaaaagctattctgcgttccccagtcctgggtactgt

SEQ ID NO: 219624 - DNA, 269 bp, Homo sapiens
gccaaagctttcagagttcctcacatagatggtgggcaagggaaaacttcacctggtaaggatgaaagaaatctaagaatctttcaatatgcctatagtatcctcaacaacaaaccactccaattgcttgcagactgcactggcttcaacccaaccaaggttcttctattcagccaagtttgtgttggaaatgatcatcttccttttgtatttgatggtcaatttcacattacttcggcaatgcttaaagaaatgcttttttttttttt

SEQ ID NO: 219625 - DNA, 461 bp, Homo sapiens
tttgaggagtagggtttgggggaagagtatatgctttttttttttaacttttaaaatcttcacttagatgttacattttaaaggtaaaattgacaaatccactgttattgactgatattccaaataaggctgctttcttcaatggtttgttttgtagctgatagctactcccgcctctgttccaggacttctgctatagcacttacaacattgctttgtaattattctttacatgttggtttaccgccagacggaaacctcctggaagacaggatagtactttgttcgtatttgtgccctagtatgcagcatggttaatcctattctgtaggattctgtataatcctacatttacatggttaagaagaggttcactactccctcccaccagtccctgctccaaatggggctgtttggtacaccaagcaaggccagagtcctcccaggcacattataaatag

SEQ ID NO: 219626 - DNA, 445 bp, Homo sapiens
cccgaacatgtcgatgctagtttcgttaagctctagttgctgaatcccaatatttataatcaaagcaggcctttgtcattagccttaggtctttatgtaaggccaatcagccttacttccttacgtaaaatagacctttgggtttagaagtacagcctccagcatataatcagacctagatctttgtgtgaggtcattagcctttttgtttggaaagtatatcatttgaaaatattttggccattatcctttttttttttaaaatagggtctcactctgttgccaggctggagtgcagtggcacgatcttggctcagtgcaacctctgcctcacacccggctaattttttgtatttttagtagagacggggtttcaccgtgttagccaggatggtctcaatctcctgatcttgtgatctacccacctcggcctcccaaagtgctg

SEQ ID NO: 219627 - DNA, 378 bp, Homo sapiens
gtctctggggttgtggggaaggctggtagcttgagagcctcctccttcaactctgtcaggctgcatgcacattggaaggtagcttttcaggttgtggtgggtggtggtgaagcagagggatgcaaagcagggtacgtggagggctgtgccttggtcattcccaggaagcaaagcgagcgtcaaaaaaagacagggtagttgggccatggcgttgcagagtgacagtgaaccaggaaccagaagagctgacttcagaggaggctttaggcgctcctgcatgttgattcttagagaactaaagacacagttgcatcttaaaatgttgagacttacacgtatacacaataagaatattttctttggctgcaaatgtactat

SEQ ID NO: 219628 - DNA, 501 bp, Homo sapiens
gaaacaacagatgttttgcattgaataaatcaaactttgtatttaagagtttaattgtattttattgtcaaaagctttcataatagaaagcacacaagaatgtaatattacggtaattaaaatagatgtaaatggttaagctcaccaattaaaagacagagtctccattgagatttttaaaaacacaaattgtgtggtcgacagacacacaaatcaaaaggatgcaagaaaatttcaaaatctaaggatgagaaaagaaatatcatgccaatatgaagcaagtgaaatctggaataacagtcttgaaaactgtagggaaacaatatcttaaagaaaaatattctaaaccaacagagcaagatgaaagacccatcatgagcacataggcctctaaaatgtagcctccaaatacatatatataatttataaaactgtgagaagcaacacatatagcagcaattataattagagatttttaaacacctctctttaaaaaacaca

SEQ ID NO: 219629 - DNA, 400 bp, Homo sapiens
atctttggcagccttttccatgatgttttcttcccaggggtttgtgtagcttgtcttcaccacttgccgtgagctctcgaggacagaggatttgtctgtgttagaaacatctggttcctgccgggcacggtggctcatgcctgtaatcccagcactttgggaaggtgaggcaggtggatcatttgaggtcaggagttcaagaccagcctggccaacatggtgagaccctctgtctactaaatatacaaaaaaatgagccgggcatggtggcgcgtgcctgtaatcccagctactcgggaggctgaggcatgagaattgcttgaacccaggagacagaggttgcagtgagctgagatcatgccactccagcctgggtgacagagtgagaccttgtctcaaa

SEQ ID NO: 219630 - DNA, 590 bp, Homo sapiens
agtaccacgttttatatggaatctctcaaataagcaacatgtgctatgttcctcaaaagagaaggctaaagtactatttttataaagtccgttattaagatctgcggggaatgctgagatgttgtgagaatccttactcattacagtattgggacacaaaggttcaggtttgtcaaagcacagtcaaatgttctttgctgttcagttgttattactattttaccagagtagcttggcagaaatgtcatcttcaggtgcaggcatctgtatatatctgagattatatatctgagaaatcacttactttgataagaaaatacagtttagaaggtggcaatatggagggtattttaagaaaattgatctcacagttattaccctctctgtgcttttcatccataattcaatagcataaacttaatgtttttaagatttgcaaggatccttagaattaacttcttagagaagtcattctttaaaagggtttaaataagtataatattaatcaagtgttaaatttggatggaagagaagacgattagaaactggcaggtaatttccctaagtagggctattagaaagagtaaagg

SEQ ID NO: 219631 - DNA, 588 bp, Homo sapiens
aagcttaaaaaaaaattgagataaaggaaattgattttcatttcaatgtttgactgtaaaatctgtttggataacattttgtaatgagctttttgtcatgtgatttgcttgtcttcaacttgaaattatgtgaggcacatttgtttatttgttgttaagaaagtgatttttttttttttttgtcctatgtgctgtgatctagactggtcaccggggtcacttatgaggcaccacaaagagatctgcttctccgtgcccggagcaggcagcaggagggagggcaggaaacaggactgggttgctttggaaaaatcatcatgacaagaagttgacatgatagacttgtgaccaagaagccaaactgaatatttaaaagctccttacttgctctgacattgaaaccaaagctgattttatctgcacaggttgcttaatatttaaaaaaaaaaaaaactgtacttaatctagagcaatatctgtatggtcagtaaagctgcactttgtgtatttcttaacagcttcagatctgtcacttttaatttgtaccataaaaaataaataattgtttgacatgagcttctaggctaa

SEQ ID NO: 219632 - DNA, 587 bp, Homo sapiens
tttagttgataatttgatactagaggatgggagtgagataaagagtagagattgatttgggaatcattctctgagataaccttagaaatcatggaatttgagatcctagggaaaaatctgtggagaaagaaaaggagaacaagaacacaatcatagagacctatatttagtggatggtaggaagaggacaaaccaaaaaagggatgatgagaagtgggagtacaagattacaaaagcactgtcacagaaattaagagaaaaatgttctttaaaagatgggacatttggccggtggcggtggctcactcctgtaatcccagcactttgggaggccaaggtgggcggatcacttgaggttaggagttcaagaccagcctggccagcatggtgaaaccccatctctactaaaaatacagaaaaaagttagctgggtgtggtggcatgcgcctgtaattccagctactcaggaggctgaggcaggagaattgcttgaacccgggaggtggagattgcagtgagctgagatcatgccactgcactccagcctgggcgacagagcaagattagattctatgtcaaaaaaaaaa

SEQ ID NO: 219633 - DNA, 341 bp, Homo sapiens
tcccctcctaacccccatcctctctacctcttcattatcacaattttcttcttcagatctgtatacccttctttccccgacctacccactgtttttccaaagttcggcccagtactaaattatctaccatttaaattctgcataacccagagaagttcagttattctctccctccctcaattctctgcagtccttcctttcttctcttgaaatacttggggccacgtgcggtggtatatacctataaccccagcactctgggaggctgaggtgggaggattacttatctcaggagtttgagaccagcttgggcaagatagcacaatcttgtctctactgaa

SEQ ID NO: 219634 - DNA, 601 bp, Homo sapiens
attgtcctatgaccctgccaattccccctctgtgagaaacacccaagaatgatcaataaaaataaaataaaataaaataaaataaagactaggtgaacagcaagttttaagtgcctcctggcttttagattcctaaaagggcccctaaagaatagtttcttacaaagaagtaaaatcctttttgtaattaattggttcattaatgtgttccctatagatgtagtgacaaatatcagggatgttaaaccccattgttttaagtggcccagcagacttggcctattttgtcaacctatgcataagataagtcctcctttcacagtcttcaaattaagaccctagcttgacaagccattctttgccaaacactctacttttcgtctggtgtgacttacagtttatatgcctagatagctaatactaattgtgccaggtatgaaactaaacacttgccatttaatgacatgcaacattcctaggagttagttgctattgtcaccccacttcacaaatgaggaacttgtgcttagctcaagcagatgcaacttgttaagacgcagaattgggatttgaatctaacagcaaagtccaatttagaaag

SEQ ID NO: 219635 - DNA, 523 bp, Homo sapiens
acacacttaggggtgattcaagctttgcctcttactaactgtgactttaggaaaattatttccttgggcctcagtttcctcatccgcaaaatggaattataaagtagcttcctcgagttgttgttgctgttacaggattggcacacacagtttgctgccgatcctaagccatgcagaggactaatcgatccacacaatcgttcccgctaagcctagatagactcaatgtggtgctccacactctgatcaattagtgcacagcatgaaaccttcagggcatcactggccttgggccttgccaaatcatgggcatcaaacttcattacaattagatgtttttagcctcttttaagaatgaagaatctgcaattgcacatcactgtggttcaaatttcattgcactagagaagtgtgtgttggccaatatataaatgtacatatcttctcagcattatttagaagatgacaatgtgtctggggatatttcatctgcagaatctaataaactcaacatcattagata

SEQ ID NO: 219636 - DNA, 517 bp, Homo sapiens
caatctattcctaaataaaatgactaagtgaatgatgtttcccactggtttcccactgaaaatcttgcagaacttttctgtgcaccttttggaccttatagaaacaatagataaattctaacatacagagatttaacacagaaagcagatttaacatttttttttaatattaggcagggcgattgctgaactgccaataggtttacactctatttacaaacatgattttgttcacagagcatactagaagccagtttttgacttctgtcttcttcagatgtatcagaaaggtcaatggcatggctcatagaggaatgtcaaatagtgaccaactggaaaccatgaaaagttcaataggggtgggaagagggtgaaggataaaagactacaaattgggttcagtgtacactgctcaggtgatgggtgcaccaaaatctcacaaatcaccaccaaagaacttactcatgtaaccaaatagccacctgttctccaaaaacttatggaaataaaagaaaaa

SEQ ID NO: 219637 - DNA, 1219 bp, Homo sapiens
aatacttttcaatattttgtcagtcttctaggcaatgttttgaaaagttgtacatacttgattgtggaagtgtatgagaaagagaaacagaaaaaagaaaacactgacttggaaatcaggagaacttgtaaccctggttacatataaatctattataattagttagtggaccctccattgactaaatgtgtagtagacagactaatatgaaggagaatctgccagttctggggctatctgttgatttatttattcacctactcatagttgctctatgttgtgagggagcctaatacacacaggctgcattggattctgtgtcagttggctatagtctggcttcagacagtttggacactagaaagcagtggtgggagacagaagagcagaggaccccctacattgggctccagtcacatcacctccttctgctgttcctgaagcccagaagcaacaatagcttgcttctcacttcaccatctttgtgggatgctcatcacccacctaaccatgtcataaggaattgcactctaagaacttaacgtagtcatggttttctggttagaccctgcctgataccaacaggggtgtctcaaagctgactccaactgtttcacaccagaagtctgaaacatcaagaagcaggattagaaatgaagccatccaaagggaagtccattttgtgacaaaagtgtgaagctcagttttggcttcactgaatcagtggtgctggaatatagggtgagccatggcccggccagaaatgtttttttttttttccaaccgctaattactttgaagaaggactttatgtagccccaaatgttaaaccaccaccacccggaacccaaaaaaatttccggtagagtttctttggtaagcccaaacattggattcccagggattggaatagagcctggggaggcttttaaaaaaaagggttcctttcggtcaaaatttgggtccatatgggtttgaaagaaatttattccccctacccttaaggccagggtggtaaatttggattcaaagggtttttcttaaggccataatctccttacacttatcgggaagaatatcgcataggttttattagtcattatgtgcactcttttttaagggacttccttccatgagagggtctcatatgtctatcacacttctctcgcgtatttgttcatctatgtctcgatttcttttctcatctcgcgtcgcgtct

SEQ ID NO: 219638 - DNA, 1148 bp, Homo sapiens
gggctggggtgtgtttatttgggtatatacaatgagtcatggattaaaattgcttccagcggatagatacctaggtgttccacagcattactgaacaagctgtcgtcatttccccattacctcagaagacccccttaattacttacttatattaactgtagaacgtatttatgcataccaggctctacctctgggctttctattctgttccagagacccagtaccagaatatttaaatcactgtggcgttaaatacgttttaatatctgatagggccagtttctgcgcattgcacatttttttttcccctttcaggaacgtgttcaggcccgcggcagggggcgggatcgcgcctcctcctcggctctggttccagccgagcctctcggacgcagagatggaaatcccgaagctgctcccggctcgcgggacactacagggcggcggcggcggcggtatccccgcgggtggcggccgagtccaccgaggccctgactcgccggctggccaggtccccacgcgccgcctcctgctgctccggggcccccaagatggcgggcccgggcggcggcgcgaggaggccagcacggcatcacggggccctggcccaagcctgttggcgccgaggaccgatcaacctagcggcggcggcggcggcggcggcgacgacttcttcctggtgctgcttgacccggtgggtggcgacgtggagaccgcgggctccggtcaggccgcagggcctgtgttgagggaggaggccgaggagggcccggggctccaggggggcgagagcggcgcgaatcccgcggggcccactgcgctaggcccccgctgcctgtccgcggttcccactccggccccgatctccgcccccggccccgccgcggccttcgcgggcacagtcactatccacaaccaggacctgctgttgcgctttgagaacggcgtcctcaccctggccacgcccccaccacacgcctgggagccaggggccgctcctgcccagcagcccgggtgtctgatcgccccgcaagctgggttcccgcatgccgcgcacccgggtgactgcccagagctgccgccagacctcctgctagctgagccggccgaacccgcgccagctccggcgcctgaggaggaggcggagg

SEQ ID NO: 219639 - DNA, 429 bp, Homo sapiens
tattgtgtgtgtgtgtgtgttttctttttggcagaaaatcttttactgaaataagactctatgtaaggattttcagtaattaaatgcttatcataatcctcaactggaaacattctcctgctggaaaccaaaacaaaaaaaaaaaccaaaagaggaaaatggggcactagttattatcacataagaggcaaagtaactttttcttgaattcaaatgttgaatataaacttctgttaatgatttacacagaacctttgcaagtaaacctagaatcagaaattctattaaaagaatggtcaactaattccattagaaaaaggaaggtcatcaaaaaaaattaatgaaacattctctaccatcattcacaagggtgccacgttttttcttgaatatacaatgacttggagtcccactggaaagttgggaaaa

SEQ ID NO: 219640 - DNA, 289 bp, Homo sapiens
acacctgctcaccagcgtgttagtaacacagctgacctgctgatctccaacagtggaccgcctgcaccttcctctctctggattgggaattcaggtggagaaaattggtgttatgtgtgaacttcctaaatccaaaacaacttcaatattcagaggaaacccttcacccctctttattctaagtatcctccaacatgtgcacacacacacactttcctccctgtttgaaatttcccaacctctgctctcttcctctagagatcttggacccctactgtgtcaagctgga

SEQ ID NO: 219641 - DNA, 444 bp, Homo sapiens
gtctttgcctgtagtttggttctttgtgggagatggttgctcccttcagtggcaggagatgatctgggacttggtacctcccaagctcacttggcaccctgtacagcacaggtgccaaacaactgtgagtggcaagtggagttttgtttctgcctctgtccctatgatataacaggtccttgtcagtggctttgacccctgtctgtggctctgtgtggctggttctgagctcgtgcctgtcgccagcccaggtcttacctgcctctcagtgtgggctcatggctctggactctgcagacagtgtcccagggttttcctcctttagtggtcttgcagatttaggatgtcagcaggatcttagaaattccttgccttgcagttgcaatgagtcgagatcacgccactgcactccaggctgggccacagagagcaagactctgtctc

SEQ ID NO: 219642 - DNA, 472 bp, Homo sapiens
cagtcgtggtgactcacgccttgtaatcccagcactttgggaggccgaggcaggcagatcacctgaggtcaggagttcgagaccagcctgaccaatgtggtgaaaccccgtctctactaaaaatacaaaatgtagccaaacatggtgtcccgcgcctgtaatcccagctactcaggagattgaggcaggagagtcgcttgaacctgggaggcggaggttgcagtgagccgagattgcaccattgcactctagcctgggtggacagagcgagacttcatctcaaaaaagaaaaaatttacatgttttatctttacatatctaatacctattacaacacataattgcgtaagatgctgtaggaactgacagaggagcttaggactcctcatgcctataagtcaataaaatctctaccatattgagttaaataatgaaggaatggattgcttcatttaactgaaaaaacagagat

SEQ ID NO: 219643 - DNA, 373 bp, Homo sapiens
ctttgtcaccttgtgctcaaataccctggctggcttgtaacaagaaagaattagggcatagctcagatacaaaagtggaaaaagaaacggctataatccatggggaagactttctatttcttagtctgtctcctgtcccaaatagctcagctctcctcccccaactcgtgtttatgtgttaaatttctttctcttgtagcagatgccaccagaccgacagtccctaaactaggtcagagagagtgatgaattgacaaagtccctcaggctacatcatccgcgtcctcacttcgtctccagttccctggcctgctttccctggcgtcttagggtggcccctgttccgagaaccacagaggcctagggggttcct

SEQ ID NO: 219644 - DNA, 429 bp, Homo sapiens
ctaagtatagttactgctgcaattattgtagataggattgttttttggttttattttcagatactttattgttagtatatagaaatattacggaatttttttatgttgattttggatcctgcaagtttaataaatttgtatattctaataattttttgtgaggtcctaggtttttctatacttaagattatatcatctgcaaggaaactataatttatcttcttcattttatttaagattgctttgattttattgaatattttttctgtcttggtcattttgtattatgttcagtaagatcgaagaaattgggccaggcgtggcggctcacacctgtaatcccagcactgtgggaggcggaggtggggggatcacgaggtcaggagatcaagaccattctggctaacaaggtgaaaccccgtctctact

SEQ ID NO: 219645 - DNA, 387 bp, Homo sapiens
gctgggtgtagtggcaggcacctgtaatcccagctactggggaggctgaggcaggagaattgcttgaacctgagaggctgaggttgcagtgagtggagatcgtgcctgggcaatacagtgagactgtgtctcaaaaaaacaaaattaccaagtatatcttacatagaaaatgagatctacattatggatttctgctttgtgacagtgcctaggaatgcacggtggttaaaaaaaaaaaaatctgctggctgggcgcggcggctcacgtctgtaatcccagcactttgggaggccgaggtaggctgatcacctgaggtcaggaattcaagaacagcctggccaacacagcaaaaccctgtctctactaaaaatacatggtggcgggtg

SEQ ID NO: 219646 - DNA, 390 bp, Homo sapiens
caaattcagggctttcctcctgagacttgttacacattactttaaaataattttgatatttttgataattttgatatacataatataaaataatcagtacacaatatgtttacttgaaatgtatttctttaagaaattaaataggaatataaaggaaatttgcctttagggggtttggtaattatgggacagttgattaattgtggactaaattaatttaactgaacaaaaggctagaaagagcctcatctgtgatatatctctgcacgactatcactgggtaaatcagaagattctgtcatagcagatatggagaaataaaaattgttgattcttaataagtcatcttaagtttttctgagattgtatactgaaatcagcagttgttta

SEQ ID NO: 219647 - DNA, 288 bp, Homo sapiens
cagtagatatggggacctacttgagggtgaaggataggaggagggaaaggatcaggaaaaatacctgtgagatactatgcttattaccttggtgatgaaattatctgtacatcaaacacctgacatgcagtttacctatagagcaaacctgtacatgtatccctaaaactaaaataaaagtttaaaataaaaaagaaagaaattagttcaatacttttttctcagtgaaatgcttatgcaaacaaatatcatacacttttatttcagagatttcgggatcataaaggg

SEQ ID NO: 219648 - DNA, 395 bp, Homo sapiens
agagtatactataatggaaatgtatctcaatcaaggtttgagatcgactatagaatgcagtttgtagaaaacaagtgaatgcttattttgaattttgaaacttagcacaaaaagaaattctaaatggggatgggtggtctggttattgtttttgttttttgtttgttttttttttttcctttgagacaggatttcgctctgttgctcaggctggtctccaactcctggcttcaagttatcctcctgccaaagtgctgggtttacaggcctgagccacaacgcctggctccgttttctgttccttgatgtgggttcactttatgaaaattcactgaacatcgtttatgcacttttcagtatgtgtgtcataattgaataaaaagtttattttaaaa

SEQ ID NO: 219649 - DNA, 488 bp, Homo sapiens
cttccaccaaggtcttaggagttttatagattggggacttacaatgtcagtctttaatacatcttgagttgatttttgtatatggttaaccagttttaaaaatcattaattactttctatcctttattgtgattttctttatttaaaaaagccaaaggtggcatttttaatcaaatttttccaaaattcacattaaataaatgtaaaatgtattatccccattgtgctctgaaatagcatcactgatcttagaaccagggtatgttgagcaatgtacgtgttataaacaagctccaaagatctgagttcattgctaggtggatcagcacacaccatcccaggtaattgattttggacactgctcctcctcagtctgagaacacgaacaccagcttcctaagtggtatctgcagagctgtttgagaagcaagtgggtcatcaatccattcccaaggttggcagcagtagtcaaagaagcatgcagtagc

SEQ ID NO: 219650 - DNA, 487 bp, Homo sapiens
cagaaacaagttcaagcgcagcaggcgcaaagcgaatgcggggctcgggatggggagcaggggcggaagggccagggagccacagaaagacaagaaagacacactgggaaggattcgcgcatttggagaccctccttgtacccccaccccccctttaattgaaactgtgtgcatgcagtgagcgcaggattctagtaatccgacgggaggatccacttaaaagactaaaatccagaaaccccaggaaaaaagaataggaccggcgcaggcattctccaaatctgtacccttctagagtcaccagcttatatgtacttaaaaagtgctaaaccccctcgtcatgtttactgagaaacagagcgatcctgcgcaggggagaggaacgctttcctctgaacaaaaaccaaaggcgaggattcaagtccagagtaaaagccttcaatactgggagacaaaacaaagtcgtccaaaccagacctgccttaag

SEQ ID NO: 219651 - DNA, 460 bp, Homo sapiens
cttgtattttagtttctgcaacacagcctgacctgtcctgattgaatcaggttctgcattttcaattattatgccttggcttctattattgccaccaactggaatgtcctttctcactgaccacctttgtactctgcacaccggtcttccctctctctttcatgagctctttttctatcccttcctccttgccaccaaacccctaagaaccactaatgttttttttcactttcttgatattttagccttttccagaatgtcttatgattagaatcagaaagcatatagatttttaaccaccttttacttaataatatgcatgtaagtctcctccatatcaatattattgctgaataatattccatggtacagatgtaccacagtttgttcattcctttacctattgaagaacatcttgattgcttctaaattttagcaattatcaataaaaccttccatg

SEQ ID NO: 219652 - DNA, 517 bp, Homo sapiens
tggctcataggtaattcatagaactcccaagtttttattttggattacagggttaacaattgaatcagaaaacttaagaaggagaattgatccttgatatgtgagatctttgaaggtggagcatagtttgtttttgtttttttaaaattccaacctgttacacaaggacctgacacataaacgctttgtgaactcaacagaagtattcttagaaatataattttatttttcacatagaagattgcagtatgattttaattaacacaagtatatgaagatatagtaggattaataatatgctgtgtgggccaagcctataagtctatttgaaagagtttcccaacttatttggaaagaatcagaatttttcatatgctgtttgtattttaaacctcttaaggctgggtgcggtggtgctctcctgtagtagcagctacttgggaggctgaggtgggaggatcacttcagtttaagagtttgggtccagcctaggaaacacagtgagactcttgtcttt

SEQ ID NO: 219653 - DNA, 390 bp, Homo sapiens
aaagatcctgactttgtacccagactcttctttgggaagggggtcatgattagcctaaggaaatcattacagttgcatttccaacttacatagactactttgccccttgggttatctggtgagttaattatggcctatgatacctaaagagaaatctgttttgggaacagttaggggactatcaggaaagcaagtgaaaaatgcattaaatgcattcctctccttccttgcatatagcagccatcttatgaccatgagatggtaatcaggatgggaagagcagagaattacagagccacaggtctccaggtgatgagccactgaaccgatagccccagaggccacccatttccagatttcttctgtgtgaggaaaattaattcctattta

SEQ ID NO: 219654 - DNA, 453 bp, Homo sapiens
tttgcctaaaatggaaatgaatagatggataaatcacaattcatataaactataacagtacaagcatggttatatgttagtatttattttgccttagtcaaaaaagtaaaacaagtctgtatttgcctctacgattatcagcaatagaaacattcactatgaaaaagcagtgtaggccgggcatggtggctcacacctgtaatcccagcactctgggaggctgaagtgggcggatcacgagatcaggggtttgagaccagcctggccagcatggtgaaaccctatctctattaaaaatacaaaaaattagcagggcatggtggtgcatgcctgtaatccagctacttgagaggctgaggcaggagaatcacttgaacccaggaggcagaggttgcagtgagccaagattgccccactgcactccagcctgggtgatagagtgagactgtctca

SEQ ID NO: 219655 - DNA, 610 bp, Homo sapiens
cggtggctcacacctgtaatgccagcgctttgggaggccgaggcagatggatcatctgagatcaggagttccagaccagcctggctgacatggtgaaaccccgtctctagtaaaaatacaaaaaaattagctgggcatggtggtgggcgcctgtaatcccagctactcaggaggctgaggcaggagaatcgcttgaactcaggaggcggaggttgcagtgagccgagatcgtgccattgcattacagcctgggctacaagagcaaaactctgtccacccccctccaaaaaaaaaaaaaaaaagattttgtttctgcagaagtgtggacagatgttcctggcatcttgtgtttttataatgaaaataatgttaaatggccaagtcagttttttggtgttcaatattagtccaggtatgagttaaataatgacaagtctgggcaacataatgggaccctgtctctacaaaaattaaaaaaattactcaggtgtggccgggcggtgtctcacgcctgtaatcccagcactttcggaggctgaggcaggcggatcatgaggtcaggagatcgagaccatcctggctaacaaggtgaaaccccatctctactaaa

SEQ ID NO: 219656 - DNA, 279 bp, Homo sapiens
agtataatccagaagagtgaagaaaatacccaggcatttggcaatataggattactacatgttttcctaaagaatttggaactgattagaaacatcctgattttatttaaaagcaatataatgtatttttacagtttgttttcaagaaggttcaaaaaaaaattttttttttttttttgagatggagtttcgctcttgttgcccaggtggaggttgcagtgagccgagaagattgtgccactgcactctagcctgggcaacagagcaacactttgtctc

SEQ ID NO: 219657 - DNA, 392 bp, Homo sapiens
aaggaagatattcagatgagcaagtctgggcttagagagcatacaactcataagaaaaggagctgggattctctcctgggccaatttcccactgctcactccaactctcagcccagcctctaaccactgcgctgtactctctcctacagcttaactcaaggggttaaatttatctcagatgtaccactgaaagtcgaagagataggattcatttctagaagtatggccatgaaaggatacagctatgcaataagtttgttgaagaaacagagaattgtgttgtttgccaattacatgtctttctccatggaatccacaagtgaatttgatcactggatgaccatgtcaagcaagaaaaagtgtaaggaataaagaagagagaaactatagtt

SEQ ID NO: 219658 - DNA, 377 bp, Homo sapiens
tcatggaggactataaattttattctgccacatatatttgctgaattatgaattatctccatgtgtactatttgactcgttttctcccttacaaccttgttgctgccatacacattcaagttctaatcatttttctttcttctccattcagataacttttcatttgcctgtttgtccctcatctttcatctctgtaattcctcttccacactgccactcatgtcatctctagaaatcagatctctgaatgctatcctgttgctcacaatcctttaatggctcccataatctgaaagacgaagttctactccatagtctagcatccaacatcttaaagatcaaagttgggcactgcctgtttctccagccctatctcc

SEQ ID NO: 219659 - DNA, 196 bp, Homo sapiens
tgaagataaaaataagatttcagctgtaaaatcagtttgaaaacactacataatatataatatcaccatcgttattattctgcagttagtgatgtttcaaaaacataaggaacaactctgtgatcagactgaaaaggtaaacaggcagagaaaagaaaggaagtacataggaaagaaaataaaaatataacaaaaa

SEQ ID NO: 219660 - DNA, 590 bp, Homo sapiens
aaaaagaaaaacagaaacaaaaattagccaggtgtggtggtgtatgcctgtcattctagctacttgagaggctgaggtaggaggatcacttgagcccaggaggtggagtctgcaagtctgcagtgaaccaagataatgccactgcactccagtctgatgacagagtgagagaccctgtctcaaaaaagaaaaaaaaaaagagattaaaaaaaaaaggtttcatttgaattgttcattccttggaggcaggaataccaggtgaatctattgtaggaattcatttggtttgccgattcatggagtggctgtgaagtgaaagttcactgtaggtgccaagaaagcatcccttcctgggttagggagcaggagagcccattgtagaaagggggcttttattttgggtcatcccattccttcagacaggaatgaagaacaggagattctaccttcagaaggtggtaagactggaaagacccatttttctacaagggtagatgagcaaatcttttggaggtaggagtctttttggaaacacccattcatggggtaggggtaatggtagaatttagtgtagaagggggatctatgca

SEQ ID NO: 219661 - DNA, 265 bp, Homo sapiens
acgatgagtaaacaatgcagccaggattggaactcagttggtttgttcccggtgtctttgatctcagtggctgcttgaggcagcctctcagggtccctagttggcagtcatattataaaaataggttccctagactcttcgcctggaaggaagatcattcattccaattattgagaagcgggaaactgaggctctgagaggcagaatgagataccagggtccctctgccactgccctgcaggttgactccttgacttggaaccat

SEQ ID NO: 219662 - DNA, 388 bp, Homo sapiens
aaaggtagtcccaaagtgcaagtataaccttgggccaaaatgttttactattcatgatgtgtttgtagcttaggttcattttagacttagataaaaaaacaaagcttgaacaagaagactgggaatagttgatgctcaagcagatcttaaaataaatctttaagaccacaaaagatgtaaatccttttgtattaggatagtacataagagtttgtattaggacaaactctctcaagagagtttgtcaaataactagacaaggaaataagaaacaaagctagacaaggaaataagaaacaaagctagacaaggaaataagaaacacgtatacatatgtaactaacctgcacaatgtgcacatgtaccctaaaacttaaagtataataaa

SEQ ID NO: 219663 - DNA, 307 bp, Homo sapiens
tattgggggtattgtgttctgtgccctgagaggtggtacaaaaattcagaggccaaacgttggccccattagccatttcctgagcattgctctggccaagtatttattattttagaaagaaagcctgataagcaccaacgcatcttcatcccatacatgacactgttttgcaggaattccacttgtatcatactgggacccagtaaccccgcattcttccagctccgtcctgctgcaggagccgggagcaggacaaacccttcagccccatttgtgtcgatccctgattgctgactccatgcattag

SEQ ID NO: 219664 - DNA, 425 bp, Homo sapiens
ggacactgaggtacccagaaagagggtggaaaatcaggatgaagggagttactgctagcctgtcatgtaccatgcacacaacctatctttttaaataccagtggatttcctgtctggctcagggggcctgtctaggaagagattcaaggaaagtagatgggttagttccagggactggggctcaaaaatttaaagccacacgtaacgttagctctctcactcccacacacatttaagataaaggagatggcagtagtgtgctgcccagaggatggaatacgcagataactaggtttctatactggttctactcactagtctgatcttgggtaattttttgggtcattgttctgtaagggagggcaataataactacttggtcagggctgttgtgacaattcagcaataaaacatggtcaattgca

SEQ ID NO: 219665 - DNA, 156 bp, Homo sapiens
taaatcaaaatcgagcaacttgaaaacgtctgtctttcaacacagtctttacttgttaagtcaagtgcacgcaaaataatctttacaataatatttctttcataacctataaggatgttcattactaaattgccaacatgcacttgaaaatatcta

SEQ ID NO: 219666 - DNA, 1055 bp, Homo sapiens
aggagctattggggtaatggcagtgttctgtattttgattgtgttgggggtttgtcagaagttattaaattatacgccttgcatttactcttcagaaatcatacatcaataaagttgatttaaaaactgaaggcaaatttctgcttcttgctaagattaagtaagagggactgcatttaactttccacctgaaacaacttaaaaactagacaaaacaatgaaacaatggtttttataatgttggacatcaggcattgaaggacattgattgcttgggagatgggaaacaaatgaggtgaaccctaagattgcaccagctttctgcctgaagagagtttccaggctacagtacaggcagggggtacccagttaaaggccagaagcctccctgattgagattgagatgtgagtccagggaggctagaattcgcagagcacagagaatcagggaggagagagccgtaaacagtctacctctggtgcgaatagtttcaactcctacaaaccagactggaaaacttcataattgacatggcattgagtagagcctcacaatgcttttgcctcaatagtggggcagaattatccttagactaaacactgctgtcgtacaaccaagagtttaaaagcaagaactaaaaggctcaaactcttgccaagtaatttaactatgaatccagaacaaagtcaaaaatactttataggaatacaacaatatccagcacccaacaaggtaatattcataatgtctgacagtcaatcatttaattaaaaactacaagcaggagcatatgacctatagttggggaggggataaaataattaaacaattaaaaccacaaaaatgactctgatgtctttttaatgtttaagaagcaggaggaaagattgaacattaagtagaaatctggaaaaagaaaagctttgtatttatggatatgaaagctacaatatctgagttgaaaagtacactggacagaattaacagcagattagacattgtcgaagaaaggattagtgaacttgatgacatagcaatagaaacaattgccaaa

SEQ ID NO: 219667 - DNA, 270 bp, Homo sapiens
atgcagtgccactgcaatgcttaccagttaaacagaaaaaaaaaaagggggataaaatgctcatctcttaaaagtcaatcggcttctatttcattctatatagttgttgatttcgtctacttctctaaatttaatcatcatttgctagattccaaatctatattcccaagccagattttcctcaaggtttgctaatgtatgtgttcaactgctcactgaacatttctacatcagtcttagacaacttaaatccagtatgtccacagctga

SEQ ID NO: 219668 - DNA, 297 bp, Homo sapiens
agctggagaagaatgcatgattgactttcctgcaattcctttctttccacatgtaaagtagattcacactcaccggtgcctcacaggaatgtaaccactgcctcactgcctaccctctctcctttttccttccttttttcttcccctcctgcttgcacattcccctttaaatattaaagttcccaaaaccctctttggaaaaagcacaggacacagatcctactgtaacttgtgtctctttttccctggcttgtcttcaacctcagcaaaataaatccctaaatctactgagatatg

SEQ ID NO: 219669 - DNA, 521 bp, Homo sapiens
tagctcttattctacttcctttctgcacaaacaaacatacacacacaggctccacatttggttgttttgtgtgactgtcagcctactagtcatagtctaggaaagcatttaatctctgtgagcatatgtttccttgttagaaagtgtactcagagctctttggaagacaggtttctacgacaattagtgtggactacactgctgttgactcatgactctgcagaattaccaatacagaaagtgaaattgtagtatgtgatcaggagctgatgaaatgaacctgtttcctcattgggaaattcagcgaattggactagatagactgtgttctttttttttgggaggtggggacagggtcttgttctgctgcccaggccagagtgcagtggcaggatctcggctcacttgcaacctccacctctgaggcaggagaatcgcttgaacccgggaggcggagtttgcagtgagccgagatcacgccattgcacaccagcctgggcaacaaagcgaaactccgtctc

SEQ ID NO: 219670 - DNA, 836 bp, Homo sapiens
tagctcttattctacttcctttctgcacaaacaaacatacacacacaggctccacatttggttgttttgtgtgactgtcagcctactagtcatagtctaggaaagcatttaatctctgtgagcatatgtttccttgttagaaagtgtactcagagctctttggaagacaggtttctacgacaattagtgtggactacactgctgttgactcatgactctgcagaattaccaatacagaaagtgaaattgtagtatgtgatcaggagctgatgaaatgaacctgtttcctcattgggaaattcagcgaattggactagatagactgtgttctttttttttgggaggtggggacagggtcttgttctgctgcccaggccagagtgcagtggcaggatctcggctcacttgcaacctccacctccggggctcaagcaattctcctgcctcagcctccctagtagctgggattgcaggcgtgtgccagcacgcctggctaattttttgtatttgtagtagagacggggtttcaccatgttgttcaggctggtctcgaactcctggcctcaaatgattcacctgtcttggcctctcagagtgctgggattacaggtgagagccaccatgcctggccgatagactctgttcttgagcaggatattgctttaggggcctcattgagcagaagcaacagagaaggaagtcttttgtgggtgagaccgtgcaactgtgcctttatctcccagttccaccagagaatctttgctttctttgacttcacacagcagggatctgagcaagatttcaaggggaaaggggttccactgctccttcactgc

SEQ ID NO: 219671 - DNA, 419 bp, Homo sapiens
ctagtctatccttcctgtagataagatttgttgaggttctcaattatgaacttgtctgtcttcctgacagcatccaatcatgatcaaagcctgaatccttggaccctcccctgaattaccggaccaaagctcaaatcctgtaataggtctttctcttactgagagaggcactatggctttctttgctgtgtgttttcctttcatgcaaagagtcataaattcaacttgttcaactatcactgtgttcttggtggcctttgtctggagatatttgacaactgaaatttgttcaatttaagtaatgctgatgctttgcaatgaatgctatttgaaatctgtattagcagttatataacttctgctctagcactctatgtatttacttctaaaattaataaaattctgacatgtttataata

SEQ ID NO: 219672 - DNA, 630 bp, Homo sapiens
gttttctaccctgttgccacctcttctatttagcacagcaatgactaagacatatttagaaggatggcctaaagaaaaatcaggactaagtagtttaggtaaaaagaagaattcatctacagatggagaaaaacaatcttgcccttcttcacgccaagttccaacatgtttgaaatttagcactggagggattgggagagctcaataattagactgcgattgaaatgttccactaaaataatgattagagaggcatccaggggcactttctatcttcttcattcgacctcagcatggagcacatcaactctgtttcttagttggactatactaccttagatacagaactgatttttaaaagtatataaaattatttcaagtctaaaaatcataaagagtttatctcaggataaataatttttatgaaagtattttatcgccagttcatttgtaacctaattgctttgcttaagtagataaatcccaagcaatgagtgaaataaactagtagactagtgggtttttaaccctctacctatgtctctcaaatgtttataatttctgctccactaatagccctgaccctgctaggtaacaatactctaggaaattgaagatatgagttcagag

SEQ ID NO: 219673 - DNA, 406 bp, Homo sapiens
attaacctatgattaaacctgatgattagccatggccaggaatcagattgctaatagccagagactcagtgggcacctttcgttggcggttgagtgctttgccagaaactgcatctcagtgggagttgggagattggaaagttgactaaggagccccatggtgggaagaattaagctgtagacccatgagatgataacagcaatagaaggagaggcagagcctcccacccacacaccaattcagaaatacctcaggtataattaaatccgactccagaatttagcacctttttgtaataagaatctttccttccagtccttagcattctgttgccttggcaaaaacccggtctcttgacatttgaaaggtttctgtcccattttcaaagaacagccctggtgaaga

SEQ ID NO: 219674 - DNA, 407 bp, Homo sapiens
  misc_feature (381)..(381): n is a, c, g, or t
taagcagggtgtggaatcccaatttatactaaccatatgttgccaaaatctcaaagacaagatatcaatttttaaaaatcttatccagcatctgttaaatttatgaggataagtagctgaggaaaacaaaaattttctctctagcaatacttccacagcacagaacatgagaattcccaaaggaaaaagtcctcagtaaagatgagctcataagtaaaaactacaaatcccagacccaatattgctttatctataccccacccactccctcaacacccgatccttggaagcaaaccctaggcatcatgccatttcaataataaatatttcaatacacatctccagaagataaggactcccatatgaacgataacgaaggangtctctgagtggaagagtaggctaaa

SEQ ID NO: 219675 - DNA, 597 bp, Homo sapiens
cgcttctctgccttttggctaagatcaagtgtaggatctgttcttaacagtttaatatctgatatattttctatccgagtccaatatattaaatggatttggggagcaggaagacggaataggagcttgcttgttcacttcacgcatcgatctggtattgcagtacctccaggaacagtgcaccccctcaggggattaaaatttaatgttcaaaacagaagaaggaaaaaaaaacagtctgtctatgtgggatgggatacaaaagagtgggataagaattatcttttggccgggcgtggtggctcccacctgtaatcccagcactttggaaggccaaggcggttggatcacctgaggtcaggagttggagaccagcctgactaacatggtgaaacctcgtctctacaaaaaatacaaaatattagccgggtgtggtggcgtgcgcctgtaatcccagctactccagaggctgaaacaggagaattgcttgaacccgggaggcggaggttgcggtgaaccgaaatcgtgctattgcactccagcctagacagcaaaagcgaaaccctgtctcaaaaataaaaagaattatcttttaaa

SEQ ID NO: 219676 - DNA, 455 bp, Homo sapiens
  misc_feature (15)..(15): n is a, c, g, or t
  misc_feature (69)..(70): n is a, c, g, or t
  misc_feature (119)..(119): n is a, c, g, or t
tctagaggatcccgntacatgtcgaggctggagatgggcagagggccagggtttaagacctggcgtggnnctgaactcacctgaattattttacttgtagaaagaggctacaggttggntgcagtggttcatgctcggctaatttttgtgtttttagtacagatggggtttcaccatgttggctaggctggtcttgatctcttcacctcaggtgactcacctgccttggcctcccaaagtgctgggattacaggcatgcgtcaccacgcctggcccagaagccaaatttttagtcacttaaccattagcaattcctcttctattagattttttttaaaattgcttttgagtatttctttgaagtggcatactcatttaaaggattctatatgtcagggggaatgttttctaggagggtacttaggaaggaacatatcgttatagcctaaaatttg

SEQ ID NO: 219677 - DNA, 389 bp, Homo sapiens
agctgattcagtactggatacaaggaagtcctgtgagagccaggtgcactattctgggccagtatacccttactttaatagaaaagagaattaaaaagatgctaactttacgttaaccaatagtaaggctgaaaatacgtcgtttggcacaccaaagagcttcacttagtagttaagaaaaagaatgactcccaattaaaattgcatacttgtgtctaaaaggttactttcggggggggggggggcgggggaaatgctgccacacgaatttccctttaccagggttatcgccacggcccagtacggcccagcgcagcatccacgtggttctcgagtccgcctggaagtctccggcgctagcccaaagcctggcctccgcgggaagaggc

SEQ ID NO: 219678 - DNA, 448 bp, Homo sapiens
tgtcctcttcttgaaagttcgttttgccaggaacactattctggggtgacagttgtcttccatccacactgtgaaggtatttttccgctgtgttctggcttccaccattggttggaaggtcagctgtcagtcactgatgcttctttctgaggaatctgagtctctctctgggcacttttaggccttctctttagttttgctacagcgtgtctacaatgtggatttatttttatttaacctctccttgttggtattcatgtctttcatttgtccttggaattttcagtcattatttcattttgttttgttttgttttgttttgagacacgatcttactctgtcacctaggctggagcacagtggcgcgatcttggctcactgcaacctcctcctcctcccaggctcaagcgatcctcccacctcaccctccaaagcagctgggactata

SEQ ID NO: 219679 - DNA, 670 bp, Homo sapiens
acagagaagaaatgccacccaacctcctcagttttgtatttatttgactgataaaagaaaaacttcagctgaattaaatttaaagaagtttaactgaacaaccaacgattcacgaatcaagcagctttcccagccagagtaggctcagagactccagcacagccacatgggagaagatttatggacagaaaaaggaaagtgaggcacagaagcaactagattggttacaggttggcatttgccttatttcaacatgttcaaacaattggctacatttggccaaaactcaatgattggcacaagtgtaagctacggtctgtttacacctccacttgttatagttcacaatgtacagaaaaacctttaagtcgaacttaaaatacgtacagaggcaactttaggctaaacttgatttaacaggactttggagaattgttaatttgagtatattaggaatatagccattttgtgtataaaaaagctatgcgtggttttacaggaacctagttcaagaaaaatcagacatataaaacagactaataaggaagtgcttactctgattagaaaattattcaccttacaggataatttgcatcagagttcattttatctgtgtgcatccgaaatatgattttgtattaaaagtgagtacttattactatcttaaatt

SEQ ID NO: 219680 - DNA, 162 bp, Homo sapiens
aatgacacaaaaggtaggagggagttaaatccagttcaagtatctaaggacttgaccctgggagacacaatgagactgtgcctggaaaaaaaaaaaatatatatatatatatatagagaggataatatatatatatatatatatatatatctcaatcaaaca

SEQ ID NO: 219681 - DNA, 447 bp, Homo sapiens
tctttaattctcttgtgagaatagttttgatctaataaaataggtgtgattttccattataaaaatgagcaaactgagtcttagagaattacagagccagaaaatttttaaaagtgtaaaattctgatctgagattctaacctagttatgtcccattcaaagcccatgttttttcattctagatcatgttaccttgtgggggaaaagtactgtatgtggaaaaacacatagtatatttattgtcctgtgtgtgagctgttaccgtgctttgtcccaacaaaagtccaaagtattggtagcctacaaagattttcattagttcagattacattttcaaagaagactttggtctgctctttgaagtttcattatgtaatcgtgaggcagaaaaacctcattttataaagggccagtgtgagttgaagacatttcctcagtgttgccaaa

SEQ ID NO: 219682 - DNA, 464 bp, Homo sapiens
ttaatctgaaagaattaaaagaaaaccaaaaaacccaaaacctgccagaactaataattgaatatggcaaggtcacaaggatgaactactaatatttgaaaggttaatcactttcctatgtaccagcgcttcataaatgcctaccagatgagttgagagatggatagaggtgtaacacaagctctggggcctctaatctatttgagaggcttttaagataagtgaaaaaccaaaactgaaataacaacaattaactaatcccctgaactgaatagtttaattagtactgtggtaagctagcccaagatcagaaattcacacttcctcggctgggcatggtgtcccatatctgcaatcccagcaccctgggaggccaaggcgggatgaatcacttgagctcaggaggtcgagaccatcctgggcaacacggcgagatcccgtcaatacaaagaataagctgggca

SEQ ID NO: 219683 - DNA, 524 bp, Homo sapiens
atctgagaaagctaaccagatcagtttctggacccacctataactgcacaccatagaagttctcctttaacctgttgatttgtttacattcattaacaatagttccatactacgctgaaataaaatggtattctcagagatacagcattttaaccctaaactaatcagtctcctgatccctagtccaatgtgtcctttattctcaactagactgcctcaacttgataagttcctagttcccaccaaaagttagggccagattttgatgttacagactacttagctaaattgagtggaccttaatatgtgggagccaatattgatattttttgagggaagacacatactttctaatataaaaatttaatctgatactttaaacagggacagatcaaagatatggtcacttttttatccctcccagacatgttgcataacttaatttttataatggatgtgaaattttctaaacgttacaatgaaatcttttttttaaaaagaagcagatataaatttaaaattct

SEQ ID NO: 219684 - DNA, 517 bp, Homo sapiens
tgcatgcaaaatgcattcaccctctcccaacatctccaaaagtctcaacccaatacagccacaactgactgcaaaatctcaaccagggctcttgatctaactcaggaataggtgagattctgggtgtaatccatactgggacaaaattcctgtctgtttgtggacctgtgaaactagcaaacaagttatctgctcccagaatatggtgggtcaggcataggttatcattaaatggaaagaaaaaaggagtctctagttttgagcactttcaaaactcctttaggtttcaaggactggggatagttctctgtgactctttactccaccctgtgggtactgaacttctccactcttgggagtcatccttcttttctaatgaagggtgtagcacctgtatgctgctgattacttttatcagcctgtttcttgcctctggaattatggtggtctgacagcattatttcatttcatattcttttacttcacctttttcctgtcccgttttactgtaaccagc

SEQ ID NO: 219685 - DNA, 398 bp, Homo sapiens
accactcaaaaagcataagcaatacagaagaatgggggtaaatttggctttattgaagttaaaacttttgtttaaaaagactctttaaacactgtgaaaagaccaaccacagactgggaggagaaacacgttatgcacatagccaacaaaagatccttttatgtatgtgtgtatatatatatgtgtgtgtgtgtgtgtgtgtgtgtgtgtgtgtatatatatgtatgtatatatatagaatccataccctacatcagtagggacaacatatgcatcaaatggaaaaatgggcaaaggatgtgaacatttaggtcatggaaggggaaacacaactggcatttgcaaagatggtcaatctcaccaggaaccagggagatgctcgttaaaacaatgagata

SEQ ID NO: 219686 - DNA, 523 bp, Homo sapiens
gtcttcacattcagcccaggattactaaagcataggaaagaggcggggaacatagacacagctcatgtaaacattccttttgtttatggccgaatcctagccactggactacctgaggcatacagatattctttggctatgggctgacatttgaatacagctggggcctcaggattctctgaaataaagggctgcctccctctggaggagccaggcagctcctcagagcagctgcccattgcgtgctggacaaggccatgtcaccacctccatggctccccagtttcccagcttgctgtatctctccaccgtaagagactgggagcaccttgatctgaagctctttgcagtgccggtggcagtgtagggggaagtagttgatgggagtgagggaaaggaattggcaaggaaccctgggcctctgtggctcactgcatcaagcagttcttggcaaaggtaaggtcaggatgggctgtgtcgtcttgggtggggtgaagacagggagcagtgggcatgcagatgc

SEQ ID NO: 219687 - DNA, 615 bp, Homo sapiens
tttatgtggcttctctatgactcaggatgtattggccctagaaagtttggccttttattatcaggctactccagaggttctcattccagcagccagtcaggacctacttccccattctgaaccaggcagtcccctagaaaaccattccaagagactgtggagtactcaacagagatcaggtaccaagtccctgggaaagaaaacaatctccagggcctcaaataagatatacctttcttaaggcctttctactacatttgaaaaaaacatgaggcagagcacttcattgaagtttagcacctttcacaatgtggctagtaataacctgcagagacatccttactctaagaacacaatgaagattttctgcactaggtatgattttgtttccaatacattcaactgtgtgaaaggctgtataattcataaaatggcaagcagggaacaaataactaatttcctctatttacccaatttcagaaaactgccatcttaaagcagaatttattattctcatggcactcatcattcttatgggtctactttagggtccccatgcatgaggctcagctcaagtctctcctctccagtaatcacattaataacttctctcat

SEQ ID NO: 219688 - DNA, 721 bp, Homo sapiens
ttaagaaaatcctgttaggctgggcgcggtggctcacgcttgtaatcccaggacttagggaagctgaggcgggcggatcacgaggtcaggagttgaagactagcctgatcaacatgttaaaaccccatctatattaaaaatacaaaaattagtcggacgtggtggcacgcgtctgtaatcccagctactagggaggctgaggcaggagaatcacttgaacctgggaggcagaggttgcagtgagccaagactgcgctgctgcactccagtgggtgccagagcaagactccatcgccaaaaaaaagaacatcccgttgcaggattctaactatagagacatattacagtagaatatcacagtattaattaccatgaaaatacctatgactacagtttacctttgaaataagaatataaggtaaagaagaaattcaaagtaatcaaataatcaggctgggtgcagtggctcacacttgtgatcccaccactttgggaagctgaggcaggcggatcacttgattcgcctggtcaacatggcgaaactccgcctctactaaaaacgcaaatattagccacgtgtggtggggcgttcctgtaatcccagctgtttggtaggctgagtaaggagaatcaattgcttgaactcgggaggagagggatgcagtaagccaagataatgccactgcactccagcctggacaacagagcaagactctgtctc

SEQ ID NO: 219689 - DNA, 354 bp, Homo sapiens
tggtcaactgtattagtgtttcttaaaagggcttctggtcatccttagggcttatcagtagcatcattaataatgtattcatttcactaaaaatgtggtaagtagcttggatttaaaaacaggatctaatttcaaagctatttccactatacacaccaagttacaactttcttatctctcctaaattctaaattttacatgatttaccaaatcacttcttaagtaagagtacttattgatcagaagtgtgagacaaacaccttatcccacttgtccaattcattcaacaagaccgattgggtacctttgtgtctctgacaggtaactttcaacagttgtatttcttaaacttta

SEQ ID NO: 219690 - DNA, 207 bp, Homo sapiens
accaaacatttgccagtctggttccctctgcatttcaagattacacacccctcataatcctgcaaagcctttcgtatcaatttttctgtgaagcttttcagaatccaccaccactcccaccatcaccccaactccctgagagggcagatctctctctccgtttggcagccacttttaataaagcatttttcactgatactatgagtc

SEQ ID NO: 219691 - DNA, 596 bp, Homo sapiens
tgtgctgtggtgatctagaggatccctgcttgatgtactgctaggttctattttacttttctcacagaaaataatacacagcatactctttatactcagttcactgcagtcatctacctttaaaaaaagattaagtattcactgatgcttaaatcccagattataaataagttaaaacactactaaagggcaggtgcagtggctcatgcctgtaatcccagcactttgggaagctgaggcagggattgcttgaggccacagtgagctatgatggcaccactgcactccagcctgggcaacacagtgagaccttgtccccccgccccaccaaaaaaacaaataaataaaaggagtaagtagggaaataatcagattgaatcagaattaagaaataacatacaattgcaatgtatgagctttatttggtccctaattcagccagcaaacgttaaaaaccctttatgagataatagatgaatttgaacagattggatatattattaagcagcactgccagtttttaagtggagaaagggtaattattttttcatgacttcttttgactattccaggtgaaggtttagaataaaatgggt

SEQ ID NO: 219692 - DNA, 506 bp, Homo sapiens
ggcctctcaaagtgctgggatgacaggcttgagccaccgcgcctggcctattttcagtttcttcaacaaatatatcaccaaggggaaaaaatggatcatcctggcatggtgtctcaggcctgtaatcccagcactttgggaagctgaggcagggattgcttgaggccacagtgagctatgatggcaccactgcactccagcctgggcaacacagtgagaccttgtccccccgccccaccaaaaaaacaaataaataaaaggagtaagtagggaaataatcagattgaatcagaattaagaaataacatacaattgcaatgtatgagctttatttggtccctaattcagccagcaaacgttaaaaaccctttatgagataatagatgaatttgaacagattggatatattattaagcagcactgccagtttttaagtggagaaagggtaattattttttcatgacttcttttgactattccaggtgaaggtttagaataaaatgggt

SEQ ID NO: 219693 - DNA, 824 bp, Homo sapiens
gacagagaatcaattccttaacttgaaaactgggtaatttttttaaaaaaaagcaggtattcatcgtgcctttcctatctcagggtaatcaaatagtagatgagaggaagcatctccttatccacttatgaactaataaatgaaaacaaaattattagaataccatgattttgcaaacttcaattaattaatgaatctaggaattgagcatcgacggctgttaacctcaaaaaagagcaaacaccagacatcatgatcatgtacctcttgaagaaaagaacacacaaccatctataatcttacaaaagacatcaaacttcagtctgaggaagaccctggatcagctgccaacttgctgtcaatacagaggacagagaaacatgctgaattgcctcatgaatgtgcaacccccagactctggaaaacctcacagatcaagggcttaagttatttaacaaataattgtaaggaaaagactgaaaaggcaaatcaaattaaaaaaaaaaagagtggggggaggggtaaggtgcacccttggaagataccaagaaaaacaaaagcagcagaagtgactacatgaaagtcaggttagtggttacttttgggaggagggagaaagggggttgtcattgaggtagggcacatggagaggctcctggggtggctggcagagttctatttcttgatccaggtggtgattacaaggatgttccctttataataattcactagtctatatatctatatatttgttttttgtggttttctgtatttatgttttattttacaattaaaaaatttttaaaaacactccttaacctgca

SEQ ID NO: 219694 - DNA, 451 bp, Homo sapiens
atcaagggcttaagttatttaacaaataatttaagccccagactctggaaaacctcacagatcaagggcttaagttatttaacaaataattgtaaggaaaagactgaaaaggcaaatcaaattaaaaaaaaaaagagtggggggaggggtaaggtgcacccttggaagataccaagaaaaacaaaagcagcagaagtgactacatgaaagtcaggttagtggttacttttgggaggagggagaaagggggttgtcattgaggtagggcacatggagaggctcctggggtggctggcagagttctatttcttgatccaggtggtgattacaaggatgttccctttataataattcactagtctatatatctatatatttgttttttgtggttttctgtatttatgttttattttacaattaaaaaatttttaaaaacactccttaacctgca

SEQ ID NO: 219695 - DNA, 403 bp, Homo sapiens
gttctaatgacacgctccttttttaatgtaggtaaggctttatacttctccttgacctgtagtggcatgagagtgtataacatttcctaagatgacaggcaaagtagaactaaccctggcactgccattagctggaccccaccttctgccatctctggccacgaagtcactttccttgtttgcggctataccacagtggtgggactgcccaggggtaagttggtcagtggacagtgttcctcttttctgaaaactgtctgcacaattgccagcaggcatttgctggttaagatgcaaacagttttaaaattcgtcattttaaaaccatacttggcatctaataactacagtttacccaaccatccactcatcttttaaaaaaaaatcattttgattcttgcta

SEQ ID NO: 219696 - DNA, 437 bp, Homo sapiens
ctgtagacttgtatctgttgtgccaaaagccatacaattatcatatgtctgaccacttgtcttttccttttatgatattgtgggaaatggggaggggaatggtataggaggaagcctgttttttgtcttctatagtggtctaactataaaaatccatagaagggttttgctttgggaatagcacagggaaaagcagtgaaacttacctgtgtcacagggtttgacactggtgagaatccctgctcttcatagatctcactccctggcccaccctacagacccccatctcagacctactcaacataactcactccccagcctatacaaatccataatgaaaggctagaaacaaaccaacaatagagaaaattaatgaaaccaaaagctggttctttgaaaagatcaataagtaaaagttttagctagattgaccaaaa

SEQ ID NO: 219697 - DNA, 484 bp, Homo sapiens
ggaaaaaaacgatccaagggaagccaatcaaagagcctggattgccagtcttccctgctgcgatctccgcctgcgattctccaggggaaatgtcctttatgaccttacagctcacctggaaccctccacctagggcccgaggcagcacatcctctcgtgcccgggcacttccaggcattgccctgagtactgggcacttcacacactgggctggaccactcaccggagtgaataaggaggcttgaagctgtcctggtacaacaatggaatgaagcgctagtctcagctcagccacttggaatatgactccaactctcacatttctgtggggtgtattcatttcagctttttgtttggtgctatggggagggaagggccctcagactggcatcctttttcttccaggatgatgatgaatattatgaaagtctgaggctgtttttaaaattctgctctaatacgttgtttttctgtgcataagaat

SEQ ID NO: 219698 - DNA, 421 bp, Homo sapiens
gattgagccattgtactgcagcctgggcaacagagtgcggctctgtctttaaaaaaaaaaaaaaaaaaaaaaaaaaaaaaaaaaagagtttcctgttggtcttactatctttagagcagtgataaacagtcatttgtttaaaggctttgctactcactgcatgtagtctgtagaccaagcgacatcagcatcacctgggagtttagaaattcagattcttaggccccatccctgacctacagagtgcgagtctgcattttgacaagatccttcatgggtttgtttccacagtggtctaaagtacaaaagcaatccttggcctagtgtggtggcttactttgggaagccaaggcaggaagatcacttgaggccaggaacttgagaccagcctaggcaacacagtgagaccctgtctctacca

SEQ ID NO: 219699 - DNA, 359 bp, Homo sapiens
gagatggagtctcgctctgttacccaggctggagtgcagtggtgcgatctcggctcactgcagactccgcctcccgagttcatgccattctcctgcctcagcctcccgagtagctgggactacaggcgcccgccaccacgcccggctaattttttgtatttttagtagagacggagtttcaccgtgttaggatgatctcgatctcctgacctggtgatccgcccgccttggcctcccaacagtgaaaaacttttaagaaccactttgttctgttattttaatacaatttaactcattagacacctgattaagacttgagttatcctcttcctcccttcctccctccccttctatgtgcc

SEQ ID NO: 219700 - DNA, 471 bp, Homo sapiens
ggactgcctattaggtgctcaggaaataaataagaatcttagatgagacatcccagcagattaggatccaaaagatctgtctggaattctgagatgccataacacgtagtaacatgcacacagcattaaaaggctgttgtggcagaggcatttattgtattgctcaccaaatatccataggcttccccatctgtcccagtccatctgtagtttgttctgtccaaccactgagacagaggtgatatgtgtcccttccaggctgaagtataggacacatgtgaattctctatgcattctctccctctacggccaagatggtgatggcccaaggctccagtaatatagctgcaagtgccagagcctctatcaaccagggtgcttaagcagaattcccatctccacttcccattccaccaccaacctgtatgtgtcatttaatgaaaacacgaaataaacttttactgtgttaag

SEQ ID NO: 219701 - DNA, 396 bp, Homo sapiens
tttgaccttatgtacccaccacagggtcaatattcctggctaccacaggtttcctgggcgtggtaacttgcaaaagccactcaggttgtccagagaaaggttaatgtggcctcatcataactggcccttttagctgagtgtgtcctggccccacccccatggagcagaccttgccgagcaactgttgaatgaacacacagatgccacttcagctttcaggtgcacagacacagcagtgtgcatacctgaacctcatgctaagacactcgcagccattcaagcagtttaagacgctgtctttaggcatgaagctctaaggaggatacaaatttttaaacaatttttgctgttttaagatttttttttttttttgaggcagggtctcaccctgtcacc

SEQ ID NO: 219702 - DNA, 334 bp, Homo sapiens
gtgataatagagttagtatgtgaagggccaagaggattttgaattcaggtcctagagttatttctaatatgctactttgttgaattgaccccataatatggtcagcaatcttcagtgataaaatgtgcagtgctcacatgcagtgtgtatctcctgagcaggtagcctctgaaacagctttggcattgctgtttcttgtcatatcttccattaactctgtgcacattagactcgctaggacttttcagactggaggactctgacactcagttcaaacttcatttggcattcagaaatatagtcattgtattactgtaattagattatcaatgtg

SEQ ID NO: 219703 - DNA, 749 bp, Homo sapiens
tcagttttgcaagatgaagagaggtctgagatggaatggtgtaatggtagtacagcagccatcatgaatgttcttaattccactaaactttacacttaaatgatttaaaaagtaaatgttgtgttgtatttattttaccacagtaatattaattaaaaacaaaagaataaagccacattccagttcatcagtattcttaaagggtggccttaaagttgaatgaatactccagatgtggtaccagatttctctttatgtattagtgaagcctaacacattagcattttacccctttattagttacattgtcctgttgacttgtactgacaaactaaaatctcctggttttataaagaatcctacttgttctgtgctcctctctctttaatttgctgtcatacttctaaattatcgattacatttttcctgattaaatttaatgtcttttttaaaaaggataaaaagtaaattatgtaaactctaccacaataataaaaaggatggaaacactaaatctatatgctttcctgtatgtaatattctagaaaaggctacttcagatttatgaagaacagatcagtggttgccaggaattaatagcaggagattcatttggcttacaaagtgctactattaggaaatttaggaaggtacttaagagattgtttgatactccaattgtggtggttacacagctggctgccatttgtaaaactcacatcctatggcttcaacagagtagcttctat

SEQ ID NO: 219704 - DNA, 336 bp, Homo sapiens
ctaataaaacttattagtaatctaattaatgtctagtcctcagggtatagtcaaagagaataaatttgatggataattttccattgtttctttcatacccttctccaggcaaagctgagaatgagcctaatggtcggaggaattaactgtttccctaagtgcctaatttactataaggaattgtatttgctgcatagaagaaagtaactttttatatgagattattataaaaacaaaaatgtcaggctggtctgttgcttaatattatagctcatacttatttcagatatctttgacatctcttgttaattttcaaataaagaagctgaagccaga

SEQ ID NO: 219705 - DNA, 1096 bp, Homo sapiens
accttgtgaaaaaagtttaaagcaaagacaggattcaaacagtataagactgaatacatatcaaactttacctttctaaacaatacctatttcttttttaactttttttttgagatagggtcttgctctgttgcccaggttgtagtgcagtggcatggtctcatctcactgcagccttgacttcctgggctcaagtgatacacccacctcagcctccctggtagctaggaccacaggtgcatactaccatgcctggctaatttttggtagagatgggggtttcatcatgttgcccaggttggtctcgaactcctgggctcaagtgatctgcctgccttggcctcccaaagtgctgggattacaggtgtgagccaccatgcccagccaacattacctatttctaagcccccgtgcaacatttataaaacctgcaacttatcctgaccacaataataaaaattttaggcaaaaaagagcctggtatcatttattgtaaatagttatgtatgaatattaaaagtacttacccaaattttgctgaaagttgaaatcagaagcaaattcacagccttaaatgcttacatggtttaagaaggggaaaaaaaaatcagataactgtttattaatttaagttaaataaacatgcaaaaaggaccctgagaaagtaggaagcacaaagaataggctcctatacaactgttgaatctaagaagtgtttttgacagaaaaaagttaattgtatcttagagaacaaaagccaaaattaaaaaaaatgtgatatttgactcaggaaaaaaaaggtcaaagcctgaatagataatcagccaggaagaaatttaggagaaaaaaaaatggaaaactgcttaagcaaaaggctccaggcctagataatttagtagtgatttagtctcaaggaacagttatttctcattctaaataaactgttgcagaaaaaagaaataaaaaacagcatcagctataatagcaactagttcttaaagtgcttattatgttccaggcattaatctaagtgcttttacatatattgtacaatttaaacttcacactttagcactggtactatttattatcccca

SEQ ID NO: 219706 - DNA, 835 bp, Homo sapiens
accttgtgaaaaaagtttaaagcaaagacaggattcaaacagtataagactgaatacatatcaaactttacctttctaaacaatacctatttcttttttaactttttttttgagatagggtcttgctctgttgcccaggttgtagtgcagtggcatggtctcatctcactgcagccttgacttcctgggctcaagtgatacacccacctcagcctccctggtagctaggaccacaggtgcatactaccatgcctggctaatttttggtagagatgggggtttcatcatgttgcccaggttggtctcgaactcctgggctcaagtgatctgcctgccttggcctcccaaagtgctgggattacaggtgtgagccaccatgcccagccaacattacctatttctaagcccccgtgcaacatttataaaacctgcaacttatcctgaccacaataataaaaattttaggcaaaaaagagcctggtatcatttattgtaaatagttatgtatgaatattaaaagtacttacccaaattttgctgaaagttgaaatcagaagcaaattcacagccttaaatgcttacatggtttaagaaggggaaaaaaaaatcagataactgtttattaatttaagttaaataaacatgcaaaaaggaccctgagaaagtaggaagcacaaagaataggctcctatacaactgttgaatctaagaagtgtttttgacagaaaaaagttaattgtatcttagagaacaaaagccaaaattaaaaaaaatgtgatatttgactcaggaaaaaaaaggtcattgaactggttcctgttgcagtgtgcttccg

SEQ ID NO: 219707 - DNA, 611 bp, Homo sapiens
cctgggaggagggaaccccattgccaagttccgtgaggcccctggactcagcagtggcttcacagatggcctcacgcatcctccaaacagcagcaccgtggagcccatgtgctggtgggaggcagattcttggccctgcagagcagcttcctgagtgtggacagcaagccaggaggcctgggggaatgccgtcctcagggatctgtgtagcaagacgatgttccgggcagaggagtcttccacacgctttcctcagatgcagtggggtgggcacgggaggttctagatcatgattaatgactataccgccgcgtcctctagcatgcttagctgggccatctcccaaggctctttgccatagtaataatcaacaagaaattgtgggatgtgtctcttctgttggcatctatgaaaaatcgctccatatgttctgccaccacggggcagcaagaacacgctttgccagcttggctgacctgcgcagttgggtgcgtgtccaccgtcatctcagccttgctcctcattgcttgctgcgtgccatttaccacaacagtgctgtgagttgtatgttatcatcctgcattctccgaacactgaacagtttacccagg

SEQ ID NO: 219708 - DNA, 228 bp, Homo sapiens
gactgctaccagagccagactctatcccggggagaaggagtgtacagaaccaagcaggtccttgccacagagcatgggagagaaatggggccccaaagtgtctatgaattgaccgaaaatgaggaggaaaatgttgacgtcatccaattagcagagattaaccagattaggttttctggcacttggcagaatggtaactcaaaataaaaactgagtttagtaaaaaac

SEQ ID NO: 219709 - DNA, 259 bp, Homo sapiens
cgtttgatctgtctaatgttgacagtgggatgttaacgtctcccattattattgtgtgggaatctaagttcctttgtagggaatccttttttttttcctgagacttgggtctcaaaaaaggaaacaaaaacaagaacaaaacaaaacaaaacaaaaagtaaaaaaacaaaactccattaattttcaaataaaggaagaggcaaagttattcaaagcgaacaaaaagacaacgggaattgaggttaaaaaaaatcattaa

SEQ ID NO: 219710 - DNA, 388 bp, Homo sapiens
cctgggaaaaattttttttaatagaatttccccatatttagaggaaatcattggaaaagaaacttcttgtcacttgttccattgaagtgcttttgaatttgaagtattgaatttcagttgtttcccatgactgtcattgtccaagttaaacactttgagaatagtgctcgtatgtttcttcttcttcatcttgttagggctatctatggttttttatttatttttttatctgtgcaacaagatctctgactgtcactgtcctagcttagtgcagctactcgggaggctgagccagtagaatcgattgaccccaggagttgtaggttcccatgccccaagattgcccccctgccctccagcttgggcggcagagcgagactgtctctta

SEQ ID NO: 219711 - DNA, 446 bp, Homo sapiens
cccacttctcatcacactacctgaaatgccaccattagagacttatcccacactgtctgctgcctccaagatgcatctaacaaatgtagaaacccagggaaggaatttactgtttaagcttatttatagaattatacagtaagagttgttgtgaatgatcattgggtaactttacagatggggaaactgaggctaggaaaggaaatgtgactcatcttcccactttcatagagagatctgtctacagtggtctgaaagcaaagctgccatgctgctatggtctcaagggttatgttcccccaaaattcctatgttgaaattctcacccataaggtgatgacattaggaggtagggcgtttgggaggtgagtaggtcatggaagaggagccctcatgaatggggttatgtgccctaatgaaagagcactgaggctggatgcagtggc

SEQ ID NO: 219712 - DNA, 677 bp, Homo sapiens
caaccccatgaaaaagtgggcaaaggatataaacagacacatctcaaaataagacatttatgtggccaagaaacatatgaaaaataaaagctcaacatcactgatcattagagaaatgcaaatcaaaaccacaatgaaattccatctcatgccagctagtacaaattgctcatattttaaaagtaaccagtatcaaattggaaaggatttgatttaggagccaaaccaaggctatcatagtggaaaaaaaaaaaaaaagaaaaaaaaagacagaaccttaacaatggatctgcagtgtggggcaacagccattgctcttaccattcggcttggctagcaaaatgtggccctgttagacaaataaagtcccttttttagtcaaaagaaaaaaatctctcccctttttattttgtgggaatttagacacttcagaggccttgttcccataaattggaactttccttcagatttcatcatgtcagatagagttgatcaaacccagtaggaaaaagactgaaacaataacaaaaacagaaacaattacaaaggcaacaacaacaacaaaaaaaaacaattaagcaaaacaaatgaatattacaatttatatgaatactgagcactctaatggtaaagataaattaacaccagctgatttttaatcttaactttagcccaca

SEQ ID NO: 219713 - DNA, 674 bp, Homo sapiens
tttagtgtgtttgaccactgaggctagctgggaggtgggagcctggaaccccaactaatgtttgctcaggacaagagagttcacaaaacaagacacattcacacctcataatcttatgcaattgtcccacggcctggtgattttagcaaggagataagtggatgtcagaaatgaacgctcgagacactgctgggtgccggttccacactgacactgtgctccttggtttaatcaactcatcagccttttggaggctgcagcttttgttactagcattttgctgctgtgcaaaccagcttagagaggtgaactgacctgtcttaagtttgcacagctaagaatggcagaagctggagtgggagtgagaaggggaactgctccttctgaacacctgaagaatatttccctgcaggctgggcgaggtggctcacgcctgtaattccaacattttgggaggctgaggacggcagatcatttgaggtcaggagtttgagaccaaccccgggcaaaatggtctctactaaaaaaatacaaaaattagcctagtgtggcggtgggtgcctgtagtcccagctactcaggaggctgagacatgagtatcacttgaatcacagaggcggaggttgcagtgagccaaggtcgcaccactgcactccaacctgggcgacagagcg

SEQ ID NO: 219714 - DNA, 649 bp, Homo sapiens
ctctgagggttacagctctataggtaaagtcatgccacccctaggcctacatttcaactactttgccattgggagcactccatctggagttcctttttaccagtttttttcattccatgctgttctactaattcttccgtctttcgtgtctttgctatgtggtgggctctactgcttgtaacttgaggaaaacaatcaaacattatttttactttctaggagggtgatggagaggttaactatcaaagtttatgttttattttgcatacctgaattttacaaagtaataataaaccagttccaacccagctgttgttaggacattttccatatctataaatcataaatgtttcaaaactggtgtcattcttcttgttagagactgaggataagagtaggtatgaaattttgtgagcacaggtgatattttcctcatccttattttccacatgattggaagaaaagagactgaaagaaaaccctatgtactaaccaaaattgtttccttaatgtctctgaaaatgtacgtgcattttcaaacatgttgaagaaataaaagatgaccacatctccgtagcaactcctttataatattaatattctttccttgttcctcttcccaacatgtatgtacccacagaaagcctca

SEQ ID NO: 219715 - DNA, 408 bp, Homo sapiens
gtaacgaatctcactgatcttcttttcactttaaataggatgggtattgtctcctctttgtctggatttctgcataaagggctagatgaagattattgtaggaccagcagcttatacagctttgaaaaagtgacaggtctacgtgtgtaagtgacagtgtgttccgctagtgatcccagggaggatgaaatggaggtgtggtgggagatgcttcacatttagtagcatctagtagaaggcatttgttttgttaattatttttatatacattacaggagaattagaaaatgctgaaaaaacaaaagcgtacaaacatctttaaaaacaaagacattgtatcatgttgtaaatactgtttttaaaacctttttaaatgtttaaaaaattgcagatatatagaaaaattga

SEQ ID NO: 219716 - DNA, 414 bp, Homo sapiens
atgctgtgtcaccacccaactagaaaaacccatcggaaaccccaaggtcacttaaaatctactcttttcctgattttcgaaaatccaatacattgttgttaactctagtcattatgttgtacaacagatctcttgaactactcctcctaactgaaactttgtacttttgaccaatatctccccaactccccccagcccttgccctggtagccaccattgtgctctctacttccattagttcaacctttttagattccacaaaaattaatttgtgaggtagtgcatatgttaattagctcaatttagccattccacaatgtacacatatttcaaaacagcatgttgtacacaataaatatacacgattcttgtcagtttaaaaattaaaataaatgaaaataaaaattaaaccaa

SEQ ID NO: 219717 - DNA, 530 bp, Homo sapiens
gtatcctagaaaaacttttaccccgtgtgaatgggaaaacatacagcaatgtaaatgctgcattattttgaaatactaaaaacttaggataaattccatataatggaatgcttatgcaccaattaaaattagagctacaacacaaataactctcaaaaacataagattgacaaagaaaaaggaagctgaagcaggttatatacagtataccatttatgtgcttttaaacatgaaaaattatattgtttaagtgatacattaggaatgcaaaacattcaagttttagataatggctacctcttgaataaaggggatttcagccatatctagtatttattttttaaaagtaaatatgataaaatgtttccttttgtcaaaggtttccttttgtcaaagctaggtgttttccctatactctttatgttcaaatgtgctttagtgggtaacagagagtcatcagtaacctagtcttgaaagccatcagttgcagtgggttctgcctataaacccagaggtgaatgcaaagcaaa

SEQ ID NO: 219718 - DNA, 377 bp, Homo sapiens
ctttgcaaaaattatgacaatgagaaaaatctgacatagctgacaccaatttgcttctaacttcacaagctaacaactacccttgcccattctggagcataggccaagctaactatgggaggaattagtctgtagtttaaccttaaagtagggatgataatagcccttcccaaaactaccccttcattgtttgaggactgacaccgcctttgtaaaactaatgaaaggcaacaaaattagaattatgggagaggcctgaattctgctaagatgtagccataaacaataaccaaccacggttccagaggtcagatttgtatcttccccacttgctcctgtagataacatcactattattaaaaccttggttctgttta

SEQ ID NO: 219719 - DNA, 576 bp, Homo sapiens
ctgggcgcagtggctcacgcctgtaatcccagcactttgggaggccaaggggtgcagatcacctgaggtcaggagttcgagaccagcctggccaacatgctgaacccccccccatctctactaaaaatacagaaattagcaggcgtggtggtgcacgcctgtagtcccagctactcgggaggctgaggcaggagaatcgcttgaacccaggaggcggaggttgcagtgagcccagatcatgccactgcactccagcctgggcgacagagcaaaactctgtctcaaaaccaaccaaccaaaaactaaaagcctctcgcactcccgtgtgtattgcagctttattcataagtgcctagatgtgtccgtcaacagatacatggatagagaaaatgtgtacatacgcaatagaatactatccgaccttaaaaaaatacatatcacaaatccttatcccacccccaacacccaactccctatccaacttaatcactcgcacacactatctcatgtggccgaatttcgagctaacttggcctcgccctaaggcgagccgattacttcactgcccgccgttcc

SEQ ID NO: 219720 - DNA, 438 bp, Homo sapiens
ggtgctgggaaagaacggtgagcaaaaccaagtaagatctttgtgctcttaaaacatctatggtggtgaggagattgaaagggaagagaatagacactaaaccagtagccagtacatacggaagaattccagatgctgacagtgctctgaaggctctgaggcagctatgacggaggaccacaggggacacctcctgggacagcagcagcaggggagcccagacatggaggaggacagctggagtaagtgtttcaggcacacaggacaaaagcaaaggccccaaggcagccagcggattggctgttcaggcgcctgacagagagccagtgtggacagagcatatgcgagggatggggaaagtggcatgagaggaggccgggtgatcacagcaggttttgcttgtatatgcagtgcagtgggaaaccactatcgggttta

SEQ ID NO: 219721 - DNA, 329 bp, Homo sapiens
cccagactcttggattcccagctcgagagtcccagaaggtgcactttgaaggcatgaaaggtgcaggcatgatgaagttgtcgtcttagcgcctgcagctgccgggtctgcacagcaggaagaaggcaggccagcccttgcaggtggggccaatctcctcctagactgatgagaacttaacaaaggttttctgtgtcttggcgaccccagacacatcaacatagagtaaagagagggctggactaaaggtttgtgagcctgggttcctaatcctaattctgtcacaatcctaattagccccatgattctagaggcctctaaactgatat

SEQ ID NO: 219722 - DNA, 740 bp, Homo sapiens
aagtgatgtaacattgccagcagaagtgaggttcatgcagaaaacattcctgctctttattttaatcaataacctcctgggtgaatgacatttccaccttagtgatttaaaatcagaagaccaggggatgtccgtgcttgtgaatcacccggggttccaggaacaaagaaggcatttttgttttttgtaatttccccttcacactacaaacaactgggctctgaagttgatttcatttagcagtcaacttctgtctagaaaaatgtgcacaactgaaccgaacaccgttcttatttaaatcggcaagcgatttgcttcagctgccatctgttggccggttagctattttaatttgatgctggggacattacctgactttgtatattgcattttgatctgcatcatgtttgagaaatatctgcaaatgactctaagggagaggactttgaaggattctatcgaacaaatatgtacatatgtttagtgccgtgctgggcagaggagtgtgggaatgtaccagcgtgtatataagacagtgtgcatcttacctaataatctttatggccagattgagaataaatttttcgaaattttctttcttccgcatttccaactgacccttatttaaaagtcattaatgttgagctctctcatggtatctttatccatttttctaaagctgcggtttctcaggttatcaagtttataacccttgtgagcaagtcacggatggtggagga

SEQ ID NO: 219723 - DNA, 776 bp, Homo sapiens
tggtgctgagaaacaggaaatacttcttgagaattatgactgggaaaggatttggggtatgattattggcacatggaagcagaaatctaactttgtgagggaatttacaaagaaacacaagccaggactaaaaacccctttcattgttcaggtgaggaaacagctttgaggaggaaagaaaatatatcagagagatacctgcaccctcatgtttattgcagcagtattcacaatcgccaagatatggtattaaaatgtgtccagcaacagatgagtggataaagaaaacatggtgtacatacacaacggaatagtattcagccgtaaaaaatgaaatcctggcattcacagcaacatagatggaaatggaggtcattatgtgaagtaaaataagccatgaacagaaagttaacaccacatgttctaattcatggaagctaacaaaagatctcatggaagtaaaaaacagaatagaggatactagtggctggaaagggaagagaggaggaaaagacagatttgttaaaggacataaaattaggaggaacaagttatagtgttttatggcactataggatgactatagataacaataacatattttcaaatagctggaagagaagatattgaacacccccaacacaaaggataaatgtttcagatgatggatatgctaattagcctgatctgatcactacatcttgtttgtatggaaacatcaaaatgtacatgtgtataattatgtattgattaaaaataaaatttttttaaaatta

SEQ ID NO: 219724 - DNA, 366 bp, Homo sapiens
gaatagagcgcttgttgaattaaaaggaaatgatttttgttgtcactttggtctgatggaaaaggaacacctgatgtgtgtctgtctccactgcacagacactggcatagttcttacattccccaggaatgagaaggcttggttcctgtccagaaagtgtttgtgatgtttggctctggtaggtgtgactggaaacccgttttctcagccatattctccgtgtggcatggctcgctgtctgaacctagccttgtggataaatatgtctagtggatagatcatactttgctgaaaaccaggattccttggttcttttgcctacagcttactgacttgagtcattttttacttctttatgcaagaatg

SEQ ID NO: 219725 - DNA, 494 bp, Homo sapiens
tctggtccttgaattgatctctgtgactaagacatgctgctctttatctttgtttttccaaaagcactttttgtgtttagagagttaaacagcatgatattttcttgtattcagaaggatgatctagtagtcatttgacatttaccattgcttttgaatacaaataacatccaagtgttttatgaaaagaggacactgactatttctatcagtgatttaaattaaacatctggttattacgtctcatccactccctgattctaagtttattgaaatttttttgtatttatatcagtctttattatttcacatccaatttggtctacaacatttttatatgtttgacgcggagtccagaagcagcatgttttgggtgtaacagctgatgtgtaaaaaactggtctgagcattgttatagcaatatacttataatggttcttttattctttttttgttaataagaattaaataaaatctaattgattttaatagat

SEQ ID NO: 219726 - DNA, 552 bp, Homo sapiens
attgtagaggatcttcagggacaggctctgggcatttagtgaaagggacagcgattcctttgcctatactctggtggtttagaaaaggacctcagggaacatttgttttgttttgttttgttttccttttgattaaggcatttggggtctagaaaagaagattcaagcaggatccatttaatttatttagtttgcctcacagacatgaagcttcagaatggtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggccctccgaaccaccacagccagtcgactctgaggccccctctcccaccccctcacaaccacacgctgtcccatcaccactcgtccgccaactccctcaacaggaactcactgaccaatcgg

SEQ ID NO: 219727 - DNA, 318 bp, Homo sapiens
aatagggtgaggctcaacatgagcacttaataaatgctcagtttaattgtggtaattgtaattctcattggtatatatttatgtcctgatcctatacctctgttattaatgagactgataataggtaagtgaagggaaaactcggcccttaccctgactgactctgacaacgaaaacaaatcagatgatgagaacggccctccgaaccaccacagccagtcgactctgaggccccctctcccaccccctcacaaccacacgctgtcccatcaccactcgtccgccaactccctcaacaggaactcactgaccaatcgg

SEQ ID NO: 219728 - DNA, 347 bp, Homo sapiens
cagcttttaaataatttcagttagggggttccttttaaccctttgggtaggtaacatactgggtaccccaatatgttacctactcccctcttccatgtattttgtattttacgttactaaataataatagttacaagttagagaccgtttctatccacagttcatatctgtaactatggtccaaaagtgctaaccccagaataaaatgagtgatctggctaaaggaaaacatcacatggtgaactgataagaggagcttattgtgaaagtctctgaatatagcgtagtgccaaaacattgtttttcaatgtcaaaatagagttcactggaaaatttggagctgaatt

SEQ ID NO: 219729 - DNA, 551 bp, Homo sapiens
tgtgtatgtgtgtgtgtgtgtcgagacagagagagaaggggagagagagatttgttataaggctttagcttgcaaggctatagagaccagcaagatctgcagttgctaaggtggagacccaggagagccaatggcacagttccaatacaaatacaaataaccagcaggccgaagacccaggaagagttgggtctgggaaaagatgttttagtttgaatccgaaggcagaaaaaagccaatgtcccagctcaaggcagtcaggcaggaggaaatttccgcttacttggaggagggtcagctttttttccctactcaggtcttcaactgattggatgcccaccccccaccgccatatcagggggaataatctgtgttactcagtctactgattcaaatattggtctcatccagaaacaccctcacagacacacccagaaaaatgtttgaccaaatgtctgagcatcccatggccaagtcaagttgacacccaaaattaaccatcacagtctaccccttgtcaacttggcacacatatacatctctttaaacca

SEQ ID NO: 219730 - DNA, 665 bp, Homo sapiens
aagaggtggggaagggtactggggcagagagatgccgatcgatagaaacagcgaggagagacggagagagaccagagactcaagggcaaagagagacgaaggaccggcgggaggaagagagagagagacagagagacagactcacagactgggaggaccggagactcgacgcgaggagagacagtgaaaataagtgaacaaacatagagacacgggtccaagttataagagggctgagtggatcagagggtcagggccgggcaaacaggtgtcagaacagttagcaagagagaggcagatcagaaagggatgcagatgaaagagacacaaagaaggaaacgcagaatgggttcacagagacaagaaatgcagatatccagactcaagaggtagacaagaagggagagggacagaaacaagaagggagaaaagggacagaaattagagatacagtaagatggattgacagttttcgaagacctagagaaagatgacagcacgaagagagacagggagaatccgaggtaaaactgttaggaaaacttaggagtccagatgctgtccagttatatgctaccctgtacaggttgataggttgcaaatgctttctgtccagtgtatcgctttgtagctcactaagcagttttgtatccaactttgtgctt

SEQ ID NO: 219731 - DNA, 129 bp, Homo sapiens
aaacatgtcagtggctcagaaagaaaagaaaatttgtcaatacaatacgtattaattaaggtaaaagacctgacacgggatgggcgtggtagctcacgcctgtaatcccagcactttgggaggctgagg

SEQ ID NO: 219732 - DNA, 2228 bp, Homo sapiens
  misc_feature (1242)..(1242): n is a, c, g, or t
ggaggggaagatgaactaatataggtagtctgccatatgggacatattagaacagtgtggtaggagtaggccaggagagtgagctgtctgttcatgtaacttacttgtgccttaatggcacttatgttagaggaaataaagacttgattttttagtggaataggtcagatgcagctagttagttatgggcaactgttttttaattgtttattaagatgaactctctgtgttctgtggtcagacctttaatcttcatcaagatccagtagcaagtaagaatctatctagctgtttctgaaaaggacagtagttactcacctaagaagtgagaatcctaggcatccccattatgttctttttatgaaggcttgtatattctgtatagcaccctaatctgctgtagactctttgagtatcattgcatctgccagtttataacatgtataaagtatttcttgtttagagaatcctactttgagtaggattagagtaggattctctactcatagtttcaagcttttcagtttacttggtattgtgtcagagtataacaccaatatgtgatatgaaagtgttgggatgaggttcccacaagtatgtctaactctcttcctttgcacattttcagattcttttctttatattgtgatatagttttttccaattgttttaaagtcaggtttactcaggcaaaattaaaattatgtaatcaaatgcactgtgaaaatctaccaacacataatttaaaaaaattaaacaataagaatatcaaattccaacaattcctcaaattgggattatttcatacttactgcatttcacccaaaaagcaggttattcttgctgttgttactgtttttggttgcttttagtggaatgaagtgttgtctcaaatgtccttgcctatcattacacaaagcctccatactcaaaggcctttaattttttttttttttactctagctcaagcttcctggactcaggaggctttttgttggttagaacttcttagcatagcagaagtttcctgtagcccttgagtgactttggttaacttggttgaaaatttcccccaatctctacacctttcttcacccctagaagttgtttatctacctcataatcaaaacaaaagcatgcctttatttttaatagaaatttctagcagcatatgtaatcttagtcttttagctttctttccaatctggccaatttgggcgaacataaaccccagttgcttangtatgaatagggacttgcagtatgagggctgccattctcttccttcagccctgcctttcctgttatccttttgaattaatttcattaacaaaatgaattcagagggttttttttagctctctccagaagtctgaactccctcagcactgttttgccataaatagctatagcagtaagttgttccaaatgatcctgaagaaatctataaaatttaactggtacatatcaaatagagactgaaacaaatgaaatgatagctttatcctaatgttgtgaccaaatatcagataaattcacagctttatttcaatcccaataaaagttaaatattttttattgaaaatcaacataacactatcaaattaatctgaaacataaatgttgagaatatgaggtcatttttaaaaataggaacagacactgccaaatattaaggcatattttaaaaagacaatgtgttttttaaaaaatattttattcaaagtaaatttagaaattattaaaacaatatgatcctgaaatgataggaagttaacttgcagttagaacttgcagttagaagtaatcaattaacttgaaagaaataaattaaaaaatataacaacataaaaatcaaattaacttaaaatttttcaacagattaagaggctaaattaaaataaaatcttagaaaaagtaggagaaagtagaaattgatatttaagatatcaagaaaaggatggaaatcctttaggaataaatttgtaatagcaatgattcacactcacagcaatgatgagtgactcctgcctcatccattgtcctggattattgcttctttaaaggaacagaaagttatcacaagagagcacatcaatagattttaccgtacagagttctttgaaccaacagctatgaattttttctctgtgtgccaagcatagtgtctttctggcatgcattcaaccagtatttactatttgcttcaattatgttggaacctggag

SEQ ID NO: 219733 - DNA, 638 bp, Homo sapiens
tcacttcactctcatcaggtggctattttcaagacagacaataacaagcttgaataggatgtggagaatttggaatcttcacaccttgctggtggaaatgtaaaatggtgcagccactttgaaaaacagtttggcagttcttcaaaataataagcatagagttacccatatgacccagcaattccactcttggatacatacccaagagaaatgaaaacatacaacacaaaaaaacttgtgtacaaatgttcatattcataacttgtgtactatattacttactatagccaaaaagtgtaaacaatccaaatgcccatcaaatgaagtgtaggtaaataaaatgtggcatatcgtacaaccaaataatatttcaccataaaaagaaatgaaggtcaggcactgtggttcatgcctctaatctcagcagcactttgggagctcaaggtgggaggataacttgaggccaggagttcaagaccagcctgggaaacatagggagagcctgcctctacaaaaaatttaaaattagccaggtgtggtggcatgtgcctgtggtcccagctactcaagaggctgaggcaggaggattgcttcagcccaggagtttcagcctgtagtgagccacgatcatggtactg

SEQ ID NO: 219734 - DNA, 311 bp, Homo sapiens
cacatagtcgcacacacacacagaaggacacacacagccaaacacacagacaggcagatgcacatacagacaggcagacaccgacaggcagacacacacagtttcatgcaaacacaggcagacacacagccgtgtgcacacagacggacacgcacacacaatcgcacgcccacacagacacatagccacatgcacagacaggcagacacacacagctgcatgcacacacaggcgaacatgcacacaggtggacacatacaagcagatacacacaatcacatgcacacacaggtagacacacagtcgcatgc

SEQ ID NO: 219735 - DNA, 305 bp, Homo sapiens
gaaagaaagaaactttgtacttactgaacagcaaacaacagactatcttttaaacccattttactctgcttagttttaaatattgagtgcaggtgggagaactagatatgagaagaaccacctttttattattggaaatgaccaagggcattgttttggttaaagtaattttaggatgtttccattgaccattgatatcttacatacatttcctgttttaacttcggagcgagtcattttgaaggattttgctggactttcagaacgtgtgatttgttttaacggtgctctcgggctgccatatg

SEQ ID NO: 219736 - DNA, 761 bp, Homo sapiens
gactgcataactaactttcaaaatgtagctttaataatctagtggtaatatttaacgcttggtttatggagactagtctagctgtcagctgtttgaaatagcaagtatctttcattaaataactttacagaattcaaaggaaacagttgacatccagatactgagatttttcaacaccatttgttttatactatattaacaataaccttaactataaatttcagagctgtgaactttttaaattagattgactcataatatcatttatgtaactttctcttcaatgagtgggattaacaacctacataaactagattttgcattaaaggattttatgttaaactgtagctttatgaccaaaatttgtgaaaattatttgaacctggaaaactgctaaaacatgcttctatgtatttttccaaagcttagccatattttctctaccagtccaagagccctgacaggttaattataatcatggcttgtttcatctaaatatgacatgaaatgtgagctattaaaattctaagaattctgtcatatggttaagactgaggtaggttttttgtttaggttaattaagcacttctccctttatatgtaaaaacaggttgaatacaattatatgaattttggtaattattgtggatgagcatgttggtaacattatctctcaaatattaaaatagcaggccgggcacagtggctcatgcctataatcccagcactttgggaggccgaggcgggtggatcacctgagg

SEQ ID NO: 219737 - DNA, 535 bp, Homo sapiens
ggcacatagaaggaatccactatttaatagctattataatagattaataatattcatgtattttgccattattttgcctcaacttgacttttgtattttaagcctttctcctctaccaggattaaaagaccttctgtatctgaccctcatgtagcagcaagcatgtgtgactggaaggaccccactatcaccctttgaatgaggctggtcccatggcaatagtcaaatggctggtgcagcccagtcactgccctggcactaccctgttgtagcaaatgctggctgatgaactgttctggtacattcccgctggaatgtcagagtgtcagagtggtggacagtccagggtgtctcccctccttcagctgcctctctgtgccttgtaagatgaagacaccagaagcctgcctaccttggctgcaggaaacctagttccagaaaagagtttttgaaccaagtgcccttctcttccttgaatgaatcctctttgtctaacctttctggtaagatattaaatgctggttttgtgcttgca

SEQ ID NO: 219738 - DNA, 396 bp, Homo sapiens
aaccctttttatttcagctgatctaaataattagttcagatttaccctgacaaatggcttttaccatttttagtttcttaccctgtaacaaaatactgccatcaagttttgattatgaaaatggctgaaggcaagggaccatatgagagagcgcaatcaacaacatagtctttttgcccaacagaattggacatttttggcttagagaattaaagcacaatgactgttcctgaaaatcagtacagtagtcataataaaacttttttcttggctgggcacagtgttgcatgcctgtaatctcagcactttgggaggttgaggtgggaggatcacttgagcccagatcttgagaccagcctaggcaacacagtgaaacctcgtctatgctaaaataaa

SEQ ID NO: 219739 - DNA, 777 bp, Homo sapiens
ccacattcagcttgggtaggtaccttcatagtagctcatggattaattgtccactgcacccaatcatagtcatttttggtttgggttgtcatatgctccccaatagatgaagaagagaataactcttagccgacttcatcagcaggtagggagagagtctctgatggagttatatttcattattcctcacaattgcatagtgccctcttacctcaaaaaaaaccttcccaggtgttttcaaaggaattattttattcctccacaacaagcctgtgggagtcggagcaaaaggcaaagtgattacctgagacattagataactcgccaatattcaccctgctaacaactgaggggccttgggcttgatctcctgcttccgaatcagggcttttcctgccatcttgtcatatccaacccattgcatctgctcatgcactcaagtgaaaggaaaaaatgactaggcaaaatggacacatcttagaggtggaattaactctttttttatgttgagggatgtttctggcaaggtaactagcaacgtggcctgcacttatagttgttcctgcatgggtgatgaaagagatgctataaaactaaataaaaccaactgcctccaagggagggatccgttgactggacaagtgttattccaaagtctgggttattatgagttgcaacgtaaaacattacataagaagatttgaaggcaatattctgtgctctgaatgctgctcaaaagaaaatacttttattttaagtaatattcttttgatgatc

SEQ ID NO: 219740 - DNA, 316 bp, Homo sapiens
gggaatgtcgggaggggcctctcgggggactcggccgcctccagccctaatccggctcctctgggggactcactccggggccatcgcaggagcctctgcattcgggcgcgggcggctccctgactccatcccgagctggaagggccggagccactgcctcgcacggcggggtaggaactccgcgtcggcggcgggactggtgcgtccccgccaagccaggctgtccccactgtggccagggcgcgggcagagccgccggtgactgtggcgcccaaacctcacggggacgccctgagcacgggcccccgggacggtc

SEQ ID NO: 219741 - DNA, 664 bp, Homo sapiens
ccaaatttgctctcttatggccgggcctgtattggagaaatcctgttacagaaacaattcaaaaatgttgatgttgtcctcaaccaatctatatgttttaatatcagagttcaagcacttgcttcacttgtattttaaaagcagccacattttctgcacacacaaaaagcttaaattgttcaaatgttaaatcattctaaaaggcataccaaccaatggaaatcagattgcaaattggcagactcaaccagcaaatgtgtttatgtgacccacacagtatttttaaaacatttagttgccaacattgtcagatgtggaaatttcacatcaaattccaaatgtccatctcttcttttgaaaaactgaagactatggcaccatcaggcccccatttcctagtcagagccaagaggtggcatgtgtttttccagcagtttaactgaagaatgtgggttgcctttttggtactttttctccctcaaataaatgagctaaataatgaagctcattcatagatggcttacacatttgcctcccttactatcatcttaccatgccatcaataattcaacacggaacctaattgaagcttaaccaaaactgtgtataaaccattggccattaactaaagagaaagttagataaatttctatttcttattaat

SEQ ID NO: 219742 - DNA, 437 bp, Homo sapiens
tgacagatgctccaggttcacatccaagttttggggggttgagagcttttccatttggatgtccttctttaagaacaagaaggtaaaattgtgaatacggaatgagatatggggtcttggtggggcccatgccagcaaggggcctgaagctcctcattagcttccgatgtgggggtgggggagtagaagtgggcagtacaggaggaagtgacaagaattctcaggggtggggagaactgtgtcgaaaataaacaaggaagtgcaacaggaaatgactgggtggcttcttcaggctgggtaggacgctgctgaatttatctgataaaaatctcctctctgtgagttgtggaaagtggcttgctgcgagagacccccttcttccccacataacataggtaagagtgatagaagtgatgcagctgggcgctgtctccaaa

SEQ ID NO: 219743 - DNA, 441 bp, Homo sapiens
gactgcagtggtctaaattcatacctgcagtatctccaaagtgtgcctgtagttgagattggagggtactctaaacaagaattaggtaaatgtgtgcatactgaacacggagccagcagaactcttccccactgggtttccggaaccctaccatccaagccttcactctccaggtggtagtttgaaaataagtcttctaagggaaatttgagtagcccaagtgatagaaactaaggatgatgagttgagggtaccctcaattctgcccaaccatatcaatctacaagtaaaagataaaattgagaaaaatctcccagaaagaatgaaaaaaatggagatggtaaataagaggaaaaaaaacaataaaacccaagataatcaaatgactagttttggcagcagtacatcttaataagagaaatatcaggaagggagaacaga

SEQ ID NO: 219744 - DNA, 456 bp, Homo sapiens
tcaagttttatttattttttattttagattaaaattattttatttttataatttttattttctttttaatttttgtaggtacatagttggggtatacatttatggaatatctgagctattttgaaatagacattaaatttgaaataattttatcatgaagactagattatacattatgccaagcattttattcattgagtagcaaacaacccatttactctcttttgttacttttaaatgcacagctattattggctataatcactttgtgtgctatcaaagagtaggtcttattaattttttctattttctttttatggcttaaacatctccacctcctgatcagcttcctattattctttccagcctctggtaaacagccctctactcactatgttcataagttcaattgctttattaggtttcacaaataaagaaaatgtgtaatgttttgcc

SEQ ID NO: 219745 - DNA, 778 bp, Homo sapiens
ctggatcagttccaccctatacattttctacttctgcataaagcctactgagtgatgctgtggaaaattataaactatagagattgggtatgttttcagagtcttggtacctaacctctttggacctttagtcctacttaatctgtttccttttccttcactttccccttagcgacaattttaaacctatatcattcttcaagactctcttcccccgctacactccttctcttcacacttctcagacaagctcctttgtgatttcatcaagaaaaatttggccatcagatgtggattactaccaagtatcttggtttaactaaatcctcctgtaaccctgagttctcctttaactcctacattctccccttcccttcttaaccaagttatttttaaaatgtagtacactcttactgtctccacttattatttactcaactcactgccgttctttgggtgcttattccctcagccttcacaccaccagtctaccacctcactgtaactactactcacagtggcaaagtgacttctaaatttgtaagtccaatgaacatctttatttagctcctttgacatcactctctcctgttcattcttataatttgctgtcctttgctttggtggacttttcataggctcatctttctctaccatctttctttaaagaatggcattctccagggttttatcagtatgttgctattcctgtgcccacccatacattatcttcaggagatttcatccactctgattattttgactatccacccccgtg

SEQ ID NO: 219746 - DNA, 346 bp, Homo sapiens
tcatcttgaccagatcacatggctaagaatttgcaaatattaggttggtgcaaaagtaattgcagtttttgccattacttttaatggcaaaaccatgattacttttgtatcaaccaaatagttcttagatttgcaatgaggagaagtggtagtatcaagtgtggatgagctctgacaagaagaagcattaatgtctttgctatagtttggatatggtttgttcgtccgcaccaaagctcatgttaaaatttgattcccaatataatggtattgggaggtgggtcctagtgggaggtatttgggtcatggaagcagatccttcatgaatggcttagtgttgttcttg

SEQ ID NO: 219747 - DNA, 419 bp, Homo sapiens
gtgggaactctctgtagtaccttcataatttttctgtgaatctaaaactattccaaaataaaaagtttatttaaatttttaaaagactgacatattgtcacatcgactgaaacagagttccctgcgtcaatcaatacctctttctctctttcccacacacgcctatctgccaaaccatatggcaaaaagagtccttttcctgaaacataagaatacttaatccttcaagccactgtagtatgaatggaattggacttattctgaaagttttagatttcccaataatacctaggtcatgccctcagtaatatgggacaaatgctcaaaagagaatgtcaataaacctgtatttcccaaaaactttaaaagataaaccatccttcaactgcatttccaataaacttatattttgtgtgagt

SEQ ID NO: 219748 - DNA, 569 bp, Homo sapiens
gacacttccctgccttctctgctcctattattttccattgcattggaatgaatctctcaactttgtttctttaaaagtaaatgtttatgctccttcaaataatttttcaaatccttaaaatgttatatattagaaaaatatacatgtaagttaagatgaaaacccagtggctgactcatatctataatgtgtaacaatgttgtcatcctgtgctccctctttcacacctcacgtctttaaaaagttgtcatttgtcaattttctttttgatgaatttttctttttttttttttttttttttaccaaaagaagcaatttcaaggaggaacattacttcgcttaaggaataatgaagaaatcttagtgatatgttgtaatatttaaataagaaacaaccggatgaaaaaatagtttatcaaggcaaatttgctgtttggaagggacacccagaataatcagcaagttttagagaaaaagggctcaaaaaatagttcattagcttaatgacaaaatacaaaatgtttgattagttgtaatccaacattttttaagtattttatcaccctttc

SEQ ID NO: 219749 - DNA, 505 bp, Homo sapiens
atggaatattatctggccattaaaaggaatgaagtgctgatacgtgctataacatgggtgaaccctgaaagtaccatgctgaaagaatcgagttatgaaagattacctattgcatgatttcatttatataaaatgtccagaacaggcagatttatagatctatagacagaaagcagattagtggttgcttgggcctggggaagagggggtggaggaatgaggagtgactgttaatgattcaaggtttcttttgcggatgatgaaaatgttctaaaattagattatggtgattacacaattctgtaaaatatactagaaaccattggattgcacacttttttttaaacgggtgaacttttatggcacgtaaattatatctcactagagccgttaaagagcatgtgagtttttactgactgtgtgtgtgtgtctgagagagagagagagagagacggaaagggacatagggagatggagagaagactgagagatgagacgattatat

SEQ ID NO: 219750 - DNA, 453 bp, Homo sapiens
actgctttatctggtcccatcagttttacctctgaaatagccactttgtttctatctctcctttcttttcacagtttgagtttagggtctcttcgttatatggctgagaaggtattgtaataccttcttaattagtctgcctgtttttgtcaatattttctatttctgcatcattctccgaagtgttcattaagttctgcagcatagccagatgctgcttctttaaaacattgttttaaacccattttaaaatattcagtgtcttccttcaactggtgaaataaagtcgaaaacgtgagcataccaaatgcagcccttcaaaacataacagtaccatcagtgtccatcctcagttttgaactccctaccaggcacgcctataatcacgtagttttgaaatactcactggagagattgctcagtttttctctaagtgcctttgtgtatactgtt

SEQ ID NO: 219751 - DNA, 883 bp, Homo sapiens
aaaaagaggcgggccttgaccagaggacccagtgtcagcactgatgtaccaggtgagcttagggcaagacccagcgacatcactggatgacagtggattctgactatgtggctgttgtgatcactacttggaaataaacacaagacagtgaagcaggcctcaatcccacatagttttgaaggttccttgtcattttctgggagcccctgatgtgtcctattcctcagagagcttactcttccccactcttctctgccctaccaggccaaagggtctttctcttcctttatccctccaccccatttccttccaccaccacttcagtcaaggagtttttgtatcagaaagttatcacaggccagttatggtggtgcacgcctgtaatcccagcactttgggaggccaagctgggtggatcacttgagctcaggagtttgagaccagcctgagcaatatggtgaagcctggtctctacagaaaacacaaaaagcagccagacgtggtggtgcttgcctggagtctcagctccttgggaggttgaagtgggaggattgcttgagtcctggaggtcaaggctacagggagatgagatggcatcactgtaccctgacctgggggacagagcgagacccttttcatgccccgggacatttgctggtgctgtttcttctggttggcataccctttctgaggactgcccaacttgtgctctgagccaagggtagaaggagatgtggccttatccattcctccagcttttcccctaccctcagagctcttaggcagtgggtatggcaccttggaagctgcagcagggtcagggcacattgagtgactaagcatagcaagtaccaggtggacggggcagaaatgccagaggtgg

SEQ ID NO: 219752 - DNA, 451 bp, Homo sapiens
ctcccacaggcaagagcacatcctactggacctgaggaagaaaatgatctgtccatacccactgcctggagaatgatctgttgccagaagctggatgacttcgggcctagccaaatgccaagctatgctaagggaagttggggttcttgtcctggaaaattgcagaatggacgcagagatccattactgcgcgcggcggggaagaggacgccgccgggagctggtgcgtgacacactgcagcctcgcgggctgcccgggacttcatcaagcccgggtcggctcggggcgggcaggggtaggatccataccgccgaactgcggccccgctgctcgcagccgctcttccgggagcgcccgcttaggactcactcccgcccattccttacctcgatggaatccttagcccttagagagagggctaaaaaacaaataaacaaacaacagacaaac

SEQ ID NO: 219753 - DNA, 711 bp, Homo sapiens
atatgtatcttttcaaatgttaaattataagtttggtttaaaactttttcaagctatttaaaagtaaataaaatctaaattagagctaaactcacaaacagaaaactctgagaaactcaactgaattttgttttaaggctgtagtgcttataaaatattctgtttttggaggttgtatggtaacaaagatagattgttgtatagtaacaacaaagatgaggttgtataataacagcaaagaaaggaccatccatttttcttataatattttaaaatattctgttctttatacaaagactagcgttttccttttatttttttgcttggcatcctgaaaggaagttactttccatgtcttttttttttttttttttctcactactttgctgattaagcagtggctcttttttccccataataacatccagtggaatgattggttctttgcattcaaagaaataatattacaataaaaccccataaaagaagaccatattttacatagctacctaagaaagatatggtatgtgactaaatttgtattaaagtcagaattccaataatattaaataattacaataaaattaaataattcccttctttggaaattaatttctgcacaaaaatcccagtgtcagtctctgtctatgtattcacatccagagctgtgttctatatatgtaatatatgttctatgtatgaaagttgagt

SEQ ID NO: 219754 - DNA, 258 bp, Homo sapiens
tatgtgaccttgagcaaaggaggtcccttttggatcttagtttcttcatctctaaaataagaaagttggactggatgatctatgagtcccttctagcttaaaaaattcaatgaggcagggggctgtggctcacaccaataatcccagcactatgggaggccaaggtgggaggatcacttgagctcaggagttagagaccaacctgggcaacatagtgagacctcatttctactaaaaataaaaaaattgtccaggcat

SEQ ID NO: 219755 - DNA, 523 bp, Homo sapiens
ttcactttttgtattattttatgtatactctatgatgctaaaatgcttatgtcaaatggaaaattattttatcaagtgacttaattgtcaatactatctaaaagttataggaaatattttaaaagcttataaaacaatagttgtatgaaaagctccttgtttgtatgccatactgaggtgtctctttctttggtggagttatggcaggtgaatttcaatattttttaaatttttgaataaaaataagaaatttttgtggggctggcttggaagtgctttgtttacaatggtcacatttaaaaatcaatacagttcattaagatagtgtcttccattttctgcttctatctcaatattgtgaatggtgattaaaaggaatagatataaaatcaaattaatgtttcattcatttcaactatagtattgtgtaatagtcttatatttgtaaaaaaaacacagcttgcaaaactatattttacaatgtatgttttttaaatatcttaattaaattggattttaatga

SEQ ID NO: 219756 - DNA, 514 bp, Homo sapiens
atggcctctcgctgggctgtgcagctgctgctcgtggcagcctggagcatgggctgtggtgaggccctcaagtgctacacctgcaaggagcccatgaccagtgcttcctgcaggaccattacccgctgcaagccagaggacacagcctgcatgaccacgctggtgacggtggaggcagagtaccccttcaaccagagccccgtggtgacccgctcctgctccagctcctgtgtggccaccgaccccgacagcatcggggccgcccacctgatcttctgctgcttccgagacctctgcaactcggaactctgaacccagggcggcagggcggaaggtgctcctcaggcacctcctctctgacggggcctggctccacctgtgatcacctccccctgcttcctgctgctgtggcacagctcactcatggggtctgaggggagagaagcacaccaggggcgccctctgccttccataccccacgcttataaaacataactaagccaagagtggacat

SEQ ID NO: 219757 - DNA, 474 bp, Homo sapiens
gtgtaaatgctaactattggctgttcattatttagggttttgtaattattttcttaaggcaggattacttagtctcagcctcagccactgaacactctgcaagcaagtaacacctatttgccacctggtgacaaaagacttggccaatgataagatctccctggttgcttaatggacctcatacctttattcagaaaaagaaattaaaaacacagcaaaagtaaaaatgctaagcaaaatccagttttaaattattttgtttattcacaagatacatacagaattctttatttttcttgaaaaatatttaaaatgtaaagaatatgaaaacattttaaaaatgaattttaaagtactttattgattcaataaatttctaacatttaaaaaaattcctatgtatcaagcatatcactaaaatgaaattagtttgcttaaattgctatctgtattgcatagtaataaaagctgaaa

SEQ ID NO: 219758 - DNA, 442 bp, Homo sapiens
tgaaatagtagttttgagacaagcatggtggcaattgagagaagtaaatggatttgagacacatgtaggagatagaatagataggacttgctggatgtgagggaaggaatgcatttaggagttagagattagaggaatgagttggagatttaaatctgaaagacaccaacagcaattaagaaaaccttggggattcgttatttactaaacaagagtgcttactatgtcgtagacactgttagaggtacccaggtacataggttccaggtacataggtgtgctccaggggttgaggttgaaaaggcagaaaacagtttaaatcattatcttggggagtagggagtaggataacacctgccctcatggaacttactttataatggggaaatagactgtaaacaagattaatacataaaatatatattatatgattataaatatt

SEQ ID NO: 219759 - DNA, 348 bp, Homo sapiens
gcagctgctgccgggatccaacggaaccaaaaattcttatgatggtgctgggttgaagcatgaaattcatatgtaagaatggtaccttttgctccagcgttggaacagactgtggctttttttttttttttcagttgagcatgaggtgaagtagttggcttatgttttggggccaggagtctcttgaaactctccacttacttgtgctcaaagtcccagaggcatttaggaaatgcgaggcatttaggaaatcacagccacattcactacagtcctcattttgtggaatgacctgggctatttctattgttttatttatcttgtttaaaagaaaattactgaatgagt

SEQ ID NO: 219760 - DNA, 891 bp, Homo sapiens
taaatttgaagacatgtttttatcacatgtaaagaataagacagcattgggagttatattacatagtcattttgtaaaagtagcatccacaatgtgatctaattagaatcataacatatccagcctgaaggtttaatttaaatatatagaaaaaaatggtgcttgaggcctacagtcacaagtacaatctccctagatagcagaggtggcaggacaaaaaagtcctgaaacaataaacaaacattattcatgcttcatagtgcttatgaaacatttggaagaaacagttgcgcacagatattgtttctgattcatgcacaaaacctctgtacctataaatgcagatatatatttgcacatcaccaactctaggctcttttgtcaacacaacttttatatcttaagtaggcactgtgaagaaacaaacacacacacatgcacggatgcattcttgagctttctctgagtctgtgttaaagaagaacatgtcccattactcattttctttgaagatggatgttctgaccccaaaagagttaggcttataatttgcattcaacatctagtttcttcttgttgaattagattcacagtgtctatttaaatttgccaaatcagagtacaatagatgttagtgcagacgaacatcattatatagaactctaataagaaaactgatgtttatgaagcaaacaaatcatttcattaaaaatctttgctgtaaaattcatgtaaataaactacttaaaatatttctttaataaaaattccatgtttcataagattaactaccatgttattaccaactgttggcttttggaaattttgtagtttcaattagattaaagtatcaagcagtgtacaagcctgaaatatttaaaaattttaaat

SEQ ID NO: 219761 - DNA, 424 bp, Homo sapiens
tagctgggtgtggtagctcgcgcctgtagtcccagctactcaggagactgaggcaggaagattgtgtgagtccaggaattggaggctgcagtgagctataattgtgccaactgtactccagcctgggcaacagttagaccctatctcttaaaaaaaaaaatttttttttttaagttaagaaatggcatgtgtagtatgggttccattgtaacaaattacttttctctcattcaaaatgcatcagatatgcacagatggatgctgtgactgaggttcaccagatgtcagcattggttctctctgggctggtattttgatggataaagtgtgctcctttatattttcctatatggcttgaattgtgttttgataagcgtgtattgctttagtaaagccagtcaagtcactacttatttaaaaaggc

SEQ ID NO: 219762 - DNA, 620 bp, Homo sapiens
cagcttcatcttgagccttgcaattcagtatagtccgtggaccagcagcaatggcattacctggaagcttgttaggaatgcaggatctctggtctcagacctattgaaactaggaatctgcattttaacaagatgctcaggtgatgcatatactttaaagtctgagaacttctgatttgttacttacaatttggagttgatactctccagattaattaaaatctcccctttgtttttagtgacctctataaacatccaaaagtaaaatcatctaggtcatttcagagtaatatgtcttctccaattggtaactaattgttcaaaagaaattgtggctaggcatgatggctcatgcctataatcctagtggtttgggaggccaagacagaaggatcacttgaagtcaagagtttgagaccagcctgggcaacacagtgagagcccatctctacaaaaaatttaaaaattagctggttgtggtggtgcgtgcttatagtcttcattattgttactatttttcccccataacataccggaaggatcgcttcagcctcctgagtgactgggagtactactaatattcagtgtaaatattattatctgaatagatactagttctt

SEQ ID NO: 219763 - DNA, 381 bp, Homo sapiens
taaatgaccagtgatgctgatggttgtcccttgaagcttcaggttcagtgtattgacaggatcagattatctacttaaagttctaagctgttcctaggtgatccattttaaaagcagctggtcttttgcatggcaactctagccttcagtctgtatgtaatgctagcaaagcacctttacctttgacaacaaacaaaacttggtgtgggatataactttgtgattggcatccaaatcttaaagcaaggcagaaaaccaggttttgacatattgttttattttattttccacacaattgaccacctgacagtgagtctaaaaccttcttgcaggttgctgagcagagttttggaagctaaagttggtggtgaatgatgcaga

SEQ ID NO: 219764 - DNA, 445 bp, Homo sapiens
gatttaaaaaacacatctttttaaacatctctgaaatagatcaggggaggcttgctatcactgttggccaaatggctttcacttaattgtctaggtaacatcatctacacttaattattatttcctaatgacataattggactattgcaatccttgagctttaaatcagcaaatcattacagaggaatgtaaggaatacaagccttggttgttacctgaaaatcttcggtaggcacctcccattaaacacagagagcatctgttcagatcttgcaatttctatggagaaattttaggaataatctcatcagtttattttgcatgtactttttgctgttcaagagaattataaatgacaaaattgatggataagtcctaaagagtaaacattgatctgggcataaattgacagtggtttttcatttttgtaatgtataatataagg

SEQ ID NO: 219765 - DNA, 242 bp, Homo sapiens
ggcttagagttatgtcaccaaggagtgtatgaatgacttcgggaaaacactcaagcgtcttctccatgacatcaaaggatttggtaaggatgaagaagctacaaatgtcaacaaggctatggttgagatggcaaaccaactttttctttttttcttttttttttctgagacggattctcactctgtcgcccaggctggagtacagtgatgtgatcttggctcattgcaacctctgccccccg

SEQ ID NO: 219766 - DNA, 301 bp, Homo sapiens
gattccagatgcggtcccccaggcggacagacccttgcccggggcgcaggaggaggcaggactggcatcgcggggtgggagccctggacctccgagcaacctcggactcggcccgaaaagcaacactctcatcaccaaaccgcagaattagaccccgatggagaaaatgggtcaggggatccattcccaccccacccctccaaatccagaccctccgctaccacagatcagcctcgaaaaaagcttgtgcttcaacaaggatggggaactgccctcgtggaattctgtggggaaattgcca

SEQ ID NO: 219767 - DNA, 520 bp, Homo sapiens
ttcacagcttcctctcctctaattctgaacttagagattttcttctcatttctaatttttagtagcttattgttctatccagtagagcattataaaagtcacatctgcatcttccaacttatggtacagtgatgggaatttggaagcacccctggagcaaagaggctagggatagcattaacatctcccaagacaagtggtataggggaaatgaaggaaagactgtggccatgtatatgccaggcgttaatacatcagagctgcctgtatttaatttaaaacttttgatgaaacttagtggataagcatctttgtcatattttgtcaataatacattacttgcaattatattaaaacttattctaaatacctgtacctttcttgttctgtagatgtgtagatgatgttgcttgtttgtcaaaatattatcttttataaaagaaagtcctgcttcttatcatgatgtatgtgacttaaatgattgtttcatattaaaactatttcttccttaatgtactgt

SEQ ID NO: 219768 - DNA, 404 bp, Homo sapiens
ttttagtagagacgggggttcaccatgttggccaagctggtctcgaactcctgaccgcaggtgatccgcccgcctcggcctcccaaagtgctgggattacagacatgagccactgcgcctggccatgaaaactcttttctattgaagaatgcagaataaatgataacagaaaaatcagcatttaatgactcagcaataactgacttaggcaagaatcaataaaagacactaaaacgactgagtgaaagattcttagagaacggtaaatgctgaaatctagaagatactgccttaaccaaactattaagccaaacctcaccaataacaggacagctgacaccgtgctcccctggtgtggttcactgaggacaacgctacctacttacctaggaagcactcttgcc

SEQ ID NO: 219769 - DNA, 149 bp, Homo sapiens
aaagtcagacagatttaaactggcatgaaacaatgtagggaaggcatatcagtacacttaaaaaacacttttatagttttcatctccatcctcaatttgatagccccaagctaaaaatgattcttataaacatctgcttcttgtgttta

SEQ ID NO: 219770 - DNA, 166 bp, Homo sapiens
ttctagatttgcatatttttcccaactagtttcagggttagttcccagaaaattggtaaccaagtaaatcttttaaacaaaacagttttttgttgttgttttaaatagggtctcactctgtcgcccaggctggagtgcaatagcgagtttacagctcagattactg

SEQ ID NO: 219771 - DNA, 582 bp, Homo sapiens
gcaaactctttaaaataggcagcactatgatgaaaatggtttctatcagtacatagaatctcccatgtcagccccagggcccatcaagcccaacctcttgtctctccgaagcagcccagaagaaacatttgacttgagcattagcagatgaatacttcttacagtcaagaggagggttcgtctgctcttccctgtttatatatcctttaggagatgaaggctcagttttccaagcgtgtctggttgccccctctacacacctgcagcctcttcccaaggcccatggtgtggaagatttggttctgaaaaccagactcagcgtaatgtggccacagaggctggaggatatagaaggacctgctattttggcacgacaccactgtgaccagcttgagaggtcatgggcatgtgttacatttcccacagaggggagaatcattcgcacttctgtactaatagcatacctctgcaaacacaaaatttaaatgtcttggctatggaaaggagattcagatcctgtttaattaattggatagcattctttcccagactataaccaggtgatgagggtggggaaatgct

SEQ ID NO: 219772 - DNA, 561 bp, Homo sapiens
agtagctgggattacaagcacacgccaccatgcccggctaatttttgtatttttagtagagatgggctttcaccatgttggtcaggtcggtctcaaattcctgactcaaatgatctgcctgcccttggcctctcaaagtgctgggattacaggcatgagacacaccatgcccagccaagaaatagtctttagttttcttagttatataaatagtagtaacatcttgtaccacattgcaccatatcttttttcatttaataagaagtattgaggctgggcatggtggctcacacttgtaatcccagcactttgggaggctgaggcaggcagatcacttgaggtcaggagttcaagaccagcctggtcaacatggcgaaaccccgtctctactaaaaacacaaaaattagccaggcacagtggcattcccctgtaatcccagctactcaggaggctgaggcacaagaatcacttgaacctgggcagcggaggttacagtgagctgagaggtggaggttgcactccagcctgggcgacagagcgaaactgtttcaaaaaaaaaa

SEQ ID NO: 219773 - DNA, 570 bp, Homo sapiens
aattttgcagctgagggggaaagacaacacgcttgatagtggtggaaaaagccatgtactcagccatctgttctctttctctaattccacgtagcatattgtgttctttccgacatctgtggagaaaggaaaacactgcagtgagtcacagactgcccctgtctctataggggagtgggagaaaaatttattcattctaatattttcataaaactttctcctataggtttatcagtctgacttgcaaattgaacacttaaatgaataaaaagaaaaccatctctttttttctaataaatagtgttcagctattttcacctttaactcctaaactattcaatagacatcatggctttatgaagccagggagtgcaagcctctccactcagtcccctactatcacaaaggagagacactgctatttagaattagttccatttcaactatacaacagagcagatctggcaaacaatcatgactttgagtgtcaaatccattgttaatctaagccctgtgatggcacggtccatgtctgtcctggttacttttatctgcaatgtgcctccctgg

SEQ ID NO: 219774 - DNA, 493 bp, Homo sapiens
gttttgtgtaactctccatgcaccaccatggatgtaagagtaactcaaataacaatgctcatttgcttgtcctctgcttcccctcagtacagtttaatttactttggaaatcttttatttgtaggtgtaaggacaaacgtagctcagcattttatatcattgtatgacctctgaaattttagatgctttacatcttattctatcttcttgtattagtaaatcatcaaaagttgaccatagatctcggaatctaaattgcctaatgtgtgcatctcagcacacctgtgtgtaagagagctagagttttgtatgcaggagaatggttcttgactgtaaatgatgaaaattccagaattcgttgtatttgatctcctagatatttttgtgtcctttgtttcagtgatatcatcatgtaggtgaaaattgtgttctaaaagccaaaactgactcattatagaaaatgaagagcagagaataaggaagcattgggttc

SEQ ID NO: 219775 - DNA, 420 bp, Homo sapiens
aagttagaactaaagaaaagggggagggtgctactggcatctggtgagtggagggagatcaggaatgccactaaacatcctacaatgcacagacagccccacgaaacacataattatttggctaaaatgccaatagtgtcaggtgcaggggctcaggcctgtaatgtcaacactttgggaggccgaggtgggtggatcgtttgagctcaggaattgaacatcagcctgggcaacatggcataactcggtctctaccaaaaataaaaaaattagctgagtgtggggcgcacacctgtggtcctagctactcaggaggctgagatgggaggatcactggagctggggaagtcgaggctgcggtgagccgtgatcgagccactgcactccagcctaggtgacagagtaagaccttgtgtcaaa

SEQ ID NO: 219776 - DNA, 593 bp, Homo sapiens
atcttttcacagtttggatgagagatgcgtcagaaaaaagcagaattaagatgactttaaggtgtttttctgttttgttttgttttaattttttttctgttttgttttgttttgttttgttttgttttccagagcaaatggaaggattgggtttccattactgaaagataagagttattttatttgttctgttttcttctttcaatgcatttgtgtctaggtgagcatgtgggtacacaggatcaatcttaaatgagctatttggttatttttttcagttatttgtaatcagttgtcctgtttccactgtgatcaagttaaaaatggtactgtttcaaattgtcttgtgtcattgtggcaatagtttagttttcagttttttccttaagttgcttcataagaaataaattaatctataactcctctttcatatcgtgttatcactaagcttgagttatatagggaaatgttctgatatgattaattcaaggatgctgaagagcaatgagttgtgtgtaagcagaaaacaaaccagtacttaactaggacatctgtctatgagagagaaaggaggtgcacattatttaaaaaaa

SEQ ID NO: 219777 - DNA, 400 bp, Homo sapiens
aacataaggcttgtaagatgtagtggaggaaatctgtcaaaaggtaggacaaaaagacaagaagtgaaaagtaaaaagaaaaaataaaaccatcagaagaccagttcaggaaaccccatgtcctaagaggtgttccagaaaaaaacagagaacaaagagaaaggtcttattaatgaactaattcaataatttttttttcagaactgaaagacaggagtttccaggtcaaaaaggcccactgttgtgatttaacaaaaatagggaaaaaacttctaacagattccagaggggaataaactaggtcacgtccaaaggattagaaacccaaataacttctcaacagaagcactgaaagataaaagacagtggaataatgtctttaaagtagaatatgatacac

SEQ ID NO: 219778 - DNA, 452 bp, Homo sapiens
acatcagaagccagacgcaaaagaattacatcgtatatttccattcatttaaagttcagaaaacaggctaaaacacagccatattattttgaaatgtgtggcaatactattgtttatcaaaatctgttctttcatagtaacaaaattgtagtggggcatataactgcctagctacagcccatttcgcagcctttcttgcggttaggtgtgtacatgtgacaaaattttcttccattgtatggagtggacttgatgtgcgccacttctacctggttcctaaaacccccagtgtgtgcttctcagggctgtggtgctcttttcctgtctggtgggctaggatggcaataatcagagcaataattgaagtcaagtgtggaaaattgcagaccctgagtttctttttatttatttatttatttatttatttatttatttatttatttattgagaca

SEQ ID NO: 219779 - DNA, 493 bp, Homo sapiens
gacagctccattttttttcctcttttgaaccctctgactctgcccaggcagcctggccaacagatactacctgaatcctccccctactctcctctgctatgtgccaggcaccctcacacatgtcaggggttcagcacatccccaccctttcacctctaggttcctccttcattcccatcacctgcccatgttggggtggggtgcagtcagggccatcctgtttgacccttgagatccaaagccagatgactggaagcaaaacaccatcccaaaggcatgacatctggaaccagactacttgggctcaagtctcagctttgctgtgtggcttgggcaagttaattctcctctcttttcttcagttttctcaagcatataatggggacaacaatgctacctttgtcagggttttcctgaggacaaaatatgagagactcagaactgtgcctggtgcacattgaatgctcaataaatacggccattattacctgct

SEQ ID NO: 219780 - DNA, 500 bp, Homo sapiens
taaaatagcagctgccatatatatatatatatatatatacacacatacagataggtatattaacattagggacttatgagaaaatcaactgagttaaggaaagatcttttagatataactctattaaaatctgtaggtcaaatgccgaggcagaagacagtctttaaagtgtaatcctgatgcttggaaaaaacaatgcaaggaactattgagcctcatttatgaacgtgaagactcggagccatttcgacagccagctgatcttctttcttacccagtaagcatacagttgtttaaataattgtcagtatgataatttcccataaatgtccatgctaaaatctagataagagcaattttctcacctctcctttcctttctttttttccagtcttttgattgtgaaagtagtagtgtgattagtgtgatttttaaaaaaatgtaattgtgtcttcagtgtgtaaattatacagttgtaaaacaaaaatttaaatcagaat

SEQ ID NO: 219781 - DNA, 138 bp, Homo sapiens
accaaatggtattgttttatttatggcagacatcaggggatgaagggagaactaatcctgtccatcctggtttattggagagggagaaaaaaaaaagtgaggagatggggaatggtgcggaaatctaagtaaccacag

SEQ ID NO: 219782 - DNA, 386 bp, Homo sapiens
gcaatatgtatgtgtctatgaagctgtcttgtgccagtgagaaccagcaggagaatgtacaacagtgtcacttgttaacaagactgatattcaacaggcttctaagaatatgtatcttcataaactgatcactatctattatgcagctattatgtggtctatactatactgtggtttgttttcctgtccccacatctgagtgaaggtcttgctcttccctttcatatccaatgtcaattccttgtactcactgaacccatgctgatctccagggaaccatccttcctctcagaatccagagtctggaaggactgaaacctggtcatacccagtcctttcaaggggcctctattctactaataaagatggatcaagtctccacagtc

SEQ ID NO: 219783 - DNA, 253 bp, Homo sapiens
gtaatttactgataatctgagaaattatccatattttaaaagttataaataaatttggagtacctgaggaatataccctttcttcctgttcagctaacactttttccctattctttaagcctcaccatctctataagtcaatctttgataagcagcttttgaaaattgcaaagggaagaatattcctactgtataccaggcattgtacttagagctttacatatactgttttatttaattctttttttttttt

SEQ ID NO: 219784 - DNA, 409 bp, Homo sapiens
tctgtaagcagcagacaggatttccaaaacgtgaggaatgaggactttatgtattcatataagcactcaaaatgtgctatctgagctcaaggcaagaggtagtcacagcatttgatgtaacaattagggccgaagaaaggcaggaggcaacattttcttgcagtcctcttttggaagattcacttctgcataaatgtgttcacctgaaccgaaggtggtcctgtgccccctgttcatacatgtcaccacctccactcatcagctgggcttctcagagatggtgcacgtccgtaaccagttctgaaggcctgagggactctgggagcaaggtggaattcacatctgctagctcatcacgccaacctggggaaattgtcccaccctctgtgaggagacagtgcaggtgtcc

SEQ ID NO: 219785 - DNA, 657 bp, Homo sapiens
gctattgtgaataagtgccacaatgaacatacgtgtgcatgtgtctttatagcagcatgacttataatcctttgggtatatacccagaaatgggatggctgggtcaaatgatatttctagttctagatccttaaggaatcgccacactgtcttccacaatggttgaactagtttacagtcagtggaaatggttattttctcattccattttagtactaaaaattaatcaatagagtttggttctccacattttggcaacattattaacactaaagataatgcctgagaacaagcaaaacaagttttgtttagttttccaaggattcagcctagtgtcgatggaatccacctagccaaagtaaattcttatctgtcatcatggttgtttaccattatcacagaatggtgtttcctggatactgaaatgtgtaggacactgggtaaggtgtaacaacttacttcatcagctgatactttaaatgttgaaaatattaagtaattcaagaagaatgccaaagaatgaggatttgattctataagatcaaagggtactaacaatattctgatcaggtaaaaatagagtcaatttttaataataacaacctaccacagcaaaacatgttaaactcaataacattaaaatataatagtggacac

SEQ ID NO: 219786 - DNA, 419 bp, Homo sapiens
gatttttcctttttttttttattagctataaatgtgaatacttgtaaataagggtctttctgaaatcaagccttgcaagtgatgtttccaaggaggctgtcggctggagcggagcctgcctgaatttcgaaagcaagtcatttctcttctgcagcactaggcgggcaaccatgtctgcaggattattacccttttatatctgcaaaagacggctttcttcctttactccaatatacctttttaacatgtgtttccagggttttacgcaaatttggtttgtaagtatgagtgaatacatttttcttttaaaatacctacaataagtgtcaatcttctctgtataacaaacccccatgacatgcgtttacctatgtaacaaacctgcacatcctgcacatgtacccctcaacttaaagttt

SEQ ID NO: 219787 - DNA, 219 bp, Homo sapiens
ggtttgcctggctggtactgggtaataataaaccagatctcctcagaggggaagtccctcaagcccaccggagatttagaaggtttaccatcagcgttgtgttgatgaaaacactaacacactgcattttgaggggctgaaggcactgtgctgaggaaggtgagttttcttcctcactgctcctagttgtgccccagaaatccctgttgaccctcgtaa

SEQ ID NO: 219788 - DNA, 424 bp, Homo sapiens
cagctcaacaatgtcaagaattggttcctttatgtctctcgcctttgcttccctgtgtcttgtctccatccttgggcatgcccttctcttatattggcaaagtggttgacaacctccagatttaacatcctcataagtccatgttcagcataaacagagtgaatgttttcctttcaaaagacctaactgtgtgtctcatagactttaattagggtgtgtgcccatccctgaacaatcactttggccaaggaggtacagtgtactgattggccaggcctgaatcaaatgtctatccctgtaggcagaagtagtattaataccaccgaaaccaaatgggctgagggtgagaaaggggtaatttctcaaaggaaaatcaggttgttattgtcagggaaaaaaataaataaatacaagaaaccgatgt

SEQ ID NO: 219789 - DNA, 278 bp, Homo sapiens
tgagaacccttcagcaggggttcttgagcagagtctgtaaatgggcctcagagggcttagacctccaaagtctcatgcagaactccctttattctcatctcatatctttctcctggaccccactatgctgtaaccgtacctgggccttggcacttactgttctctctgcccaggctacttcctacccgatacttaaggcaagaatcactcacctttcaggtgtcaggtttcaggtcatgtttgctctttgaaatcatctggcttgattatgtgtatta

SEQ ID NO: 219790 - DNA, 512 bp, Homo sapiens
tgcatgcaccctccagtggcataaggatggcccttgcctgccaccagcccccacaagcacctcttgggagtctgaggattggcccatgcagcctgctgctgccactgagtcacacaaaccacctcggggcctggagactgacctactcagtccaccactgctactgcactgccaacaccacacacaatgcccagagtcctgaggacccacctgcccagctcaccactggcacctgagcatgccacatggaaacccaaggactagcttacccagacccaccaatactggtgcttgtctgtgccacccaggggtctaaggaccagcacaccaggcccactgccaccactgctgatgcctgaggactagcctggctagtattcctgtaccctgcaaagccttaccacagccttcactgacaactccagcttaagctgctgagaaactcagagacaccactgttgctgattatggccaaagaaatcatatagagactacactactgcacccaccca

SEQ ID NO: 219791 - DNA, 406 bp, Homo sapiens
tgccaacctgccagacaccttgatctgttcacagagacatttctgtcaatgagagaactggctaattccagccatgggcaaaaacgggataggaaccagattcagggtgggggacagcacatacgtgagagcagccctttgcctgctgctgtcctcctcccagtgccccaggctgcatctggaccttccacgtccacacacctggcccgacatttcccaacccacgctggcagcaacaggtagggaacactgatgggcccagtgccagcctcgcctcacctctgcgcctccatccttggcccagtgtcctggctctggttgcagtgctctcttttttccttttaaagttctggtaaaatatacatgacataaaatttgccattttaaccattttaaacgtatagtt

SEQ ID NO: 219792 - DNA, 606 bp, Homo sapiens
tatgaaatataccttaataaagctaattttaaagaagaaattaccattatctttgaaatttctgagaaagtcacaattacatatgtagtatcataactaagggcacaacttgcctttcagcttgtcgaacatgtaaaataaatgtcaaattaaagagaacattattctgcaggctcttcttagatggttcctctgagattaaaaaacaacgacaacaacataaatacatatatgagtttttttgtatacacttcctccaaacagttgctaaaatacttctcaagcaaaactggagaaaatggtgtatttatgaaaattcctgttttaaaaatatttttatttctaccattattcattcaattattggaaaattaatatttcatttttaggccaagcgtggtggctcatgcctctaatcctgatactctgggatgccgaggcaggtggatcacttgacttgaggtcagcagtttgagactagcctggccaacatggtgacaccccatctctaccaaaaatataaaaaattagctaggtgtggtggagctcacctgtaatcccagctactcgggaggctgaggcaggagaatcactagaacctgggag

SEQ ID NO: 219793 - DNA, 128 bp, Homo sapiens
agtaaaaaagtaattatgattccttagtggctatcatttctgaaatcagaaattatcttattctgtctttcaggctaagaatacctttttgttttgttttgttttttttacaatatataaagtgcttt

SEQ ID NO: 219794 - DNA, 883 bp, Homo sapiens
ggccctcagaggactctctacggaagctgtcttcataacaagggaacctcaggggtgaaccagagttgtcatggcctcagccctgcttgcccagctctgggaatagagctgaagcatgcgcacacacagacacatgtgcacttacagccagaatcacactcaaaggagagtgttttggtaagaaggaggcatctgaaaagggagtcctacatgggtctacttttgaaaactcaaagatgtgggaaaatatattgttaaaaaaaagaaaagccaaacccagccagcatgtcagaagtgcttctgaggtggaccttggaaggatcctgggccagctgaggtctcctgagagtgtgggaggtgacagagctccaaggtgcagggctgagtgatgctgccaggaactaggagggcagcagggcccgcccggggctgagaggtggttggtggccaccagccaggtatttcctagtgtcaggccagggatagctacctgtggggagtgtgtctagccctcagggcccttccattgggttttggggatggaccaggaatttggtgggagatgagactcatttggcatcttgttttggtggaacaaatgtgttctgtaagtcaggggagccctgcatcttcggctggcagtcagtcccaggggcagaggcacagcagggctgtcagcgttagcttactctagagagagttaatctcttcaggtggaaaattgagtcatggaggaagctgatcagtaacatgaacacaccctcagaggcggcagatttattgacacatctatccaagtatcaggtataaaagatgctcgttctgccacagggcttggttttaagtggatttgagtgtgattcgtgaatggctgggctgctaa

SEQ ID NO: 219795 - DNA, 389 bp, Homo sapiens
ggggaatttgctgggacaccttgaaggccgcaggccagaccccaggggttaataagggaacaaagtccttgggcgaacacctgcatttactatctgagccagcaggcagctaggatgctgggtgagggggtctctgggctgctgggcggccaggcgggggcatcggggcaggagctgagggctgcactgggcaaccaccctgagctcctgtttacccaccaggggcagtgccagggcgggctgggctcacagcagagcccagaggaaggggctcaggctgagcaggagctccctgacagcctggcaccagaggccacgccgcactgtggccgccttgttacggaggctattttcacagcaggtcatgtccagcttctcaatcttcgagt

SEQ ID NO: 219796 - DNA, 469 bp, Homo sapiens
aattaattataaattattaattataaattaattaattataaattaataaaaattgtgatcccacaattaatttcaaatttattaaatagaacctgagaaaaaattatgcagtatttttttcattagatgattgtcagcctcctaccaacaagcatatgctagatgttacccatgaaaacttaagtagtcaggccaggcacagtggctcacgcctgtaatcccagcactttaggagattgaggtaggcggatcacctgaggctaggagtttgagaccagcctggccgacatggtgaaaccccatctctactaaaaatacaaaaattagccgggtgtggtggcgggcacctgtaatcccagctactcgggaggctgaggagaatcacttgaacccgggaggcagaggttgcagtgagccgagatcgcgcaactgcattccagcctgtgcgacagagcgagactgtctcaaa

SEQ ID NO: 219797 - DNA, 291 bp, Homo sapiens
gccggccagcatcccgctccctttgacccgcagtctgtgcgggaagtaggcccggagtggtgccagcaggaggtggccttagaaaggcggagacccaaggagcagagtgagtcggcgtccagctccacctgaaagcgccatcttgtcgccacttccctcaggagcagatcaaaaggacctaatgaaatgtttgtggaacctgtgtaaaacatgctgcacaaagatgtaaataaatcaacccatgaactcctagtaccctgaccgcagcgtatgtaagatcaataaatagct

SEQ ID NO: 219798 - DNA, 522 bp, Homo sapiens
tcgatctagaggatccctgctgatgtactgctaaatggaatttgaatctagaccccctgactttagaactgtggccttaactactgctctatagtgccttctttactgcccagtaaagcagtcattagggaggctggattaaaagcaaagtcaaagcacttatattctctgttgtgatagacacttggttgtttatcaaatagccatttctactttctgccaattttgttcagatattgggcagccaagaacttcaagtacttggaggaagttaaatagtgattagtctgaacctaagagtggtaatttcattattttgctacaaattagttaggaatggcctaatgacacaattcctatcaatcatacatagcaaagatttaaaggctgggcatagtggctcatgcctgtaatcccagcattttgagaggcagaggtgggcagataacttgaggccaggagtttgaggacagcctggccaacatggcaaaaccccatctctaccaaaaatattaaaattag

SEQ ID NO: 219799 - DNA, 536 bp, Homo sapiens
gggacaatggcaaacgtgcttgctttcctcttttgctatcagcaggttccagcgttcacacatgggtcttgagtcaagctcgggtcactggcctgcaccatcactccctgtgtgatcctggactgcaagtggctccacctctctcagccgcagtccctcctcagtcaccccacagtggggctacaggggtgacagatcaagcagacagcagccggcagtgtctgaggtcccacagtaggtccttaataaatccagtggttactagctcagtaatgctagaggttacctgctcagacactcaggcctctctgagtacaggctaagtcactgcccagggcagatccttcctgtgatttgttccagctctcaggacactgtgtcttccctcccatggagaattgagaaaggctccttgctgatctgtctacactacatgcatcttatctctagccacctctgcctggtgacctgcactgggtcttgatcacgcctggattcagtgcaggctgctctgcccagcccgagctgcttcccgg

SEQ ID NO: 219800 - DNA, 281 bp, Homo sapiens
ggaggggataggagggtgagggacgagagacgacactcagcaggtgtccagggagtggggggtgtcctgggctaggacagaggtgacaggtagacaatgtaggatttgttctggagactgagcctttaggatgagggagagattagatggagacgggactaggggctacactgtggtcgtcagtgtggcacacatttagggcagaaacaggagcacgaaatcaacagtagcaatgaatatgcccgaggcactccagacgtatctgatgctgaatctgcaca

SEQ ID NO: 219801 - DNA, 169 bp, Homo sapiens
tacactcatggaattccttgaaaacatttcacactgtatttactacattatattgaaatatttgtgccacatctgtctccctcaggagccactatcctaaagagtaagtatcggttcatttttatattctcagagcctagcactggcatacggtaaatagtcctaaatg

SEQ ID NO: 219802 - DNA, 578 bp, Homo sapiens
cagcacacgcagggactactacctgagtctgcaaaacacatagcatttttgtccgtggatggtacacaaagctcaatctttttgttttcttctggggaaaaaattaaatctttatatgttaatatgattgatattcattgtgcaaaaaaaatcagtgtgtttttaaagaagtataagggaaaaggaaaactcatatgtccttctgtcactctgagacatacactggtaacatctgtgcaagcccctttccaggattctgaatgtacagtatatatgaatgcatacacagagaaatttacattcaagagtgtactatacttgttcttctataacatcagaaataggtttttactcagatgtcttcatgtcggtaattatagaactacataattatttttatagctgtattatgtagatttaacaggttcctcattgataaaacaatgtttttttggttgtttattcagtatctgaataacgtttctatggacatctgtaaacatgtatgaggggacttttaaaagttcatggaaaatggaattaaaagaaaaataaaaaaatataaactttaaaaaaaa

SEQ ID NO: 219803 - DNA, 604 bp, Homo sapiens
gcgcggtggctgacgcctgtaatcccagcactttgggaggccgaggcgggcggatcacgaggtcaggagatggagaccatcctggctaacacagtgaaaccccgtctctactaaaaatacaaaaaataagccgggcgaggtggcaggcgcctgtagtcccagctacgcgggagactgaggcaggagaacggcatgaagcccggggattggagcctgcagtgagccgagatcgcaccactgcactccagcctgggcgacagcgagactctgtctcaaaaaaataaaataaaataaaattttaaaaaagcatttaacaacaacaacaaaaaattcaattttaggattcacctgagaaaagaatacctcaatactgctacactttcaaaaatgtttagaatcacataaaaattcacttcaataaaagaatgcttctgcagtttggggataaaagtttctaccaaataatcagtccctaaaacgctaaaactaaaaatttgctacaagaaacttttcatgtaatatttaaagatttttagaattaccaaaattaaatgtagatctgtttaactcctatcaattttaggtatcaccacaaatataacat

SEQ ID NO: 219804 - DNA, 474 bp, Homo sapiens
aactgaactggaatcagaagaaggtaggcctgaagtttgcgtcgggtacatacttggaaagttatgtaagctcttgagaataattccttccttgcctgcctttggcagtttgctgtgagggtgagatgaacgaatgagcaaagccctgggtcagggctttgtaaatagcagtggcagttctttcctaatggcattgcatcagtagctggagagcaagcagtaaggtgaggtcctctgagtcagtctactacgcccacgttactgtctttaaaagttacattgacctatgggcggttgtgtttttcccatgtcactgtctttagaagtgatgttgacctatggactgttgtgtttctcccatgtcactgtctttagtagtgacgttagcctatgggctgttgtgcagtttgtttaaaaacaaaatatgggtgacttatatgcacactagaatggctaattaaaaagataaaaaaa

SEQ ID NO: 219805 - DNA, 356 bp, Homo sapiens
gaattgtatggtaagagtacatttagttttgtaaaaaactgccaaaactgtcttccaaagtgactgtaccattttatattcccactagcaatgaatgagagttcctattgttccacatccttggcagcatttggtggtgttagtgttttggattttggccattctgataggtgtgtagtggtatctcattttacttgtaattccctaatgacaaataatgttgaacatctttttatatgcttatttactagctgtcttctttagtgaggtatcttttcaggtcttttgcctatttttaaaatcatgttcatttttgttttaaagaattttaagagctctctctctcttttttttta

SEQ ID NO: 219806 - DNA, 172 bp, Homo sapiens
tgcttccctcttccactgtaagtttaaaggagaacttgggctttggagtagttgtgctgattggtgtttacatactaactctgctgcttcttagctgtatggccttaggcaaataatttaacttctaagcctcagtttccccatctaaaaaataggggaactttacagggtt

SEQ ID NO: 219807 - DNA, 268 bp, Homo sapiens
aaaaagttgtagagattattttaagagaacagccctgcctgaaggactgttactgttatttgaggctaaaggaaatcttgcaatttgcaaaaaaagttaaatctgaaccctcccctccaccgtgggggccagggacaaggcacaattccatttccaccccccagctttcttattggaaaaataaacacccctgccagacacagtggctcacacctgtaatcccagcattttgggaggccgaggtggatggatcacttgaggccaggaa

SEQ ID NO: 219808 - DNA, 411 bp, Homo sapiens
ggtttggtatttgggcacctgtgccaccctccagcccaggactctctctgcccctcctcagcaaagaccctcagcaggatccccgcatccctggccaccctgtggggcctgctgctgtctcttccagcattggtgtgtcctccagggaaccacacactcaagcactttggaacccatggaatccagtgagcacgtgctgtgggctctgcctagaagcttccaaaacctgtttgttccagtggacacagagtaggaaatgctgactcgttcagagcgctagtgcccttgggtccttgcgggtgtgctcttctcactcctcaccccatcagcaccttctggggtaatgcacacaccagtaaaatgtacagtgcatgcttttaaaaatttttaaataaatgatactatgctata

SEQ ID NO: 219809 - DNA, 504 bp, Homo sapiens
tgcctaggtttacctctcagtgttcacatttctgcctgttccactccatcttatctggattttcaccaattaactcagattgggattttatttccttaaacttttgggagataggaagagttgggagagggaggggcttactttcctttgtggtctttggttgtgagttgccctcccatctccccagttcaaagtacctctcctctccagccagacctttatttatttctcctttgcaagagctgctcacagatggcctaggactttattgcttattcggccagtactaaaagctgccaatggatccccactgtgggagatcccaggacagagttgtctgacattggagtttggagtggaaacaaaatggtataaagacattattggaatgattgttcagtttaaatagggatagttattgtataattagataatattgtattaatgttaaatttcctgatttgctcattgacagtggttaaataaaataatgtgttttctggc

SEQ ID NO: 219810 - DNA, 313 bp, Homo sapiens
cccccatgactatgactatcattgttcttgctattgtgcccccacttcccaatatctatccaggatgtgcaccccatgttctcttacctggcgtcttacttttttctccctcaaatttcagcaagcctcatacttgcagtctcatttcgccagcatgcaagaactgtctcccccttccttttctgggactcaataatcttttccccttaccactccctcaccccaggcctattataagcaggagcatgtcctcctgccaaattccctcccctgttcccaacatgccctgtaataaaattagagaagactaaaa

SEQ ID NO: 219811 - DNA, 485 bp, Homo sapiens
tgaaaatgacccaaacgccaacttctagtagaacaaatgaattgtggaatattcatagatggaatactatagagcaatgagaacaaatgacctgaacctaacaaaaacaacatggatgcacagtacaaacgtaatactgaacgaaatacataattttaatatacacaatatgattccagctttataaaaacagtcaaaactacattggtttaggcatatacagacacacaaaagtggcagaggtatttggaaaaaaaaaccaaggaagtgataaaagtcaggaaaataggagggaggggagaaggtggggaaggattaccaggggcaaagaaaacttttggcatgatgagtatgtcttgttagattgtggtgatgatttcacaggtgtatagtatatatcagaacttatcaaattgtgtgtatactttgaatatgtacagtttattatatgtcaaggatacatcaataaaacttttaaaatcaaa

SEQ ID NO: 219812 - DNA, 468 bp, Homo sapiens
ttgtgctggaaagaggaatgaggtgatacaattggaaatattcccatcaaatggttaatcttatttagaaaatgggcatattagaaaaagtccttccaagatgattttggataataaaagttgtatttgtggaaattggtattatctctgttttatgcacttatatttatcccttacattttgtttttagtgaccctacatgacattaaatttaaagtaaaacattgtttaatgttaccttttggcttgagaatgtctttcagctccagaattattgttactcatattttaatcagtaagtcatttaagctatgacagagtaggaattgagaaattatttcatatgctacagtattgaaatgtggatgctgccttgttttataagaagatgatcaaggtttgtgtgcccattacctttcctctgcctgaaagacgtgtctcaagaaaaataaattctattttagatgc

SEQ ID NO: 219813 - DNA, 478 bp, Homo sapiens
cagattcgttctggaaagtctttgtgtggccctgatgcatgtactccagtgttaagatcatgaccactggggccatcctttttccctggggagtctgagccagggacatatcatgcccagcatttgctaatttgaattttgacttctgatccttgttgggatgtgcgtttgggagagagccagtcagtgctgtggttcttatactgtggtccacaaatccagggggggtaccccagatccttttagggaggttctgtgaggtaaaaactatttttatagtaacacaaagatgtttgtgatttttactgtgtggataatttgccctgacagtgcacaagcaatggtaggtaaaacaactggccctttatcatgaattaaagcagtggcacaaatgaccaggggtcattgtatgttttggctcacatttgtggtttaaaaaaattccattttcacttaagaatatcctcaatgaagcagt

SEQ ID NO: 219814 - DNA, 587 bp, Homo sapiens
ctgggattataggcgtgagccaccgcacctggatatttttagttttaaacctattattttgcttttgctttctatctttcctgaaggaattcagaaccagatacccccaaacatgccactttggcatattgatttttttgagttaaagacacttgaaaaatagcagatgcaagaaaagcactctgattttcctttaaagcactctgattttcctttttcttaaaagtaggaggtaaaatttctacatgaaagttgccctctttatacaagaaggaaagtaacagtctcatcacccaggatgagaagttgaggcaagggaaacctgtacaaacagaccttgttaaaccaacccttatcctgttaatcacctcttcacccaattaactacactagttccagctcctttgtcttgtcatatttcacaatttactactctgtgtctacttcagaacataagtgattatgtcatggagtcttccttccttaaagaatctcgcatgccacataatacatgcattaaataaatttgtatgcattttcctgttgatctgtcttatatcaatttaattctcaggcttagcagagga

SEQ ID NO: 219815 - DNA, 581 bp, Homo sapiens
atggccatactcccaccactgctatatgaatctgctcttttctccactcccagctaacacgatgttgtttcaaactttttgatatctgaaacctggtagtctgataatagtctgaaacctgataatggtatcttgtgattttaatttgcgtttattttagtatgagtaatgtaaattatcttttcatatgttttagagccattcatattcccttttgttcatatcctttttgcattttctttggatatttgtctcattgatttgtaggagatctttaaatattaagaaaattagccttttgtttatgctatgaattgcaaatatttccccaaatttgtcattcatctcttgactttcatttttctccaaatggcatgaaaagctgaggtgggcggatcacctgaggtcaagagttcgaaaccagcctggctgacatggtgaaaccctgtctctactaaaaatacaaaaattagccaggcaggagaatcgagaatcgcttgaacctgggaggtggagggtgtagtgagctgagattgtgccaccgcactccagcctaggtgacagagtaaaactctgtctta

SEQ ID NO: 219816 - DNA, 407 bp, Homo sapiens
ctgtacttgctgatttttcacaataaatatgtattacttgtgtaattaaatatatattttttcaatcagaggttgttaaatagttgattctgaggctggctgggagatggctgaggtcttcaaggaagcctttttttttttttcattttaaagttctactttctgttgcatcaacatgtttagcctttatggaagcgcacggcaggcctcctggatcccagagttggtgtataagggccatttggcttggctgagcaggctttgagtggtaagtgggctttggaatctgtttacttagaatagaaatatctcagttcagtttgcagggaaaaaaggggctgttctatgatatatttgggcaggggccccagtttaagctttcctttaaatacaaaaaaaaacccaaa

SEQ ID NO: 219817 - DNA, 563 bp, Homo sapiens
ctgcctgtcagagccagcgcttgagaacgtggctgctagtgaaagtgtttatgtgtttatgtgaccacaggagaaccttcaggagtgaggctaactcatctgtgccacttaatgccggagtaacaaagcccccatccactgaggacggagagagcagattgtaaggagagagcagattgtgtggagaggcaggggtttctgtcacgtagaaagcatcttgtacaatgtctgacacacagcaagtgaccaaaatgtgccaggctggtccacccagtgctctccaaacaccgtggtcgcttgcatctgtgggattttgctggtgatccttccctatttatctgagttttgcgtatagacaaggttgtctagatggttctcatttggggatctcttctacagccgcagtcagatggtgcaggattcctcagaacctttaagaagctaacaggcaacatggctcttcagaaatgggatatgctgggccctaacataatgggaattgcacatcccacatctggaaagcaggtttgaaatatctaataataaagctgaaagaaaaatgc

SEQ ID NO: 219818 - DNA, 742 bp, Homo sapiens
catttaagacacctcttggaatctgtgcatctgctgcatagggacaggaagatgatgataatggataggagttctttggggttccatctttctgtacatcccaggccataagatgatggaaaagcaagtgaggcatgtgtgtctctatgagcatttcccttcagaaggaagatgttggagactcatctcccatgcacagtgacttctctcttactaaatttgtgatggtagggggtactcctcattactgtggctcagcagggattgcatctgtgaatatgccaagggagggtctactattggggaatggtgagaggcaaagaggagaaaagaacattataggcactttgaatgttacccagcaacattttttttgttgtttcaaagtaacatctttctataatgctttcaaatttacctgtctggtaatctgttctaagatgggcagcccatgaggttttgacttttttcactttggctattgcatttcaaaatattactcacaattaggaatttataccatttgaaacaataatgtggtatctcatgagtaaatgctgccattaacatcttccttcttttaaactgaaaacaagcaaaccagaaccaaaaaaaaaaaaaaaaaaagcagaaacatgctcccccaagaaagcttgtttttttctttgagatggagtctcgctctgttgcccaggttggagtgcaatggtgcgatctcgactcactgcaacctccacctccc

SEQ ID NO: 219819 - DNA, 369 bp, Homo sapiens
ctgctgggaactgtagtcttctggacgccggcggtagcaacgatgaactaaagtggccaacccagggactacatctcccagcaagcaaaagagcgggtgcttcagttaagccggtaaatattactgctcagagcgaccactgcgatcgccggtcttacaaaggtgcttgcactaggcagtagctactcttcggcgagacggaaacctaagtcacaggtgactaggcgttgagcgaaagatcaaactcagaggagacaatatataagccagattgacgcgatgtcccctaggagtgtgagggaggaaacctcacctggtctagaggggcggggtgggagaacgagagactgacgcgaaggagaaggaact

SEQ ID NO: 219820 - DNA, 413 bp, Homo sapiens
tgtctggcacacaggacaggaccaacaaatactgaatgagaaaagtgaatgacagatggaaaagaacagaactaaacagggagtttctccactgggaccacaagagggcactcaagatacgtgtcaaacccttgaagccccaaggtgggtggtctctctgctcctcagcctggaggaccagggacaggtgacctggaccacgtcctttctcctctgtgagcctctatttccccatgtgtagcgtggagatggaaatgcctgaaatacgttcttgtgagaagcaaaaacccaacaacgcatgcacgtgaatgtcttccaaggggttgcacgtgtccaaattcatctaattgtgtacattaagtgagagggttttttagtagaacaattatagctaaacaaagctgctaaaatgt

SEQ ID NO: 219821 - DNA, 696 bp, Homo sapiens
gccaccatcactgtggcttcctgctgcctaagatgacttgagttcccggtaggaggagtggcagccatcactgcagctccagtctgccatttttcccctgccagtgctggggagactgggtagtttggacccaggaggaattgcccacagcacagcacagcagctataaaaggttataaccagactgtctctttaggccaggccctgatcaatcctcctcactgggtggggcctccctgcaggaacttcagcaattcctgccaggagtttagaaacagaactctgatctctctgagactgagctcttgtggggaggggtggctgtggtctccatggatcaacagacttagtcttttccccctgctggctctgaggaatccgggcagtctggacgagtgggattccacccagcatagcacacctcctctgccaaggggcagctagagtgatttgttaggtgggtcctggatcccatgcctcctgactggggagatctccccaacagaggtcaccaaacaccgtatacaggagcattcctgctggccttagtttggtgcccctctgagacagaaatcccagaggaaggagcaggcagccatctttgctattttccagcctccactggtgatacctccaagtatgggagggacccccagcaaattgcagtagccctatgggagtggaacctgactgtta

SEQ ID NO: 219822 - DNA, 453 bp, Homo sapiens
atgggaacagtccctatcatccatccagggctcccaatctccaccccgagctggtctcctgccctccctgccttaccttaacctgctcctgagtggagcctaagggaaggctggttctagggaccccagtgggaggcaagacaaggaggtcttgctgggagatttctggttcccacacaagggtccccaagactagcttctccacctggagagggtgggagaccagctggaaccccaaggagagtcaattttctggccttggaattaggtattttttgttttgaaaattccttggtatcaagtttacatgactggggccactggaccctgtaggcagggctgggggtacaaagaggatcacaagcctggcctctttgggagccatagctcaggcaccactcaaggaagcacatttgttcaagggattagcatttctggatgtcagttcagcga

SEQ ID NO: 219823 - DNA, 613 bp, Homo sapiens
tcatgatagaatcgagctctgtacccagcagcatagatattaccgaaacaaagtacacagaaaaatgacttacagtttgaaattggaaagtaatacagatgctccatcttagagggacaagtggtgttcaaaaaacaaaacaaaacggatgatccatctggttaaactcattctaagttgaaaataccttgtcgaaatgcattgaacacacctaacctaccaaacgtagctaagcgtagcccaccttaattgtgctcaaaacacttacattagcatatagttgcaagtgttgaatacctcattatttattgaatactgtactgaaagtgaaaaaacagaatggttgtatgggtaaatgaagtatggtttctagtgaatgtgcatcatttctgcttcattgtaaaactgaaaaattgtaagtaaaaccattgttgcctgtacataaaaccagttagaacaactggctagccatttggaaaaagataaagcagaatctgtatcccagtttttaagtcaaaataaatcttaatacagaatttaagacaaaaaaagtatgtgtggaagacaggacttactaaaactaccagaaaaatactgacatgtattattctaa

SEQ ID NO: 219824 - DNA, 435 bp, Homo sapiens
tgttctgtgaccctggcacccatggttggcagctgaatagctggcatatggtgacttactgggctggcaagcattaacgcactttgtaattttattatgacagtagtggagtcttgttcattgagtctctgccacaatgtgatagccattcctccagggaggcagagtcatttcagtcgtctctgggtggcattaagtttctccccatgaccaatatattgtaaatagcacaagggatgatatttctggaagtaggatcccatggtaatctgacaaataactgctgtgggatcagggtcagctcagaatacatgaggatgatggcagccacagcccttgttttgcctttatagactatggaggcagataaatatcgcagatatggtacagtttagtttcgcctgattctttgtcactgtagatcattgaggagtt

SEQ ID NO: 219825 - DNA, 154 bp, Homo sapiens
gattccagatctaccctttagctagtactggctgtgtgaacttaggcaagttcttgaatgtttctgtgcctcatttccccatatatgaaataggaatagtaatagtacctagttgataggatactggatgatagtaatcattcaacaagttaca

SEQ ID NO: 219826 - DNA, 644 bp, Homo sapiens
tagaaaagaattacataaatcttttcgtgcttgctagatttttctccccaggattcagggcatggaaatgtcatccctattaagaaggatttatgcctttagcaggtagttgctgaaactggctctagcatctatggttttattgatgccacaaaactctagactaggaaagaataaataaaattcacctcctcagctgattcttatggaacttcagggatgcagaaaggggcagctgttaagtgatgtaaaataaattattctggaaggcacaattagtatgttaaactgtggtcctaaaaacatctgattcagttttagtactctagtaagttgacaccagtggatgcatggataaaaatgaaaatatcatgaaaaaatctggcggtgctggtcattagcatagattcttccagaaagtgtcagaaacaaaactatagcctctagaataaagattttaaattggaaattcttaagccttgggatgattttttttaacaataagaagttaaaaaaacttgaaatatatgaaattatttgccacctctttacaaatctgagggcacacttaactttagaagcataaaatgcatctctcatagcaattttgacttacatgaaacatttagagaattcaaaaccta

SEQ ID NO: 219827 - DNA, 494 bp, Homo sapiens
ttagccccaaacaaaggagatcaccaccacgtggagtcaggatgggccaagcttttattctgaagcctttcctctatttcctaacttgttggggctttttccctgaaaaaattaaaaatcaaaaaacccatccatgacttttcaccatatcacgactgtggtccaaactatgcaggcagaatcggcagctatccagttggaggcacaaagatcttccttcctttaaagaaatccccctctaacctgccagaggaccccaaatggactcctcagaagcccctgtaaaggagcaatcatgttatttggccaatactccccaataactaatccatctttgtggcctcaggctttgcaccattccaggcaaacagcaggtgctcattaaatatttgttggctaaatgaatatacccacccccagttgttatccacttcgtcctgactagctgatcagattatagtctgcgtctatccctaagcaatgtccagagaggc

SEQ ID NO: 219828 - DNA, 364 bp, Homo sapiens
gcctcttcctgaaatgtggcagggagcgcaaagcagacatgcagacaaaagcagaaagccacaataacacacagacacacacgcgcacacacacacacacacacacacacacacaggttagaaattaaccagcacttgggagttgcctggagttataatgcctttttttttctttttggccacgtacacaaatggtaaaatagactttatttttaaatgtccagagcaagtaattctatatttttatactgtttgcatatttagttattcttgcagctcaatttttctccatacctatcaatcatctatctactctacctacctacctatcatctatttttaccgatgcaaaattttatgtaac

SEQ ID NO: 219829 - DNA, 512 bp, Homo sapiens
ctcagtacgtctgactccaaaaaatgggctgctaatccctttgctatacaatctgagtttctaatagtcagcttcttggtagaagactgaaatttgaattcatgaaagcagaccctagctgtatggtattcccagttttgagtctccagtctgtcgtttcataggaaaagcagggcttcttttggagattgggacaccttgctccagagaacctaccagttttccactatctggaaagaaaactaatttaatgttagactctaaatgcagaactttaagatatttcaagtatggctataacatctctctcttctctgaatataccaatctttgtttcagggtgaagcttacaatgcagttgactcttaactacatcttactgattcgcacttgcttttccaacagattcctttttaacttctttctttgctttttgaatttcctgattttaattaaatagtgggactatcagactcttcctcctcaaagacgtctagtacaagcacttgagt

SEQ ID NO: 219830 - DNA, 533 bp, Homo sapiens
catgtacacagtaaatcctcacttaatagtgtcaacacgttttttcaaactgcgactttaagcaaaacaacatacagcaggttcttgaataacaccattccattataacactgatgaggcagacaaaactggttcagttctatgtcattttgcttaagtttgcagcttccaagaacctgttaatggtgttaagtgaggacttactgtatgaccaaagcacaggaagcgctaggactggcaccgggtaggcacccaaggtatctgctgaatgaattagtggccaaaaattggtatcatttacatacattcacttataaacaaaacatgaaaaatttaattattacttgaagttgaatgatactttaaaaatacagttggaattaagaaaacaactctttcagtttaaactctggatacacacgcattttaagaaataatttgaaggctgggcacagtggctcacgcctgtaatcccagcactttgtgaggccaaggcgggcagatcacttgaggccaggagttcaagaccagcc

SEQ ID NO: 219831 - DNA, 200 bp, Homo sapiens
aattcaagtgtggctggaatggaggacgtcagtcacggggactggccacatacagactggccagttccattctccaagtacaggaatgtaaccctcagagcttaattccttgtagagggaaatgcaatgtgcataccaaaaaagtgactttccaagaaacgtgtattaaaccagaaaaataaaatagtttaacatttggt

SEQ ID NO: 219832 - DNA, 744 bp, Homo sapiens
ttcaagtccctttccacacggggctgctaagagcagtggtcagaaatgtaggaggtcaatttgggaacagcatgaggaagggtctgatcctgatgggactccgcgatcatgggacggggtgtttgtgaccccagccttcctcctcatggcatgtgttcaggcaggcccagggtggtcatttgtccagcgttttggtaagggaattcccacactgacaggtcggttagacttgaaacctttgtcttttcaaactcttaagacacacttcatcctatccattaggaaggcatagaatttccaagtggaaagttacttctgaatgtagcttgctgcttagcaaagttaggagactttccctattcacaaagcaaggtgatgcagacccagcaccagagacagatgtggaatgaaaaccatgcagttccagtgttctcgacacccacagaagcaactgccaggattgccatcaatctctcttgcctcttaaaaattttttaaattgtagaatgcatcatacaaacaaaaaagtatgtgaaatatgtatggacacttaaaagtactggaaatctatgggcccactgcctatgttaagaaataattccttaacttagcagtcaggaagtccctctctgatcacagccctccctcatcttcgtggaggtagccactgtcctgaagtttgagtttgtcattctgttgcctataaagcaaggatcagtgaacttcttctataaggggcagata

SEQ ID NO: 219833 - DNA, 587 bp, Homo sapiens
ggaggatcacttaaggtcagaagttcgagaccagcctggccaacatagtgaagccccgtcactagtaaaaatacaaaagttatttgggcgtggttgtgggcgtctccagcctgggtgacagagtgagactccatctcaaaaaaaaagaagaaaaacaaaaacaagtaaataaatgaataaaaataaaggaatccagccatctgttagtatagccaaagcagaggatattgcatcaaatgttaaacgctagtcctgtcagtcactcctgagagaacagggcaacaagacccagaaagggtatcaacactgcctgagcagatggaggcaaagctgtgcatgggctgcttatagggcacagtctgaggccttgcagcagtcacgtggaaactgaggctgcctgctttccaggtgcaaggtgatggacagtggcaggaaccctgtgctagatgactcttgtgcgatcttatttctttgttactgggacacaagcaccaactgtcacaagggaccaacaagaggaggtgattttttttttcagctgttaccacaaagcttttcatcttttggtttgaaaacatagctgtggg

SEQ ID NO: 219834 - DNA, 539 bp, Homo sapiens
ggaaacagaggccttcctcttttactaatccttctcagcacagaccctttatgggtgtcaggctgggggacggttaggtctttcccttcccacgaggccatatctcaggctgtctcagtggggggaattcttggacaatacccacgctttcttgggcagaggtccctgcagctttctgcagtgcatcatgtccctggttaatagagaatggagaatggcgatgacttttaccaagcatacagtctgcaaacatattgttaacaaggcacatcctgcacagccctaaatcccttaaaccttgattcaatacagcacatgtttctgtaagcacagggttggggctaaagttacagattaacagcatctcaaagcaaaacaatttttctttgtgcagatcaaaacggagtttcttttgtcttccttttccacatagacacagtaacagtctgagctctcttttccccacacaaaactatgtttaaaataatttaagtatgattatataagatttgggggccgggtgcagtggctcacgcctg

SEQ ID NO: 219835 - DNA, 435 bp, Homo sapiens
cattgcaaagataaaggagaaagggcacaatcaccaatgtcatgaataaaacaaggagtattactacagatcttctattctttaaaaggataattaggtaatactattaaaaacttcatactcataaattgtacaatttagtagaaatggaccaattccttgaaaatcacgaacttctaaaactaaccaagatgaaatagacaatctacatggtataaaagccattaagtaacttaaattcataatgaaaaagttcctgaaaaagaaagcctcaggactttctttttggtttcactggagaattctaccaaatatttaaaaaagaattatcatcagttttagtcaatctcctccaaaaaaataaaagatgaggaaatacgtttcatgagtctagtataatgttgataccaaaaacagagaaagacagtgcaaaga

SEQ ID NO: 219836 - DNA, 328 bp, Homo sapiens
ggtggggttgctaatgcatttaactgagtgctttttaacagcccagctggagaaacaggaagtgggacaggatcagtggaaacgctgcttgggtatttgaaattcaagcagtgagacctgagagactggagttcctcgccaattccagaacctcagtgcagggcattactcttttagatacaaagattgggtgtagaaactccacatctgtcagccacgtaacacagcccatcagataatcatgttaaggctaacagccagttcgaaacattctgtagaactatatctgttcaagggctaccaggtcctacctatctgtctcacctcc

SEQ ID NO: 219837 - DNA, 481 bp, Homo sapiens
cttcagcaatttttcttgttctgatgtctacattatctgatactaagttagtccttttttcccatgatcaatgtcttcataatatattttcccatgttttgccttcaatttgcctaggttattatatttgaagtgagtttcttgtacacattatatagatgggtcatatttttaaatccccttgaccaatctttatcttttagttggtatatttaggacacttacttacacttaatataactgattagagtttaactatggcaatttttgtttcttttctgtttcctcatttccgttttctctttcctgccttcctgaaggttacttgaacatgttttttcagaattatataatgtttttaagtgtatctcattgcatagaatttctagtggctgctctagatattacatcatatttacataacttattactgtataccaatgtcttcattttaccaatttgagtaaagtataaaacctta

SEQ ID NO: 219838 - DNA, 372 bp, Homo sapiens
ttgcattcccaccagcaacatacaagagttcctcttgctcctctccgtcagcagcatttgatgctgctggtgctcttggttttggccattctaatagatgtgtggtggtacctcattgtggttgcaacttgcattttctttatagctaatgatggtagcagcttttcatgtgagtgtagatgctctggtcaggtgtcacttcaagtcatttgcttcttttttaactaggttggttgttttcttatggttgagttttgagaattctttatgtattctggatacaagtctcctgtcagatatgtgacttgcaaatattttccccagtctttagtgtgtcttttcattctctaaaaagtgtcctttgcagagaaa

SEQ ID NO: 219839 - DNA, 262 bp, Homo sapiens
gccctctgaatcatttttaagaggtaaaaattagtatctttttcctttaaaaggaatttctttctctctttgcaaactttgagtttctctgttttgaagttttcagatatggactataaactgtcttctgtggggtttcttcttaattgcctgcaaaatttcatgaaattagcacctactgtataccttcttgtgtctagctaggagactctcatcacattgttgagtgagtgaataaatgaatacatttcactttgtggaa

SEQ ID NO: 219840 - DNA, 411 bp, Homo sapiens
gtctctgtttctgccaaaccacatctcgaaaggctcaggatgaaaatgtaggtgatagactcggggcctcaggtggaaggaacccctccttgaaacccccaggacaccatgcccgtgaagagtttcactgattgtctgcccaaggttctgagcagcaaaaaggaatccctggacccagcaagtgcctgaaatcccacatagtctcaggtccctgaggatcacccaatgtgtacttggcttccccttcgaaatgcctttccttggtcataagtgaccaaaaactggggtagcgttggggtagccgctttccagaagtgtatcgtgccacatcgtatcatatttgctgctgctgtggaaaagtgcatgcatggctcataaaattacggtgtttggagttttaaaatctggccc

SEQ ID NO: 219841 - DNA, 509 bp, Homo sapiens
agctgaataaaattattttcataaaaatgtactaatttgtcctatgtgaaaaggaactaagagattaaaatctagaatttgcttattaaagctagaattataaagtctagaagtctccatatttttatatttaaaggaggaatgactgaggagttctagcttccagtcttaatgtaagtggtttgaaatgctttactgttaaaaggaagttacagagctgggcgcagtggcttacacctgtaatcctagcactttgggaaaccaaggctggcagattacatgaggtcaggagtttctgaccagcctggccaacatagggaaaccccgtttctactaaaaatactatatatatatattagctgtgcgtggtggtgggcgcctgtaatcccagctactcaggaggctgagggagaatcacttgaatccgggaggcggagatcacagtgtgccgagatcgtgccactgcactccagcctaggtgaaagagcaagactctgtttcaaaaaaaa

SEQ ID NO: 219842 - DNA, 330 bp, Homo sapiens
tagtagagacggggtttcaccatgttggccaggctggtctcaaactcctgaactcaggtgatccacccgccttggcctcccaaagtgctggcattacagctgtgagccaccatgcctggccaataaaaactcttataaatgaaaatctatttataattatttgagcctagaagctaatactgttatacagacatgaagtatttttcagttttagtgtacagtgaatatactggtttttattctgatatctacctgtctacctttttattttctgtatgatgtatggaatggcttctgatcccctctcaaattcagaattattcattagaa

SEQ ID NO: 219843 - DNA, 1083 bp, Homo sapiens
ttagacataatccaaatgttcttcaatgagcaaatgactaaaaaacctacagtacatccataagttggactactattcagcaataaaaaggaacgcactggtgaatctccagagaattaaactgactcagaaaaaccaaaatggtacattccttttggggaaaagttctccttagtctggcaactattaatctcctccatttctacaattttgtcatttcaagaatgttacataaatggaatcatagttgccagactaaggggtaggctgaagaaggagggaagtgagtgtggctagaaaagggcccatgaggattcctgtgggcttggaaatgttctgtgtcttggctgtatcagcatcactatcctgggtatagtaatagtgtacagtggttttgcaatgtgttaccattgggagaaactgggtaaaaggtataagagatctctgaatttattatttgcacgtgaatctacaagcatctcaaaataaaaagctaaaaaacaagcaagtggccagatacgatgtggctcacacttgaaatcccagcactttgggacgctgaggcagagggattgcttgagcccagcatgaacaacatagggataccctgtctctccaaaaataaaaataaaaaaattaggcatggtggtgcatacctacaagttccagctacttgggaggctgaggtggaagaatcccttaagtctgggaggctgcactgggctgagatcacaccactgcactccagccagtgagactctgtcttaacaaaactcccaaaaaccaaaaaccaaaaactctttattgacaaaaacatttgtctctgactgtggggtaccttggggctaacctcagtgtgtggaagaacacttaggctgctaaatgtttagtgtagagaaccacccactagctatacttacccatggtcaccataaatgctgtgcatgtgggggtgactgagtgttcatctgagaggcacggtgtaggtgaggagctctcattcaatgtgaagatgctgggtttgacggggggccgacagaaaggatctatgtgaagaacattgccatagtctctgtaacagag

SEQ ID NO: 219844 - DNA, 542 bp, Homo sapiens
gtatttctgcagcctaagaaaactgcagcattctgttcactgagaaatttgtgcttccataaaaaatgattttaaaaccctatctattattgcagtgaataaaatgagattttgagcctattgttggatttaatcattatttttatggcagaactggggttgtgggagtagttataaccagttgtgttcttttaatctcttttattaagtcatttatcataagtaaaattcagtttctgaccttggtgctttatttaagtttccaacttatctgtttcttagcatgttttgtgttcccattttaagtctgtaagggttatagaatacttatttcattttctctataagaaactgtttagcaatctaggatagtgttatgattaaatggcaaaaagaagagataatgtcaaaattaaagctacttaacagtaaggggcatggaaggctacatatcaaacccatctacactcaagcttcattttcaataggggattttctatggcctcttggctttcttgcttagcttaatccaagatttctga

SEQ ID NO: 219845 - DNA, 463 bp, Homo sapiens
aaccaagttcaggctctcccccagcaccccctctcttcctgtatggctggccatgcccggaggcgctccagccagagaccctggtgtcctcagcggctcccttgctccatctcacctgctctcatgttcagtcaccaaagtcctgtcagtgccttgcagatgtcttattttttcaaatatggaaataatccttttatttggaatatattattgtaaaatatgtaagcaaatttgtcccctccccaacccagggacacccatgattaacactttgctgtagaaggtccttcacactctcgaatttgttaatttgaatgtgtaaagatctcccttgttctctttaaaggctgcatagtagtatttcactgaatgtaccataacttatttaaccgatctgctttcagtggacattacgttgtttccaccttttcactgtaataaacaatgccgcaacaaacaaccg

SEQ ID NO: 219846 - DNA, 430 bp, Homo sapiens
catactgcttctctattagcaaaaggccttgtggaaaacttaccttgtctgcttctgtttgtcactgcccagaggaaagtaaacctagttgtgcagctttggccaatattattattgggttacatttaaaaaagttattttaaaaataggctttgtcttttaaagcagtttcaggttcacagcaatattgaatagaaagtacagagggtttctatatacctcttcaccaaccttatgcccaaccttccccattatcaatgtcccatcccagagtggtacacttcctataattcatgagcctacattgacacatccttatcactccaagtccatggtttatattggagttcactcttagtgttgtacattttatgggttttgacaaatgtatactgacatgtatttattaaactatcatacagaatcgttt

SEQ ID NO: 219847 - DNA, 427 bp, Homo sapiens
gcttttgttttctaggttatctgccatagaacctgttttctaaactgctgtaaaattaaacactgttttggttgggatgactgacaaggcatagatttaattcagtgcacaagacacagagtccaattttggtacagcataccaggtgttccatgatgaacatttgttcatctaaatgtccctggatatggtccaagctgttctctcctgttattaaagtactaaagtaataatagtaataaatcaatgttttggtgctgaaaaaaaatttttaagcagctggcaaaaacatggttcccagccgggcacggtggctcatatctctaatcccagcactttgggaggccgaggcaggtggatcatgaggtcagtagatcgagaccatcttggctaacacggtgaaaccccgtctctactaaaaatacca

SEQ ID NO: 219848 - DNA, 500 bp, Homo sapiens
tatatataatgaaaagaatatatatataccagaaataatataggaggaaatgattaactgactctagaaaagcttgtggaggagacactatccaagcactattttgcttgaggaataggagttcacaaggaaatctgtgagggaataagttgtacaaagacatggtaggatgaagcagcatgatgtatgaggaattccaggtggtttggtctgactagagtctaaaaggtgaggagggggattatgggagagataggcagggccaggtcacaaagggaagatgtgataataccatatataggaataaaatggggggttttgtgattgactctgaattcaggtccaaccaatttaatggagctgctagaaatgttaatgtacgccaggtgcggtggctcacacctgtaatcccagcactttgggaggccaaggcaggagaattgcttgagctcaggagttgaagactagcctaggcaacatagtgagactctgtctctaca

SEQ ID NO: 219849 - DNA, 499 bp, Homo sapiens
agcataatcacctgagcttcctaataagacaaagttctactgacgctggtaaccaggtcagcttgttgagaacagtcttggtaacagtcttgacagctagctagttggtggttctctactcagcactcatgcctgtggtcccggtcttttagttgtctcagaaaagcaattcatatggaggcctttatgttggttgatggcccctgcagatatcttcatcttcaacatgggcaccaaatccagtctcatctgcaacagctctttctagtttttttctacccgtaccgtggcaggccagatctcaataacgcaggcctccataacaactgtttcagcactgagtggttaagttaaatattaaaagctgaaagagtgagggcccttatgcaaaggctagaatgtaacaaaaggccaccaagggttttgcccaggccttttctgggccttgaagcatgacaagataacaaaggaacccatttaggattaaacaagttttatt

SEQ ID NO: 219850 - DNA, 149 bp, Homo sapiens
cgagtagctgggactagtggtacaagcatgtgccaccatgcccagctagtaagtagttttgacccatgaaggcagacaaagagatgtgacttgtagagttgaatttgtggcaaagaaacagtatcacactgtatgtcaacacacaagtt

SEQ ID NO: 219851 - DNA, 464 bp, Homo sapiens
ccgggcatggtagtgcatgtctgtaaacccagctactagggaggctgaggtggaagaattacttgagcccgggaggcggaagttgcaatgaaccgagatctcgccactgcactccagcctgggtgacagaggaagaatctgtctcaaaaaaaacaaacaacaaaaatagagacatcaaaggatggtctgatgaaggcaagacaggggctgggggacaggagaaggcagggttcctgtgaatgcatggggggtggtcagggcaggcctccaggaggtggcgtttgagctgagacctcagtgaaaagcaggtggccgtgtgcagggagggggaggttctcctggccagaggttggaattgcatccttctaaaataggaaacaggccaagcgctggtggctcacacctgtaatctcagcactctgggaggctgaggcgggcagatcacaaggtctctactaaaaata

SEQ ID NO: 219852 - DNA, 546 bp, Homo sapiens
ataatactttactgttagccatagtcaccctactgagcaacagaacaccagaactttttcctcctgttaaattgtaactttctagccactgaccaatctctcccatcctttcctccccagtctctggtaaccacctctctgtacctctaatatatcaattttttttcagattatacagatgagtgggatcatgcagtatttgtctttctgtacctagtctgtttcactcaacttatgtcctccaggttcattcatgttgttgcaattgacaggatttcattcttctttatggctgaataatattccatcatgtatatcggggggttcgatcttttggcttccctggtccacaatggaagaagaaggattgtcttgggccacacataaaatacactaaccctaacgacagctgatgagcttaaaaaaaatcacaaaaaattctcataatgttttaagaaagttcacaaatttgcattgggctgcatgtagccgcgggctgtgggttggacaagcttgatgtatgtataccacgttttctctatccag

SEQ ID NO: 219853 - DNA, 501 bp, Homo sapiens
gaaaagacataaccaaaaacggaaactatagatactgttcttttttaaagattccaaaaagtcgttagatgtgaatacttccgcttttaagtacaatgtagtaaaaacagaaagcaattacaactagaaaaaagacattttacattaaagataacaaagatatatagatgcatatgagactggaagaaataaattctagagagagaaatgtctttgttatatgaacctagattgctggccattgtcttgcctggggcattttctgagtctggacacaggctttcatagacagagcaagcaactgtactaaagggaaaaaacagaattgtcttattgccagttgagtcagcatggacaaattggaatctacaagatcatcaaatgaatagctgttttcctcacagattactcactgaatgctagggcagtatagcagactggtaggctgagccacaaagacagacagaaatcaactggaggccaagtcatgctcaaggcaag

SEQ ID NO: 219854 - DNA, 301 bp, Homo sapiens
tgttgcaagtaaagctgctatgaagattcatgtaaaatcctctgaatgggcatatgctcttagttttcatctctaatagaagtggaatagacagctatcatgtctgtaatatgcaaacacaaaggctgacaaaactgatttctaaagtggaaactccactggataaccttgactccagcctggcttttgagattatctcctatgtttgtgcaatgattggtcctggggtagccacatgacccaaggaggaccatgtttaaacttctgagttttcatcgagattaacatgcatttgttgaaa

SEQ ID NO: 219855 - DNA, 430 bp, Homo sapiens
tgtttttagtagagacaagatttcatcatgttgcccaggctggtcttgaactcctgacctcaggtgatccacccgccttggcctcccaaagtgctgggattacaggtgtgagccactgtgcctggcaggattattttattttttgtgataaggtagggtgatgtggtgaaaagaacacaggctttcataagagaggtagacctagatagataattcttgttctgtcattcactagctatgtgaccttggaagttatgagtccctttcaaacttgcatttgattcatctataaaatattaatatttttagcttattcaacaaatatgtgttgaatacttagtatatatcctattcagagatgctataaatatagtggtaatccagataaaaaagatacctgtcctcttagatctactctataaggagagag

SEQ ID NO: 219856 - DNA, 415 bp, Homo sapiens
tgggtgacggccagaatcacactcaaagaaaaagaaatgtacaaagtctaataaagttgtaaaactatcttcaagaacagaaaagaccaccttcaagaatgcttaagtggagagagttaccaagttgcaggatgggaagacctaatgctgtaaagcttgaagttgcagttaaaatcccagtggggtttgttttaaggacctggccagttgattcaaagagtaaacctaagaagattggggaaaataagaatgaggggacttaccctatcaggtagcaaaatgaactcaagctgtgggaatcagaagctgtggtgtggatgcagaaatagaatggagatcagggcaggattaggaagtccagaaactgaccctgaacatgtggaaagtcagagtgtgtgaaaggtgtcattttgaa

SEQ ID NO: 219857 - DNA, 463 bp, Homo sapiens
aagtagatcgcccttagctctgtgtttttttcctcttgaaaaactcagatatgtaatcagttgtgcttgatattttcagtgtacaaactattttgtagtctgtttggaagattaactctttcaagaccattagattaggacttatcaaatgactgttgcatactgctaatgggcacctgggtagtatcgtgtagcatcactggacatgtgctccttagtcaagaaagcagactttttctttttttttggaaatagagtcttgctctgtcaccaggctggagtgcagtggcacagtcttggctgactgcaatctctgccttctgggttcaagcaattctcctgcctcagctactcaggagactgagttaggagaatcccttgagccccagaggcagaggttgtggtgagccgagatcgcgccagtacattccaacttaggctacagaatgagactctgcctcaa

SEQ ID NO: 219858 - DNA, 443 bp, Homo sapiens
tcacttacatctggcagttaactttcagtagagacacctacacgtgacctgggcctctgcacagtatagtggctgagttccattagtgaccatctaatgaaagagccaggaagaagaagctgccagtttctagggcctgagcctgcaaactggcacagcatcacttctgaaatatattatttgtgaggtagtcacaaagctcagagtcaagaggaagggacatagacctttacctcttgatggagaagtagcaaataattttgaggctatgttgtaaaaattaccacacatgtattcatatgtctgttagataattttcataatatcttgttctgcttttcactcttctgtggaggacagtgagctagctacatatttctttcttggtatctctcttttttccctctttaaattttttttccctttgtatcttaattaaaaca

SEQ ID NO: 219859 - DNA, 332 bp, Homo sapiens
tttaagaaaaggtgctgaatataattaatcatcagggaaatgaacaccaaacctcaatgagccatcacctcacatttacagagagataacacaatgagatatcagatcatgagatatcacctcataccgttagaatgtctactatcaaagagacaagcgatcacaaatgttggtgacagtgtggagaaaaggaaacgttgtatgccattggtggaaatgtaaattgatccagccattatgggaaaaagcatagaggctcctcaaaatattaaaaatagaagtaccatatgaacctcaattccacttctaagtatatacctaaaagaaataca

SEQ ID NO: 219860 - DNA, 213 bp, Homo sapiens
aagtgtgggcactgtcgcaccacacacccagatactactccaggcacgggcattaggggctcccacaggctggacaggccttggactttcctggttgaaccgtgaggccgcggtgtcagtccacactccactgtgggtggcgggttcggccccgcgaggaggcgccgctctcaaaccccacggtcccgcgcagcgaagaggcgaggcggccgc

SEQ ID NO: 219861 - DNA, 486 bp, Homo sapiens
gggaacaggtgagtaagtagagctatcagtatagagtcagtcacctattttacaatcaagctttcctcggtaccactaaatgttttctgtgacttcattccattaagaatagccaaggggccaggaatggtgactcaggcatgtaatcccaacattttgggaggcaaaggcaggaggatcatttgaggcctggagtttgagaccagcctgggcaacttagtgaaacccgtcttttaaattggttgggtgtggtggcacacacctgttaatcctaggttttcaggaagctgaagcaggaggatcacttaggcccaggagttcaagtctgtagtgagctgtagtcatgccactgtgctcctgtgggcaacagggtttaaccctgtctcaaaaaacgggggaaaaaaagactaaccaagcttttactttaatgtcagttgttaacttggtccaaactggtcaatggtaatcttgtttatatattttaac

SEQ ID NO: 219862 - DNA, 862 bp, Homo sapiens
agtgggtgcccaagataataattcttcttccaatgtggcccagggatgccaaaagattggacacacccctggtccgaggtgatatagcagtacccaggcaagaaagaaagaagaggccgggtgtggtagctcatgcctgtaatcccaacattttgggaggctgaggcaggcagatcacttgaggtcaggagttcgagaccagcctggccaacatgacaaaaccccatctctactaaaaatacaaaaattagctgggcgtggtggcgggcgcctgtaatctgagctacttgggaggctgaggcaggagaatcgcttgaacccaggaggtggaggttacagggagccaagattgtgccattgctctccagcctgggtgacaagagcaagattccatctcaaaaaaacaaaaaagaaaagaaaaaaagaaatatacacctactactatgtacccattaaattaaaaaaaaacaaaaacaaacaatgtggtgagaggactgcctagggaggccaagcttatccaacccatggcccatgactgcatgcagcccaggagagctctgaatgcatcccaacgcaaatacgtaaactttattaaaacatgagattcttttgccatttttatttttagctcatcactattgttagtgttagtgtattttatgtatagcccaagataataattcttcttccaatgtggcccagggatgccaaaagattggacacacccctggtcctaggtgatatagcagtacccaatcaagaaagaaagaagaggccgggcgcggtggctcacgcctgtaatcccagcactttgggaggccgaggccggtggatcacgaggtcaggagatcgagaccatctt

SEQ ID NO: 219863 - DNA, 422 bp, Homo sapiens
gaatataatgaaagttttatgaacatttaagttgcttagtgtttttaagtcactccattcattctattaagtctgttctgttatttatttattgtacaaactattctaatgctatagtaacaaacagatttctcaaaaaatagagaagtcctacagacatcacaatattttcatgtatttgtgctcttctagtactagtccattagacaaacatttctctgcagccgtcacaacttacttgcaattatttcttctccctttctcccttaatattgctggtatatcttcatattgatcattttgtatggctgtataatatttcatcaaataatgtattgtaatttatggattctcctagttttggaatttaagttgttttaatcttacctgcttcaaaaattttgttttcacccaagtccaga

SEQ ID NO: 219864 - DNA, 472 bp, Homo sapiens
acaacaacaaaacatctgttcatgtcattcctcttaaaatcctccagttgttccccattctgtccagaataaagtgcaaactccttagtttgtcatacaggcctgttatgatttagctcctgcctactttttcagctcctgcctcccccacatactctgggcatttttctcagacctggatatgcccttcccttcctttctcttcatcaagcaaactcctgctaattccttaaggctcaactctgacatcattcttgaaagctttccctaaaatgtaggtacacatctatatgttagcactttgcagttattgatactgtatatggtgtacattgaataaatgcttgctaaaccaaactgttaagggcaggactatgttattcattttatatctctgttgcttaccactgtctcataaaaggtgatattgatggataaatgaataaattattgaaagaatatatgaatatta

SEQ ID NO: 219865 - DNA, 438 bp, Homo sapiens
cctgagcatatgtttttgagtctatcagtttgatcatggaaactgacagattatcagtaaggacaacgaaatatagcggcatattggccagtctcaaatccttgaaaggtgcaaaagttaaaaagtgaaaagtgggccgggcacggtggctcgcacctgtaatctcagcactttaggaggcagacacaggaggaatgcttgagcccaggagttcaagactaacctgagcaacacagcgagacccccatctctacaaaacatgtaaaaattgtccgggtgtggtggcgcgcgcctgtagtcccagttactcaggaggctaaggtggaggaacctttgagcccaggaggtccaggctgcagtgagccaagactgggccagtgcactccagcctgagtgagagcaagacgctgtctcaaaaaaaaaaaaaaaagaaaagaa

SEQ ID NO: 219866 - DNA, 243 bp, Homo sapiens
agccacagatgaatggagctcaaaaccattctgctcagtgaaggagtcaaacacacagcattacatatcacttgattccatttatatgaaagtctagaaaaggcaaagctatagtggcataaaggtccttaacagttgccaggggctggggccaggagaggggatcggctacacagggactcaaggaaatttctagggtgatgaaaatgttccagatcttgattgtggtgatggctgctctat

SEQ ID NO: 219867 - DNA, 509 bp, Homo sapiens
gaacagtaaacacacaaatgtgtgaatccatgagtattagatacagaatgatctgtaaggtttccagggtgtggagatattggttgggaaagagagtattagtccaaatctgagaagtcaaatacaaaggccaagaatttaaatggtttatcaagttgaaggataaagcaaggtttggtatcagatggttaggcataaggttacgggtgtatatcagaagaggagttctcaattccaagaatgtggtccatccattgctgtctggtcttaaatactctgctgagctagcaacctggtcttaaagggatcgaataatgtcagacaggtctgtgttccttttcttccttccccgttcacttttattgagtagctacagtaagggaaatggtaggaaacaagggagcagaaagggaaataccccaaatatggggaaacatctttttttctgggtcaatgaaatatgtgtgtgtatatatatatgtgtgtgtgtatgtgtatatatatatata

SEQ ID NO: 219868 - DNA, 240 bp, Homo sapiens
atacataacattccaatagttttgttgactggaaagttctggtatttgccttctattcagccaaatacacactatatactaaacacacacacacacactttcctcagtactaattactgtacaatatttaaattctgtttatgtagtctctatcctattagacttcttacaggcaggaaaagcatctagttcattcagattcttagtatctagaattgaacctgacacccaaacatgtga

SEQ ID NO: 219869 - DNA, 853 bp, Homo sapiens
ctcaagcaatcctccagcctcagtctcccaaatagctgcaattacaggcgtgagccaccatgcctggctgagagggaatcgttaagaaggagtgggcaggggcaagaacactgtcagagacagtgtgttggccacggctactacagcaaattggctgcttcctgtgatcgcacgggttgagggctcagttccacaaggctgccccagcatcagatgccagtcgcaagctcacgtggtgcctgtgcttctgacacagggctataaaaattgaggttcccatgatcccctccttgggttcaattaattttctagaatggtacctagaactcagggaagccctttacttacatgtgtccccttataaaggatattatagggcctggcgccatggctcatgcctgtaatctctgtgcttcaggaggttgaggggggaggttcacttgagcacaggagtttgagaccaacctgggcaacatagcgagaccccgtctcaaaataaagatataggatattacaaaggatagttatgaacagccagatataagagatacacagagggaggcctgggggaaggggtgcaaagcttccgtgtcttctctaggcactgcaccctctaggaagctccatgagttcagttatccagaagccctctgcatcccttttgggtttttatgggcttcattataaaggcatgattgggccaggcacagtggctcatgactgtaatcccagcacattttgaggctgaggtgggagaatcaattgagccctcaggtggcaactgaggctgcagtgagttgtgattgcaccactgtactccagcctgggtgacagagagagagcctgtctcaaa

SEQ ID NO: 219870 - DNA, 283 bp, Homo sapiens
agaggccgagtctcactatgttgctcagactgatctcgaactcctggcctcaagtgatcctactgcctcaacttcccaaagtgatgagactgcaggcaggcatgtgccaccacacccggaccccaactcttggtttagtccagggacatcaactgctactcagaactacatctgatatctatattgttaactgattttaaatcacttatgataaaacacttttattatagctaatataatatagtgacccatttttagatgttttgctgtgataatatgtaaa

SEQ ID NO: 219871 - DNA, 678 bp, Homo sapiens
ctggtcttgaactcctggcctcaagagatctgcctgcctcggcctcccaaagtgctgcgattacaagcgtgagccactgcacccagcttgaaatgtcttttaaaaagttacaatgacaagccaggtgttggtggcgggcaaccaactactcaggaggctgaggcacgagaattgcttacacctgggaggcggtggttgcagtgagctaaaatctcaccactgcactccagcctggggggcagagcgagactccatctcaaaaaatttccatcaaggcactgttagaataaacccaatctgagcattgtctcttttgggctatgagctgtcttctaagcatggttttggccatactccatggatttgatctgtgttgttctcattgttaattgctaaatagtcactgatttctccatctctctctagctttttccttgcattcaacagttacatggaacagtattttaaaattcctaatttgttaggtttttgagctctctctccgtagccattcatttattgcattcggcaccccacaacctcgcacataaccctcccttttcgctattgtttctacactgccctacattatcaccccattccgctactaacactccatgctcacgccctgctacgtgctttcaccccaccttcccacacactctggctagcctctcg

SEQ ID NO: 219872 - DNA, 404 bp, Homo sapiens
atgtgtttggggaaaaaagaaagcaggattgtgtgactacgtttccaaacttcacttgcccttagccatagtgagttgggggcctggagattctgttttctttcacaatgatatagatacaattaaatgtatagaaagcaaaaaaataaaaaggtgagtaatgaggaacctctgattcctgagtggccatgtagttacccatggcacagagccacagttactgaaggtaaagtttgctggggaatttagaaatgaatccagctcttggaggagtcagtttactggatgcctaagaaaatgcaaacaaaataagaaaaaagggtaatattcaatcccatagttattgttacctgtcatagctaaagtaaaattaaaacagagtgctggcttcaatcttgatgcta

SEQ ID NO: 219873 - DNA, 504 bp, Homo sapiens
tagcagtctattgtgtatatttctctatgacagtacatagagacctgctgtcttctttttaaaggctgcttggtatgtattccaccacgtagatgtactgctagttcatctcctcccctacagatgaccacaaagtttttcaatgtcctgataatatttataggccactacatcctcatttttatacttttatgcatttgtgctagtgtttctataaaatagatttctacaattgagactgttgagttaaagggtatatacatagtaagttgtatatacttccagttgccccttgttgaaaccttgtaccaatcagtgcagtgtccttttaaatggtcttttcattgcctgttgcttccctgtctccccaccccccggctcttcaccctagtgctagaattgcttttatgaaactcagatctgaccatggcttgccctgtttaaaatacctcagtggctcctcactgtcagcaaaacccaaacattcatctaagctccttctca

SEQ ID NO: 219874 - DNA, 431 bp, Homo sapiens
tatgggaatatggctaattttctgcttgactccagacagattctaaattactgaggcacattttattttaaattgactaataaagaaatctcacaccccacaccatttcacattttcttgggtcgtttaatgttcccacttttctacagtggctcagtcctctccctgagagctgggtcgggaatgcggtggaggagggctggaaaacagttggacgcattgtcatttctcctctctcttcctctctctctctctaattttccctgatcaaaacacaaagaaaatgacaaaaaatatcaccctgaatcagatgccttgcttttatgctcacttacaccaaaaaacacgtacggctttttgctttccccaacataaaaataaatggaaaacattttgcaaatgtcaaatgctatatgaaaggaaaaaatatg

SEQ ID NO: 219875 - DNA, 408 bp, Homo sapiens
catccctacattaggataattagcaatcgtttaacagtaagaagagcgcctggaagtcacataaatttattccattaaatccaaattaattatgtccccaactctactgcccctaactggaacccagttggcctgcgggcaccacagctcaccctgcagaggagaaattgatgaacgggacatgagcatggaaaaagatccgaatccgttgctcttaaagtagcttacttttgcaaattgtattacatatgagcacatgggcacagtgttagaggccccctcaagaaatacatgctcacatggacactgcctgcggtgctcacccaggccctggaaggggatcgtgcaatgaagggcactgcagcatcagctttgttttatagtaaatctactttggacacctattaa

SEQ ID NO: 219876 - DNA, 528 bp, Homo sapiens
atgtatattaccgtaggtctgttgaaatacaaaatattctgaaatgtttgcattttgaaaaagacttggcctctaccaggcactaatgtgcagtatgcattgtttatacatgggcatatttatataaacagggttacaggtctgtgtaaagaagttacattgattacaagagctaatataagcttgggaatatttgtgttaatacttcagtttttttcaaataaggtcccatgtatttcttacatagaagactgtttcctaaaagtggtaaaaaggaaaacactcatctctaatgttttatactgtgccagctacatatttgacaagattcttttagttattctacttattagagatatttgtaaaggaatgtgttctgcatactaattagcattaagcagtatctttgacagaagcgagtcaccagctattctaagtaagaactgaagaacttttggatggcatggaatatttcaaatatttcaccattcagcagtctagctcgtgatgatcaaatacaccaataaa

SEQ ID NO: 219877 - DNA, 617 bp, Homo sapiens
gtttggatgctgcctataggtccagaaataatatgttatgtatatgtatatgtgtgtgtttaaacacatgtaatatatatgctttatctcagagaatatcctttcaaaaatatagaaacttaaaaaactaaagttactttaaaagagtacatttttaaaaataataaactatcattcgatttactgaatatgtgttaaatccacatttcaaataagacacgatgagtttatattgttttgtggtatctcatccaaaagagacaaagcagactaaaagagaggataagggtttggggggcaaaatggttctgagcccccaaaagtctttggaaaattttgatgctctggggttcagtaactgagcaggaggctccactttcttgtgaaactacccacaagattgacttgattcttcaaaccttcatctctctagttcttgtgactcttggcttagcatcaatggtcaaattaaattcttcaggccaggagaaatagaggtggcccttacaggcatccccccaacaaacaatcttagacagtattttatcaaccgggaaagcaatatttacagatgctaaaagataaaaggctttctaaaaaaaaaagaaaaaaattca

SEQ ID NO: 219878 - DNA, 429 bp, Homo sapiens
ggttttatactgtcttttttgaactcatgatgtcatctgattgcaacacttaacttccagagggcaactggggagaaggaagacgagaacagtctaagcatcacaaaacagaacagggatgtttccatatgcccctttcttctactctttctcctcaaggataaacatacaattttcaaaacattctaaaattctaagagctgttaccacaataaatcaaagaaacaaacaaaagacatgtttcctgagcacttactatcaactaactttctagacaaactctgtgctaaaacacaaggaaaacacacactaaacctcgctagcatttcaggaggtccagcagatcacagatacaaatgcagacaggcgctgaactttgagagaaagacaggtgactgattctgtagagactggtgacttatgaacata

SEQ ID NO: 219879 - DNA, 537 bp, Homo sapiens
acttaaggttcctatgggaccttcaaacacagacgtcctgatgaacagagagagaaagggacagaggaaacagcactggagcccattggtgacagcgccttaggcaactctctgaggagacaagcatagacaaccagacctaatcaaatcccagcttctgcctcttagcagctatacgacctggggcaagtaaattaacctttttgggactctggtctcacctaaggaaattccttttgggatttaatgaaatcagaaaaggacatgatgtcatggcaaacagaagagatttaatattttcctcttgcccttttgtgatcatatactgctttgtattataattgagtacttaacctttgcagcagattataagttttcttgctgtcactcatctttaaatcccttttgaccatatttgtaggcacagattctcaaatatttgaattgccacaagtcatatgaaaaactaaggccagactgttctgggggaccaggggtttcctgcttttgacattaaataacaaatgcaaagatctc

SEQ ID NO: 219880 - DNA, 622 bp, Homo sapiens
aaaagagaaacctaaccactcttcagcaaacaacaaaagcttggatacatgaacaattttacagtcatcattttataacagaatttatctaattttgaattattaggaaaagcagagggaacaatgaaacatagattcctactgattcaaacttggtattttccaactacacttcatatttctcctataactcagagttcttccaatgccataaatattgcatggtcaatttcagacctagaaattgacatttcatctagcaaaagggctgattgttcatgatggaaaattttgtgttccacctttaaaagctctgcataacataaaattctaatcttccttcaggaaccagtaacagtttaaaccacccctttacactaccttggttaacagaaaattccattcacatagaagactaagaactgatctgtgaacattttaggaaaaggtttttcattatgaaatcagaagattaaactctactaataactaactgcataatcttggccaagtcaataaaactgtctgaggctcagtttcttcatctgtaagaggatgagatttgactgacttctcatgagtcatttccaaagctctaatgacttgaaactctttattaagt

SEQ ID NO: 219881 - DNA, 227 bp, Homo sapiens
acaaaccccccgactgcatttgctattgtgccctttgtccaaagtaatcaacataccaaagtgtcatgttttggggtggcatttcctaaactccctcaaccagataaggtaatatttacaagttcctggaatgaggacacagatacatcttttgaatgggtggcccccattcagctccctacaataagagaataaacagtggttttttaatattgtctatgctgctt

SEQ ID NO: 219882 - DNA, 415 bp, Homo sapiens
aaataaaaacagccagttaaatacaaggttgccagagtcctcaacacaaatattgaaatataacttgtaagctttaagacaattttaaaaagatgttttcaagtataatgacacaaattcagcagaggaaggtaataaggtgattacaaataatggttaacaatagagatcggggcaaacccctgctgtggcccttagagctaagtgaactttggcagagaatgtcaacattctgtcttggattatatgccattaaagtgacaaaggtatgtatctcaaaaagctgccatgaggattaataatatatacagatacagtgtcataaagtttctttgtgagtgtgtgtttatacaaacatgttgatatgtttataccacatatgtgtatatagtcttaatatacaatttaacagtta

SEQ ID NO: 219883 - DNA, 367 bp, Homo sapiens
ataaaataaaataaaataaaatcccagcaggtatgacctctttgggttcctttactgataagaaagactctttgattccaaaagcctaaaaagtccaggatcatagtaaggaaggattggaagctactgatcaaatacttggtggagttccaggatcaatctatttccagtgtgttgcagaaaagttaatttatggcagaaaaccatgattaatttcagaataaacaatattcagactcaaagtgagttatgagttactggagagaggaggcacatttagtagaacatgacttattcagacatgtaattctttccttagctcagtaaagctaagtatggcaaaaatgccagaaacagctttgcaatg

SEQ ID NO: 219884 - DNA, 424 bp, Homo sapiens
gcaggaacagggaatcgggtcctctgctttaatcacccacacaaaatttaggcaaggctgtaggtttctggaaggagcagggctaggatttggagattagaggtgaaagcactaaaaaaatcacccgcgaagccccagccccatctctgcaatctttacatggggataaacgcgctgagcctgcctcctgtggtaccccaacaccccccaggccttgctaaacatggtttggtttaggtttgttttgttttgttttgttttgttcccttggactgctccctagccacctccatgttaccgcagctttccaagaagtcacttttgttgtcactaggccagaagacagttggcatccttttaggtcccacataaaataggacatttcaaaaccaggagttccactgtgtgcttttggcgcagggag

SEQ ID NO: 219885 - DNA, 435 bp, Homo sapiens
tgcttaatcatttctctatgcttgatgttccttagaaaggaaattgttagacacaaagctgattcacactgatagctatcagtttctccctgtcaaagccttgggaagcacatccctaggagagctgaaataaaacactagaagatttccccattcctaaattattccctgattttatggaaaaggttctaaagaaatgttttctctcctgacctaatactggaagctagaaatagtcaagtgggactattcctctttcaaaattaaagactgttgccagcatactgatgagatttttacctctatgaaatagccaatttcaaatagtcagtagccaatcctcagtttcctgtggttgggaagaagatagtgagatacaggacagataacgagacctaaatagtcagctgtttctggaaaagtatactcagattt

SEQ ID NO: 219886 - DNA, 541 bp, Homo sapiens
gacctctcactatcatgaccatgaatgaaaccttccagaagctggtgctgtgcactgccatgcttaggtgcatgaagtggttctgccactggacctttgctgaggacacttctttttggcatcccaagtaaaatgactcctaataaaagctctgtatattgagtgcttactatgttccatgcatcctggtaagcacttcatgtacatgatctaatttagcacttactgataatcccgtgagctgggcattaagcccagatatagaatcttaataactgatgcctcccatgattatcctagctgaaaaatgatccctcctctgtctatatccttacatagctttcacactttatattacagatcattgcatcttcttatttttcctatcagattttgtattccttatgattaaattttgttgtatgcaactttgtgcttgcagaatcttgcacttcagtaagtctgagaacatttttcttagtctctaattatattttatttcagtcactgatcacaacaaaatttgtgggcaaaagttgtg

SEQ ID NO: 219887 - DNA, 613 bp, Homo sapiens
ttcctagttatggattgatgacatctcgataccactgctgtgatgcgtaggaacctccaaacatgaaatgaaacttctaaaaggaaaggttttgtggggagattctagatgcctccatgcagcatagaaaggaatctttaggaaatatactatttcctattttataatgtctgtctctaagttgaatggtaaaattttgtcaaacctagtgtgtgttctgtgggcattttgaactcttagaaactgatgaaagtgaattctcttcctctgttcttgacccagatccttgagagcgaaagggaaaaaagattatttgatggccctattaaacacaccattgtaacttaaaatcatcctctgtggaagttcataaccgttcattatttgcatatatattagcctttaaaagttttagaagcctgtgtaaataatctgttggaaatgtattattttgctttatttcaagggctttatctagccttgttccattgaaggactctggttaagcttatgtacacaaattatgaaattaactaatactttcaatgataatattcctggaacataaaaagaaagtagacttaaataaattttagtgggattcagttgaaag

SEQ ID NO: 219888 - DNA, 109 bp, Homo sapiens
tgttagagtcaagccagcaaatacagagatggtttccaccgtgagacccaggggagcctcgcttctctggggaaggtgaaggaggcttttctgctccctgggctggtgt

SEQ ID NO: 219889 - DNA, 679 bp, Homo sapiens
acgaaaccctgtctctactaaaaatacaaaaattagctgagcatggtggtgcatgtctgtaaccccagctactcaggaggctgatgcaggagaatcacttgaacccaggaggcggaggttgcagtgagctgagatcgcaccactgcactccggcctgggtgacagagtgagactccatctcaaaaaaaaaaaaaaaaaaatacacgaaagtataaaactcactagtaaagcaatcacacaaaggaggaagagaaaagaattaaatggtattactacagaaattcaccaaaccgcaatgacaaataataaaagattcacaggttctaaagactgggaaaataaaattaattaattaaaataataagagaaaaagaaaggaacaaagagtatacaaagcaaacagaaaacaattaatatgacaggaacaaagcctcacatatcaataatatcaataataatcttgaacataaacattaaataatccacataaatgatacagaacggctaaacagattttttaaaaactatcttccaactatatactgcttacaagaaactcaacttatcaataaaacacatatagactaaaagtaaaggaaaaggaaaagacactccagacaaacagaaaccaaaagtgagcaggagtagctacaattatatcagctaaaacaggctttaa

SEQ ID NO: 219890 - DNA, 430 bp, Homo sapiens
aatgggcacaaggggttctttatagacaagtaggtcacaaagaggcagttcttgggaaactcttggaaatactgagtcctcttgagatgctcaggccagttgtattttgtttgagttgtataggttaaagtacacacaattacctaattgcagttatctaatgttaacctattttctatcatggattgatgaaaggaaatcaggttttaacagagagtagtttagagtcacctcgaactaaatcttttcacccagaatcaaagctgagcttggggcttgggcatttttcaggactttaagacatactgacttcaaatctcctgcagattttcattattctcaagagattcctacaaagagagtgcagtcttttggttgcagcttattagaagaaatgaatatgtctctctttgtgataaaataaaaagag

SEQ ID NO: 219891 - DNA, 415 bp, Homo sapiens
gcaaatgagtttttattatttttattaggaagtacctataagctgagaaaaaaaggcggcagagaaactggctctattatagccttgcaatgtagtgtcgaaggagagagaagtacaatcaggagttccacctccagagacagaagttgaattcggtagtctgggggatttccattttatcttctcagaaatgcccaaattgctaagctgaggatcacaactgaatgcttctcatgtctatctcttactcctctctgcttccgcatagtaattcctcatggaattattaaaatagagctcaaaagttattttatcaacaaagaagggtaaactggaaagactgtttcctaccccacagccaggattcgaggaaaggcaatgatatcggataaaataaatgatagctggcaatgtg

SEQ ID NO: 219892 - DNA, 197 bp, Homo sapiens
atttattttactttgagtataataactcgcttgtagttgtaacaagcaaacttaaaccaaaatattctaaattatacttgtcatattaatccaaaaagaacaatatttaacctaaatgtaaactaaaagccaacatgttgatccactaattacagaataataaaagccagactaaaatcaaagaaactgccccaggt

SEQ ID NO: 219893 - DNA, 466 bp, Homo sapiens
tgattcggattggggaactgatgctcagtgtggcacaatacctccctgcgcttacccggctagtgaggggcacagctggtttgactcccaagttcacggtgcgtaaggtttgctcactgaagaaatgtaaggaggactctggtgttgcttgggttcggggctggttcaaacacttaaacaataggtgaggtctgtatgtcctcaaaggacaggggagagactgaccccagagtgatgccgccacctaaataaggaactgaaggcaattcaagaggagggctgtctgaatggttgttgggaagtggatacctaagagaactactattttctccattcaatatatgtttaatgccatatttcatatacatatgcatttaatgcagtatgtatgctataaatatacgtgtacatatacatatgtatctctagtgcaatatttcatataaattttgtaaatacagattta

SEQ ID NO: 219894 - DNA, 465 bp, Homo sapiens
aataaagaaaacgaacggacacagactttaggaatgatgtttgattcctaattaggcttgatattaccatgtttggttactggtgtgttttcattcatgtcttttgacctgcttaaaaaaggaaagaggtcacttcaagggatccacatttcaatttcagtgtgtggcacaattactctatactaagagtctactagccgtcattcccacagtaaggcctggcttgttcgtacactgggtgcatctctgatctaattttattatggatgacagcatgacattcatttccaccacattctacaccgctccaattctgaacttggcatgtaatagccataaaataacatgagtaaagaaggggactcctgcacagaactctggaaaccaatgcccaatttacgagtccaagcatgcatgactactgtaaaccagaatggtactaaaaccaatagatatatgagaaga

SEQ ID NO: 219895 - DNA, 559 bp, Homo sapiens
ccatagccatatcttgaaggactttttatgccagccttaggagtttggactttgtcctaagaagagtgattaaaagatttttaatataaacatgataaaaaccaatttcccttatagcaccatgaaggataggtcagggagggctgtgtgtgagaacaggctgttacagtaagaaaacatggtgtctgtggagataaatatttaagtgctaaaactgataagacaaagtaactggttaggataaggttagacgaaccatgcagctgagtggatgattgtgccgtttaccaagataacatacacaagaaagaatttggaaggggtgatacttaaagtagattgtagcataagttaatggaccagtattttgtattatagttgttttgatgtccacttttttttctatcatcctccaccagtttacagaggttagaagatagatttgggggtcatttcaaatttcacatcacttattggctttctgatcttaagaggatcacttaattctataagcctcagtgttttcagtggtaaaatgataagaatacttatggtacag

SEQ ID NO: 219896 - DNA, 226 bp, Homo sapiens
tctgtcccagctctactggctgtgtggcctgggacaggtatattaacctctctgtgcctcgtcttcctaattgtaaacatgaggctggtaatggcatcctgagaggattaagtgagcctctgtattttaagtgctgagtgcagggctgggcacacctcaagtgctattgtaattgccccttctgggccatgaccaagccttgttcttagagagcattggagacttt

SEQ ID NO: 219897 - DNA, 571 bp, Homo sapiens
ttaactgaagttaatccctggctgaagttttggcttgtttttgtttttccattgctcatgagatacaaacccctgagctgattacaatttcctgctaactatccagtctggctttatcagccatttggggcatgtgtgctgatgaaagcagctcatgaaaaatacagaaaacaaaacacaccccagccataaccctggctcacctgcaggggtgtggattggcagagtggaccccagcaatccactgaagtgctctgtgcctcaattgcctcatctttaaaatgggggtgttggccgggcatggtggctcacacctataatcccagcactttgggaggctgaggcgggtggatcacctgaggtcaggagttcgagaccagcctggccaatgtggtgaaaccccatctttactaaaaatacaaaaattagccaggcgtggtggcgggcatctgtaatcccagttactcaagagactgaggcaggagaatcgcttgaactcaggaggcggaggttgcagtgagccgagattgcactgctgcactctagcctgggcgacggagtgagattctgt

SEQ ID NO: 219898 - DNA, 446 bp, Homo sapiens
caagggcagagacaagaatgggggttttaggcagaccacataggtcgttgggggaacctcagctgtgctctgaagggactgtgtgatgttggggggctcctttggactctctgagcctcaatttcctcatctgcaaatggaggcaataatctctctctctctttcagaataatgaatggaataacttgggctaagtgcctagaaatatctggcacataatatgtgctcttgtgaataccaattctcccccatttctttggataagctcagagactggcagagaggtgttttttttttttttaacttttaattgaagtgtaacatacacatagaaaagtgcatacagcttttttttttttttaatttacaatttatttcaactcttccagggctgggaatgttacaaaaccttaaaccaataaaaagtcatgtttttattctttttt

SEQ ID NO: 219899 - DNA, 445 bp, Homo sapiens
catttatatgctttcttccaatatattttcaacttgttactgaggtaaaatttaaaagtgtaccgatattaagtgtacacctcagtgggtttttatatatgcccttgaatgcaccacccaggtcaaaatatagaatatttctagcacttcagtaggtgtccttatgttccccaggcccccaccaaccccttttatcaccacggattagttttgcctgttttaaaactttatgtaagtgaaataattatatgcactcttccgtgtcttgttcaacattgtatctgtgagagtaatccatgttatatgtagtagcagttcatgttttacttctgtgtagtattccattgtgtgactacatcacaacttacccattctaccgttgatagaaatttaggttgtttccagcttgtggtcattatgaataaagttactatgaaaatgatca

SEQ ID NO: 219900 - DNA, 469 bp, Homo sapiens
ccgcccggggctcccattggctcctcgaccttttgaatcatccccggcgctgtcgattggtcgcgcgccgtggcgcgtccgccccgccccaccctgcctgggggcggggaggccggtgagcgggggaaaccgagtctggcggggcggcccggagcgcgacgtttgccaccgccttatctcagccgcccaggcgccctcgcagcacacggagcccgcgcgctcccgccctttccctcccagcgctcgcagcagtgtttggggtgccaggtggcttggcgaacgagatttttttttaagctacaaagaaaactaatacattcttgaagtgatcaccaaagatccgagctcgaaagcgtttctcggtaaaacactatgagtgccctccttagcgtgttaaaatcccacagaagcccctggaccaagcagcggcatcgaaggcgagcaggggcgcttttgtgtccgcggccgc

SEQ ID NO: 219901 - DNA, 555 bp, Homo sapiens
aagtaaacaacaaaagaagctgaagacagactggatacagacatggtgcttttatctgtcagccagcaagccatcagctttctcttttgcaaagagacatggtgtttctatagtgccatcttatacgttgggttacatgcccatcttacttgcttgtttgtcagctcttggagagcaaggaccctatcatgcatatttttattccttagtttgcagcacattctcttttatataacaggtgtttgatgtatgaagaaataaaaaagaaaggaaggaaaactctatgtcctgtatcctgaagaaatttataataaggcttattgcttttctcccagactgtataaaattcaatgatagaaaacatgcagaattatcttgtagaagaaatagagaaaatggagaacaagagaggctattaaagacaggaattaatttatggcagggtagggaggctcatgcctgtaattccaacatttcggggagccaaggttggtgaactgtttgtgctcaggagtttcagtccagcctgagcaacacggcaaaaccccatctcta

SEQ ID NO: 219902 - DNA, 533 bp, Homo sapiens
aaacgatctgccgtccccgacctcctgaagtgccgggattacaggcaggagccactgtacctggcctatttttttcctttttaaatgatttgcaattacatatatttttaacaaagcaactacaggataaccagattccaaatgaaactacgcctggatgggcgaggtacacgtggtacaactcaaagatgcacactcgtcttccagggtcgaaactactgcataatagttttgtttttttttttcctgagatagggtctcgctctgtcatgcaggctggaggacagtggagcgatctcggctcactgcagccttaaactcctgggctcatgccatcctcccccctcagcctcccaaagttttgagactataggcgtgagcgacctcacccagccctgcatgataattttaaaatagaaaaggaaaaatacaacttgggaaaactgaaattcctaatgtctagccaaaagaaaaagcaaaataaacaatacatggaggaaaattgtgtgcagctcctatccgcacacgtcttc

SEQ ID NO: 219903 - DNA, 268 bp, Homo sapiens
tgatacggggtctctcactctgtcacccaagatggagggcagtggcacagtctcggctcactgcagcctcgacctccccctcagcctcccaaagttttgagactataggcgtgagcgacctcacccagccctgcatgataattttaaaatagaaaaggaaaaatacaacttgggaaaactgaaattcctaatgtctagccaaaagaaaaagcaaaataaacaatacatggaggaaaattgtgtgcagctcctatccgcacacgtcttc

SEQ ID NO: 219904 - DNA, 804 bp, Homo sapiens
aagcacttagtttagtttatttatctatctcatttaatccttataacagcccaataagctagacatcattattcccattatgaagatgaggcagaagacctaaggaaggataaataattcgccaaatgtcacttaagcacctggttggactgcaatgattctaatctagatgctcttacccaccatgctgttaaacttgattgcactgcatcatacacttgataattcaacagttaatgataataaagtcaaatttacatctacaaatcatgcaagcttaaattgatactacaagtttatttcaacttaatagctgggaaatacttagggggtgttatgggctgagttgtagtccccccaaaattcacatgaagaaatcctaatcccagcacttcagaatgtgactgtatttggagataggttttgaaagagataattaaggaaaaatgaggtcctcagtgtgggccctaatccagtatgactggtgtcctcataagaagaagaaatttgggcacagacaagtacagagggaaggccatttaaagacacagggagaagatggccatctacaaatcaaagagaaaggcctcaaaggaaaccaaccctgctaacaccttgatcttggacttttagcctccagaactgtgggaaaacaaatttcttgttgaagccacccaagctgtagaactttgttatggcagcctaacaaactagtacagtgagggaatttgacaaaatttcattggttactggtacactgacctaacatgctgtgtggaccaacacaaatgaaaccataagaca

SEQ ID NO: 219905 - DNA, 602 bp, Homo sapiens
tctgttaacacattgaccttgaagaatttgtattccttttggatgtatgtatagctgcttaagccactttcagacttagattatcttttataaatgtgccttccatacagaattctgaaaatatttaccatggacaaagaagcagatttaaatcaggtacagacaagaattgaaagtgttgaataagtgaatatatttcccattctctctacttttttcttaattcttatagaactttgcagaaagaatgatacataccacagtaccagcaagtttaaagcgtacccttttgtgcaaaaataagaggttatctttgaactgccttaaaaatccaaaattaccctatcagtttgcaagtattaatcaactctggtacctgaccaaaggagtttaaacaatgatgtcctaattaaacagaaaaccagattaaccatcttgttgaaaagagtctctactttggttttgaaatcttacaattcaatacatacacatacacataaaaatatctatctatatgaatgtaatagtttacagtagggctgtgcttactgctttgaggtatgtgtttttaaaaccaaacttgatttatttatttcttaggc

SEQ ID NO: 219906 - DNA, 464 bp, Homo sapiens
tataattgtgagagacagacttcattagaagatgctggaaaaaaatgatttcccctctttgaccgtcagactgcctgttctctggttctaaatcttaaaacattttggctttaagagagcgaatgttaaaggcttatgttgacacataatccttataaagtattttgagcctgtcgttgatatttagatagtgtctgcgttaaatctgtgtatatattttttattttttctatatacattttgcttcccagtattgattgctgctacattccatacgacatctttaaatttaactcacattttaacgagaaaagtctagttcttaggctttcctttaaaatctctggaattttttatgagaagcctgctgaagaatatgcttgtttcataactgttatattcaaaggaatgaccagattaagttggtaggacagatttgctgtgttaataaagcttctagatta

SEQ ID NO: 219907 - DNA, 393 bp, Homo sapiens
gtccacatcaatgacctttccaaaaccttagccattcctcttaacctcattaacatttgtaccttcatttcctctgctgccatttagtcacagccctagagcttgtcgtcccctagagcttcccaatcacatctattcttcaccctcatgtggttctcctatctacttttctgttagacctttcctgccctcaattccttcccatccatcttattctcaatggccatgagctcacttattcttgggctaatctatcacttccccttaactctcattaaacgaccttctctatttcacaaagaagatgtgatcttcaggcaaagagttctctcactccctacacagtcctccaaatcttgtttgtgtccacaccaatcctcttctccattcctc

SEQ ID NO: 219908 - DNA, 424 bp, Homo sapiens
gcctggaaagagggtctcatgagtattcgtggatccatttgtttctgaggcccaattgctttcttgtagttggataactattttgagaatgaagaaaaattctttccaatccattcccattttgtcaatttagttcaagatagggttgttcctattttgagagaattgttcttcactgtgccacatgtaatcctttacctggagtgccttccctctcttgacttcttactgactccgtgatcctgtgcagggagggcgcagtgtgtattctcatgcttgcatttacatgggctctgatttttttctttttttctacatatgtggcatggataatttgatagagaatctaatatttttacaataagataatactgaatctatctttaatctgaatctttgctcaataagaacatatgagagttgc

SEQ ID NO: 219909 - DNA, 682 bp, Homo sapiens
tgctaaaataggtctatccccgtgaggagtttcatacctcatgacatctttaggataccctttctgtggtccaagcagctctctaaaggctgtttcccaggatcgaaaaaggagtggaggggatgaggaggaggcccagggattcccgtggcaccaaggaagaaggtgagcttccacaggacctctgtctaagtctgcccaggctgccataacaaagtgccgcagaggctgagtgtcttaaacagcagaaatgtatttctcacagctctggaggctggaagtctgaaatcaaggtgcggggtcttccctcgcacatggctgcatcctcctggtttcctcttctctctaggacaccagtcatattgcattagggcccaccctaatgacctcattttaccgtaattgcctctgtaaaggccttatctccaaatatagtcacatctgaggtgccagtcgtcagggattccacacaacttcagggaacacaatttggccctaacagcctgtccccacacccactgcacttagcttcatagtgcacattagcacatcactgaggtggtccccacaaaccatgattcgtaatgtctaaccctgtttctcaggtacttgataacagatcacttttctcccagaaggcagcaaacgttcccccgataaccagggaccaccctgcttagca

SEQ ID NO: 219910 - DNA, 347 bp, Homo sapiens
aaaaaaaaaaaaagaagaagaaaagagagtcctttgattttgctctattttttcaggatctttttggctattctgaactccttacaatattgtatgaatttaaggattgtcttttccatttctgcaaaaagttttgataggattgtgttgcatctgtagattgctttgagtagtattaacattttaaccttaataacaataagtcttcctatgattacaggatatatttccatttattcaagtcttttaaaaaatttcttaaagcaatacttttatctccttggttaaatttattcctaggtattttattcttttggatgctattataaatataattgtttccttga

SEQ ID NO: 219911 - DNA, 338 bp, Homo sapiens
aatctttctcattgctttctgagagttagaattgattgaaaaccaatatgcgagcatatagaagctaattcagtgtgcacgtgtgtgcctgcatgtgtgcacatgcgcgtgtgtgtgcatgtgtgcacacatgtagagcctgtcctagtgccttaccacagcagactacttggtgagcaggaaagagagctggccagcacacacttggcctggtgctgcctccactgtttctcttggcatctcaggctgtcaactggctgccacattgattcaaggctgtcatttttttttgtttttagatgatttcttccatttttgattttttattttcgaaggag

SEQ ID NO: 219912 - DNA, 359 bp, Homo sapiens
gtacaaatgaaagaaaaatacaaaaacatttaaactttactaaaaactgatcaaatctcaaaataaatcttaatcagttcatcaatcattaaaaatatatttagggtctgctgtgttttcagctctctgtgagcagttagatttgattttgaactattttcatttgtgtatggttctgtatgggcctttatttcttcatcttcataaacaccaagataaattattggtctttacattcatctttgaatcaattacattactgtaatatttaatgtttttccaagagttacctttatggagttctttctctaaaatccacactctgagttgctaattagacatttctggtctctcatatg

SEQ ID NO: 219913 - DNA, 283 bp, Homo sapiens
gaccatggagggggagaggagggaggaccatggaaggggagtggaaggaggactccatggtgtggtgagctctgccagtgctgtccctgactgatgtctttcctggcacaacctgccacctggtgtccctaaacttgagattcctcagtgagtataggagcctctgcctccgtcttcagcagggacagcaagggcgaaatgggtttagcttcgtggagtgcaggtggggcatgggagagggcaccctggttctgtccccgtcccctccctgtccctgtccctg

SEQ ID NO: 219914 - DNA, 829 bp, Homo sapiens
tattcctgacttgatacttcaaggtgctgccagatagaggttgagacaggcttggcatttaacacactcctagcagaggggaggcccagggggaagcggccaggctgggaatcaagaatatggaagacagaggtgaagaggaatggtgggtttctcatggatgttctcataagttatatatctctcaaattcatcaaagaaccaatttcagctcagagaaagtagaagcctccaggggatgcctgcatgctccacaggaccgcaaagtatctgagttacgcaatttattcagatgtgtgaggcctgaaatattacaacactctcttatctgctcccttgcgaattcaagctctcttcactctcatccactctacacaccagaatctgaccctcgcacctccaccgaagtcagcatggtcaacagctcctactgccttcagaataaagccccatggctgtctgggacttccaggataactcccaaacacattggcctccctgtccaagccttatcttccgttccacccccaactctgattgccttttgccactcttggttccacccaaaatgagtcactcaaaccacacctctccatctctctgctgttatttatactcttctttgactacagccaccatctcaagttcccacagtgtatcctgtctatcctttcagagctttgccaaatgccgtctcctccaggaagcattcccagagtccatagccagaaggaatctctgccctgcaatctcatagcacttcgtgcctcttttatggcacattatttacctttaagtaacttagagttaaataaatatcttacagttc

SEQ ID NO: 219915 - DNA, 228 bp, Homo sapiens
tcatctccagcctggcctcctgcaacagccacatacctcactgccctgcctccagtctcacgtaccttaaactgaactgcaaaccactgccagagagacctttctaaacccttcgacgctccactgctgcctaagggagaaatgtcatacccagtactttttttttttttttttttgagaccgagtttcgctcttgttgcccaggctggagtgcaatggtgctatctc

SEQ ID NO: 219916 - DNA, 536 bp, Homo sapiens
taaagaaaaacacccacacccctggagctaacctgacaactatcttcattcacagaggacacttatttctaagcacattcttttggccaaagcaggtaacatggccaaacctaacacctttgagactgggaagtgtactcttcataatgaaggctctgcacatgatagaggacattgcatgtataattctgtaaggagagaatgaaaagttgaggacaatatccaccactgtctcacagagacagagaatgttacacctttttgtggttctgctgtcgcttagtatgctctggcaaacagctgagttctagtgctgaaaaagaaaaaaatcacaggcaacactgaggaagaacaaggaaaatgacagaaccctgaggattagagtagtcaaaggagataatcacttagattgaattgcagcacaattctttctggagttaaaagacaagacttcccaacagaacagtttattcagtaaatgacagaaagcatcactgctattgaatctgaattagtgacttgaaagatcaagtaga

SEQ ID NO: 219917 - DNA, 426 bp, Homo sapiens
aaaatgggaagtattaacatacatataaagcagttctgcataccaaagtgcagtgattgtctcaaggaatggtgccttctggattgaaccagagactgcagaatcatgcatgggtaaaagatccattcaaagtgcaaagtaggctgggcatggtggctcacacctgtaatcccagcactttgggagcccaatgcaggtggatcacatgaggtcaggagttcgagaccagcctggccaacatggcaaaactccgtctctactaagaatacaaaaattagccaggtgtggaggcgcatgcctgtggtcccagctactcaggaggctgaggcaggaaaatcgcttgaacctaggaggtggaggttgcagtgagccaagatcatgccactgcactccagcctgggcgacagaacaagactccatctcaaa

SEQ ID NO: 219918 - DNA, 579 bp, Homo sapiens
cgagggtctgaggtgggaggatcacctgagcccaggaggtcaaggctgcagtgagtcgtaattctgccattgcactccagcctgggcaacagagcgagaccctgtctcaaaaaaaagaaaggagcaacagtctctactcagatctgtatacccaaatctatacccaaaagaactgcttttatataatttttaaataaaacttttcaaacacaaaggagcgtaacataatgaaaggcatgtatccatcaaccagcatcaataattataaaatcgctcttttaatgagtataaaataagaactgaacttaacgtttaattggcagcgtttctccatttctgataataacagtgcaccctaaaatcagcagcgtcttagatttagggcctcagaaacaaggccacccacactggatccgaggggcaactgggcacctccatggacacccatgcttcataaagacagctgcaccctacactgggttggactgggacgttttcagctatccaaaataaaacgttggttttctaatttaaagctttgtttcatgtctacattctgctcttgtagtctgcatcttc

SEQ ID NO: 219919 - DNA, 621 bp, Homo sapiens
tgcggtggctcacgcctgtaatcccagcagtttgggaggctaggcgggcagatcccttgagcccaggagttcaaggctgcagttagctatgatcatgccactgcactgcagcctgggcaacagagcaagaccttgttttttaaaaaaagacctagagagagaaagctatgatataaactagaaaagacagtagactagtcatagagagggtgccatagaagttgcaggagcaaggttgctttcagttggggaaaactaggagcagcttcatttgacaagcacatagtatgtgccaggcctgagctactgccaagactacaaagatgaataagacagagtcctggctgggcacggtggctcatgcctgtaatcccagcactttgggaggccgaggtaggcggatcgcttgagctcaggagttcgagaccagcctggccaacatggtgaaaccccatctctgctaaaaatagaaaaattagccaggcgtcgtggtgtgcacctgtaatcccagctacttgggaggctgaggcaggagaatcgcttgaacccaggaggtggaaggttgcagtgagccgagattgcaccactgcactccagcctgggcaacagagactccgtctc

SEQ ID NO: 219920 - DNA, 239 bp, Homo sapiens
tagcacctcaaaaatgttcaggagtgccctgtaacttttacggctttctcccacattaatgctgttatttataactcttcagtgtgatgagtaaggttttgctggtgatttagacatttaattagaaagttgcatatttagtcttaaagctgtttatgaagaactacattaaaatttggatgaattttttctaataggttatatttgctacagtgaagaaaaactttgtaaatttagtt

SEQ ID NO: 219921 - DNA, 756 bp, Homo sapiens
actggggacacctcacctcttttcccctgtgtcatctccaatcttgcctcacccagttcattctgagaaaataactagttctgaggaagtgctgatcctatcatcttcagagaacttgactaatatcacgccatttcagacctgctcaggcttttgccctagagccctccttgtcaatattggaaagaaaagtagtgttggtcactttctcctggaaatgaggtgttagcgatggcttattccccatggaaaaggcccctaaggtctaaatataaagattcagagagtaaaaggaattacattcaaggaactgcagccagtttggttggatacgacagatcaaagagcagcttgcaggacagaaggaagtcagaagacacagcccttggtgcaggccctgcctgctccgtttctgtggaatgagtaggagtttgcgctggttcatctctgctttgaggctgctctgtaaccactcaccacagacaggcccttgggagaaactgagcgagtccttccaagcagccggggctgatgagacacttgcagatttcttgggaatttggattacagcccccaacagaaggccccagctgttcttcaactgagcaatctccttcaagggcttttccaagctgaggaatgcgtaatgctgtctttgtgtgagctaatggaacttcctcttagtacagagagggggtaaatgggccaccattgagtgaagaggaaattcaataaactgtgttttcccaactttgt

SEQ ID NO: 219922 - DNA, 179 bp, Homo sapiens
tgtatctgtgctgtgtcatttcattttactaattttggaaatgctcgttttcatccttgattaatgtcactgagcctagtcactggtgataggttatgaacagattttgagacttgatattcaaattttatatttctggtcactgaaaacttggaagtaaatgtccttttattctttga

SEQ ID NO: 219923 - DNA, 259 bp, Homo sapiens
agtatagaaaaaaaatgtggtatgttactttcaaataatagcttaatcaaaatgtgagtaaatagatgaagttttatagagtaaatatttcaaccttttaaatttttttgtgatacttcataaaattcataaaacatttggagctggaaataatttttaaaatcccattttctagataaagaagtaaacccagagaggctaagtggcttgtctgtagttaaagagcaggtttgatgtattcgaaactcttctggtcatt

SEQ ID NO: 219924 - DNA, 540 bp, Homo sapiens
tcttgggactttgaagagtaaggcagggcccagtgacctttagcagtggcagcctctcttggccacacgttcttctgcacggtgtgttgtggggggcaagagtgaacttgccagatttagtgaacaggaggctgcttgcttttcctctccaccctcgaattcttttggattcaactcagaacccaaagggtgtgaaagactctctcccactcgatttctaaatcacataattacaccctttatcccaggctcccaacccccaggaggccctaaagagaaggagagggtgagagaagacagagggaaacatcatcttccccaaaacccagctccccacatcctgctttactgcccactgaatgcaagatggcccaacccccaggtgtccccaacctgaacacccaggtcaacagcaaagtcacctgccacctgcacagggagcaggtagcatgctctgtgtccagccaggtgggcatacttgtcctgtggctcaggggctcttccactgttaggccaggtgctgtgaggcttgttgtgttc

SEQ ID NO: 219925 - DNA, 461 bp, Homo sapiens
ctgaataatattccatgtgtgtatatacattacatatacaccttttggttgttgtgaataatgctggtgaacatgtgtctaccgatatctgtcaagtccctgctttctgctctcttgcgtatatacccagaagtgttgtatcacatggtaggtagttcttgtgtttaattttgttgccagcctgccatattttacatagcagctgcaccattttatattcccaccagcagtgtacaagggttcccttttctccacatcctcacaacacttattattttctggggttgcttgtctttgggatttttagtaatagccatcctaatgggtgtgaagtcagagcttattttaacttctactatattctgtttcaaagccaatcaaagagagaaataagtttgcccttcagatagcttccctgttctcagagcatctattatttttctttgatataaccaaaacag

SEQ ID NO: 219926 - DNA, 196 bp, Homo sapiens
cctgtcatcagagtattgctacttgagaggtgaggtgagaggatctcttgagcccaggagtttgagactgcagtgagctatgtttgtattactacactccagcctgagggacagagtgagaccctgtctcttaaaaacaaaaacccgactgtatcaaaaggtaacatttgagtgggacttgaaagagtgtgcatgt

SEQ ID NO: 219927 - DNA, 576 bp, Homo sapiens
agtcaggatgtcgtgttataactgaactgaacccaggtctccagattcccagatcagtattctttaccaggaaccaaaagagaaacatctctactgtcattatcaacatttttttttttttgaggcagagtctcgctctatcacccaggatggagaacagtggcacaaacttggttcactgcaacgtctgcctcacaggttcaagcgactctcgtgcctcagcctcccaagtagctgggactacagatgcaggtcaccgggtctggataatttgtttttttttggtagagacggagttttgccatgatggtctggctggtctcaacctcctggcctcttaagtgatctgcccatctcagtcttccaaaatgctgcgattataggtgagccaccgtgtctggccaaagtgtcattatcaacactttaattttcaaccagactcagaaagtttatttgtggggttactatcctaggcaggttttataaggtatgactccaaagcatataaaaatggcaattgctgacaagtaaccataaaagagaaagacacagaaacctttgatttcttcttccatt

SEQ ID NO: 219928 - DNA, 290 bp, Homo sapiens
attcatggccctaattcaccctgatgtgagcggaaggcctggctgatccggagccccaaaaggaattctgacaacatgccttttgctttgtactgttcatgctgcaattcctaggtgcatctgggctatcactgaagcaatactttctatttccaaagcactttataatcattaatgatttatgccttacaacatccctccaagggaggtcagtagcaaaacacaaggaacacaaatgaagaaacaactggaagatattaagtgatacggtggaaatcgcacagcaaaaa

SEQ ID NO: 219929 - DNA, 796 bp, Homo sapiens
cttcacttgtctcagacttaactctagaattaaagagagttaagagttatagttaaagagagttagggctttgctctggattaggctttggcttaggggaatgttgtggctagtttgatcttctttacggaccactaaaactttctgcatatcagcaataaggctattctgctttcttcttattcctgtgttcactggagtagcacttctaattaccttcaagaaacgttgctttgcattggcaactaagcctaagtggtgcaagaggcctagcttttggctgatctcagcttttgacatgccttcctcactaagcttaatcatttctagtttttgatttccagtgagagacgtgtggatctttgctctacttgaacactgcagaagtcactggaaggttattcattggcctaatttcaatactgttttgtctcagggaatagagagacccaaggaaagggagagagatgggggaacagcccgttggttgagccgtcagaatacatgcatttattggttaagtttgccatcctatgtgggcgtggttcatggtgccccaaaataattacagtagtaacaacaaagattaatgatcacaggttaccataagagatacaataatgaaaaggtttgaaatattgtgaaaattaccaaaatatggcacagagacatgaagtaagcacatactgttggaaaaatggtgccaatagacttgcttgatgcagggttaccattaatttgtaaaaatgtagtatctgtgaagtacaataaagggaagcacgacaaaatgaggtat

SEQ ID NO: 219930 - DNA, 371 bp, Homo sapiens
ataatatgtctgaagttgaaagattaaggggcatgtgcatggtcagcaacacattgagagaaaaacaggcaacataagagtaaagggacggctgggtcagtggttcacccctataatacaagcattttgggaggccctggtgcatggatcacgaggtcaggtgttcaagatgagcctggccatgacggtgaaaccccatctctactaaaagtacaaaaactagctgggtgtggtggcgggcagccgtaatcccagctacttgggaggctgaggcggagaattacctgagcctgggaggtggcggaggttgcagtgagctgagatcacgccactgcactccagcctgggtgacagagcaagactccgtctca

SEQ ID NO: 219931 - DNA, 548 bp, Homo sapiens
gtagaatcaacttataataatgacttgcctttctttggcaaccagtaaactttgcctaaagttgtatttgtttttattgaaggcatagtccaaattctgcttttgaggtttgctctatatttattttttaaatgaaatggaattgtaaggacatttttggtgagaaaatgtagtattactttttcttcagagaaagtcataaatagtgatatataaaatggggaccttttaagagaagttaatgagttgtatcactgatttccctctcattattgctagttgagtagtagataattcagtatggtaatgttttgttttaaataagaggtgaggttgaagaagccataatatagtgaaggcagtcacattgctcttaaaagataggaaacctgagtaggttgagcctcatttgatagtaagcagtagtttgctcacagcagtaacataaataaggaaggtgttgtgtaaagctgtcctggtgggtcaggggagtagacacagcagacttggcagtaggcctggcttctaaaacaatatccaagtcatca

SEQ ID NO: 219932 - DNA, 419 bp, Homo sapiens
caagggcagaggagcctgtgggaggggtaagcacgagggaggccgaggccctgagatgtgaggcccgcatcctgctgcaggcgctctgcctccagcaagaggtggctctgggggacagctctccatgggggacagctctccatgggcttggacacccgtgctcccagacaacagcttctgccgtgctcccagatgagagccagagccctgcctatcgggaggccacactcatgcccaagacttctaggcctcagcagtgctcccaagggtgtggcaccaggtgaagcagggcaggtgtgtggaccaggtgtgctgggggggcagagggagggcagcaccccgtgggccagctacctcttgtgtgggcacacagcacctgtgcactcaaggtcacccatgtgcacgccgcctctccactc

SEQ ID NO: 219933 - DNA, 451 bp, Homo sapiens
caagggcagaggagcctgtgggaggggtaagcacgagggaggccgaggccctgagatgtgaggcccgcatcctgctgcaggcgctctgcctccagcaagaggtggctctgggggacagctctccatgggggacagctctccatgggcttggacacccgtgctcccagacaacagcttctgccgtgctcccagatgagagccagagccctgcctatcgggaggccacactcatgcccaagacttctaggcctcagcagtgctcccaagggtgtggcaccaggtgaagcagggcaggtggaatgcaggagcaggcaggaaaacccagctcttccaagtcagacactggagagctctgcagacacgaagacaatgccatgcctccccctaaatgctttttgttttggaaaatatagctgttcgtcataaggtatttacgttgacgtatgacagg

SEQ ID NO: 219934 - DNA, 361 bp, Homo sapiens
gccggctcactcatggttattgcatggtatattattttccatcctttcaacctatttgtagtatatattgaatctgaagtttctgctctagacagcatatagttagatcctgtttttaaattcagtctgataatcctttactttttttttgagacaggatctcactttgtcgcccaggctggagtgcagtggcgtgaacatggctcactgcagcctcgacctccctggctcaagcgatcctcctgcctcagccacagaagtagctggaactaaaggcatgcgccaccacgcatggttaatttttttgtatttttttttttgtagagacagcgttttgctatgttgcccagcctggtctcaa

SEQ ID NO: 219935 - DNA, 555 bp, Homo sapiens
aatgctcaatttatcagaagttagtaacctccaatccaagtttatggatcctctgaattctatccataaggtcccaggttaagaacatctcaaactgagggaatctaacaaaataattttaaaatttacatgcaaaattagctttctagattcacaaaagttgtatgagatttaatattaataaatgtttcaaaaagaagaaaaagtaagataagtcaataattataaactgcttgtagagaagaacaccggaaagatgatgtgggttcaagccttgtcttcaccatgtatttactgtgtcaacttgacaagtttaatttctttaagcctcaatttctcaatctgttaactgggaatagtaatagtgtctatctacttcctttagttgttgtgaggatcgaaggacatactgtatatgcaaaatctcagcaaagtgcttaccactgactaagagctccttagatattaagaaaattgtatttttcaacaatacaactgaattccttaaaagcatgatggcattcattgcagttccagttaatcacaaacagcaaa

SEQ ID NO: 219936 - DNA, 553 bp, Homo sapiens
gcactcttactaatagtatatttactattggtattagaagcaatgctgggactatctagtcaagccaggacagttgataaccctgtgtggaccactcgtgttaaaattgtctgggtgcttatttggaaatgtgaatttggggctccaaactagtctcactgaatcagaatctctaaaattggactgggactttgcatttgaacaagcacctcaggtggtactaatgtacattgatattggggaagctggagttaaaacaacagaccaaaaaagagtatgcacaggcctgacatggtagctcgtgcttataatttccagttctttgcgaggccaaggcaagaggattgcttgaggtcaggtgttcaagaccactgggcaacatagtgagaccctgtctcaaaaagagaaaattagccaggcataatagcgtgcacatgtagtcctaactatgcgggaggatcccttgagcctggaagtttgaagttacagtgagctatgatcacactactgcactccagcctgagtgaaagagtaagaccctttctctcaacat

SEQ ID NO: 219937 - DNA, 1264 bp, Homo sapiens
ccccgtctgtactaaaaatacaaaaattagccaggcatggtggcgggcacctgtaatcccagctactcgggagactgaggcaagagaatcacttcaacccaggagatggaggttgcagtgagccgagattgtgccattgcactccagcctgggcaacaagagcgaaactctgaaaaaaaaaaaaaaaaaaggaaggaagggagggagagagaggaaaaggaaggagggaaggaaggaaggagagaaagaaaagaaaggaaggaagaaagaaagaaagaaaagaaagaaagagaattttcacagatttagttccaagcaacagatgctacctcaggggcagaaagggaatttattgagaggatttggggtcactcacagaatcccaggagtgaactggggaatcaggattggaaagtgagcaggaagaatcctggcaactggccagcaatggtaacccagccacagtgacaccacggaaccggtctgatgaggccatgctggcgatggccactagacactgtagttgtctcgctgcctctgctgccccagaaataggatatggctgctcttctcattagctgttgctggtaataaatcacttcacaacttagccgcaaatgacagcaatcattgcattaagtctcatggttgctgtgggctgggatttgaagaaaggcgtggctggtttgttttggctcaggatgcaaacaaacagtgcaatcagtgatgcttgccacagggcggctgggggtgctggacaagtgggcatctctctgtggtctcagggcctcccccaccatatagtctctgcactggccagcttgggcttccccacagcatggctgcctcaaggtagtcaaactttatatggccgctgaagacccaggcagaagctgcatggccttttctagctcattttgggagttccgcaacttcacttcagctgaattctgttggttgtatgcaagtcaccaaactgcacagatttgagaggagggtgccatagaccccagctcttgatggaaagagtatcaagctctcattgtggaaacacacatgggatgaaagacactgtcacaacatggcaaaaccccattcctacaaaaaaaaaaaaattaactaggagtggtggtgcacacctgtactcacagctacccaggaggctgaggtgagaggatcacttgagccctggaggacgaggctgcagtgagccatgatcatgccattgcactccaacctgggtgacagagcaagaccctgtctc

SEQ ID NO: 219938 - DNA, 365 bp, Homo sapiens
catcatgacctggccttttgccatcatgacagcatctgacatgtactgacatgtactgaatacttagaatgtaccaagatcgcttccttagtcatcttatttaatccttccaacactctcattgggtagatgattttaccctaattttcaaaaggttaagcagtttacccacgataggtagtgagagtcaggatctgtgtgtgactggccctaatgcctatgcttcctaagtaatttcctaagtaatcaaagctgcttttaagattaactttctccaaagatgcaggtattgctcattccttttttatagctgagtcacagacataatgaatactgccagtgagctgcagtgaaactgtatcttt

SEQ ID NO: 219939 - DNA, 300 bp, Homo sapiens
tagatttgtgatgggtggtctttgggatagtgatgaggtccatggaatcaatgattgtgggtatgtagggtcagtgatgagggaatctggtgtcagtgatgggatgtgtgtggaatcaatatgtgaaagccagatttgtggtgtcatctctcaggctgacacatcctgatctgtgtgtcagtggtggaaattctatggggtcagagtgtgactgtcaggtccctgacactgtgtgttctgggtctggccaggtgcacagattcccttgccttgtcctggccggggaggcccttctcaagg

SEQ ID NO: 219940 - DNA, 365 bp, Homo sapiens
tccaaatggcatccaaatacccatgttagcaatgggtaaaagatttaagagcaacttctaaacattgatttttttcatcaagtatgattctctttttgtgtagtttgtctctttgtgtttcagcaaggaacaaatattaagcacaataaaagtgaagccctgtgaagtccaaaatctgttaatgcaccaaatatttttctagaatgtgggatggggcaggcaaaggagacatctgaaacagaaattgcattcatgtttttattcgagatctgtccttgtcaaatgtttcctacattacctggacaatccctgtctgtccctagactcctctttgcttcctataagtctgctcaactcactggcat

SEQ ID NO: 219941 - DNA, 398 bp, Homo sapiens
aaaaacataacttaggtagctatttccttgggaaccaatatctttacattggctagaactgtgaatcgccctttaaagataaagccccaaaatacattttttttccctacaggtaaccagcagggtgaagtaacagccgaagaggaaaccagaagtgaagtgatttgtacaaaatgtcgtagtgtaatttattgagtgtcatgtggtattaatcgcaacatcctgaaaatgcaaatgaataaaagtttggtcaatgtaccatgacattccttcatgtgagcctcctaagaaaaggtcactgagcattctctgtttacattttaattttagactccagaatttcacactaagtttttcttctcatttcttatgcagtaaaagaagagtttgtatttcca

SEQ ID NO: 219942 - DNA, 257 bp, Homo sapiens
aaaaacataacttaggtagctatttccttgggaaccaatatctttacattggctagaactgtgaatcgccctttaaagataaagccccaaaatacattttttttccctacaggtaaccagcagggtgaagtaacagccgaagaggaaaccagaagtgaagtgatttgtacaaaatgtcgtagtgtaatttattgagtgtcatgtggtattaatcgcaacatcctgaaaatgcaaatgaataaaagtttggtcaatgt

SEQ ID NO: 219943 - DNA, 325 bp, Homo sapiens
tgtcacaaaagaaaaaaaagtgagtctataaaaggacagtagcactctctccttgaaagtctagctgctgagcacaaagtctctgggtgtaagacatagcattacctgggacgaccctgatcaccaggattccaagcccagaaacacaggagctaaagtagagcatatgtgtcctgggatccattgcttttccaatacgaattagttttaccctacctcagaggtgggattatataaaacactatttgataactttggaaaacctgtcagaaagtgtcccatatattcacatgtatttgtttatattttgttctaaaatctatat

SEQ ID NO: 219944 - DNA, 355 bp, Homo sapiens
gctatcctcccatctcagcctctgaagaccaaggcatgtgctaccaggcccagctaattttttaaaaattacttttatagagatgggggtctcactatatttccccggcttgtcttgaattcctgggcccaagtgattctcctacctcagctcccaaagtgttgggattaaaggtgtgagccaccacacccaaccaagttttgaggtattccgttacgcagcaataagtaactaatacagtcaccttctcaatgaaatctaccttttttctaaaacctagtctttctctttctttttctttctttctctttcttttctctctcttccttttgatagcatttattatctcctaacc

SEQ ID NO: 219945 - DNA, 222 bp, Homo sapiens
tgggtaaatgtagagacaggttttgctgtgttgcccaggctggtctcaaaatcctggcctctagaagtcctcctgccttggcctcccaaagcatctggccttgtattcattttaaaaatccattctgagagttagtcttttaattggtgtgtttacatgactcactttaatataattatggatatgtttggatttaggtcttcccttctgtcattaattttc

SEQ ID NO: 219946 - DNA, 285 bp, Homo sapiens
cttgatgtcctgccctctctcaccgctcctattcaacatagtgtggaagttctggccagggcaatcaggcagcagaaggaagtaaagggtattcaattaggaaaagaggaagtcaaaataattacgctgaaagccagccataaaatagtacatactataacattccatttatataaaactctagaaaatgaaaaccaagtgtggtgatagaaagcagatcagtggttgctgagagaatggaaggctagacacagagactactaacgagaacaagggaatttgggg

SEQ ID NO: 219947 - DNA, 552 bp, Homo sapiens
gtatattcctattagccaaatggctttattagtaaatagtaatacattgtaatattgtaatagtaattacaaaagtaatattgaaatagtaattacaaacctgggaaattaaggactaacagatctttaaactcatgtcaacgacttctccaagaaactattcaagacacagcagcccaaaagataaagacacctgttttctcaccctcttctttgcttttgttttctttacgagacagttcctccacccatatgtcatcagtatgagcatttatgagaaacatgctatcaatatttgatgtctaattctctttcatatccaactaaaatgaatcaattaatctggcattcttccccaccaaggaaatacaaggtgtttcctaatcctagattttctcatctaccagcagaatgtgatcaacactactctgacaatttacacaaacaagaagtgaccactttaaagatggaatgccaagaacaatacaataaatgctaaagagaaagagtgacaaaagtgagcaactacagataatgcagtcatggaaccag

SEQ ID NO: 219948 - DNA, 385 bp, Homo sapiens
agtttttatatttttaagacagtttattattatgtggccaatgaaccagcaggtggcactacacaacaattttacacaggcaaaaataagttcccttagggcgaaaaagatgatgttttctcaaatgggacctttggaaggatatggacctgtacaacatgcacgcctaccggggaaaaaggactgaaaatagttgttcgaataggatgcccttcaccccggtgactctccatacgaaaacggaatgtgatcaacactactctgacaatttacacaaacaagaagtgaccactttaaagatggaatgccaagaacaatacaataaatgctaaagagaaagagtgacaaaagtgagcaactacagataatgcagtcatggaaccag

SEQ ID NO: 219949 - DNA, 370 bp, Homo sapiens
gtggttcttgagtatcaaaggatccagagcagtcctgatgagatctaatcataacttaatggtttttgctgctgataaaaaaataaaagcaaaagtaatgtctttgttcatacgactgtgatgaaattcagccttattaatgagagcactatggttgcatttcactaattagcattttgattcctagggtaatacttgatatcactaatattatgatatcttttaatatttaagagtccctcttgagctcgtgtacttgagggaaagttcactttggttctgatcattagaacgtggaaatccaaagatgtgaaaggttgagttctgggttcccaaacatggcttaccttcagaatcatctagggaattt

SEQ ID NO: 219950 - DNA, 304 bp, Homo sapiens
actctggacgccaaaatttggtggagcttcctggttggtgaacacatccatgtgccaggagggtgacacaacctgattcacagagagaagacacagaagctctgcatggaagacccgcccagaccccgccctacgtgtgtcttcattagtctggtcctcctgatttgtatcctttgtaacaagcctgtaatcaactttctcagttgtgtgtgtgagtacgcctggcttttcatcaaagagctttgccgtcttgatgcttccttttctgtgaacacagcaataaatagattctgcagaacaaaaa

SEQ ID NO: 219951 - DNA, 551 bp, Homo sapiens
atctgtcactggacacttgggttactcccaccttttggctgttgtgaataatgctgctgcaaacatgggtatacggatatctgtcctgctttctatccgtttgtctgtatacccagaagtagaattgctggatcatgtggtaattgtgtacttcattttttgaggacctattatactgttactttgataagaaccatccttatgggtatggcatggcactgctgtttctggtgcctgctgtctccccctcatctgcaactgccagttgaagctcatgccagcagccaaacttctcttccctcccttctctccttacctacccccagcttctaacactctcagctgggggaataatgtatcttcctcctgctgatccatgtttcaaatgtaataactgcctctggtgtgtttaatcacctgccaagccctgttaaatcttgacagaaaccattcgcatctcttccctcctgtgtgcagactgtcatttctcctcagtggccgtgccgttttacattcccaccagcggtgcctctgttcttttacctgggata

SEQ ID NO: 219952 - DNA, 306 bp, Homo sapiens
aggaatcgagggtgagggtgggcaagccctgaggaaagaagggagagggggaagacccttggggagctaggaggagctgaggttggagagggcagggagggattccaggagatccgagcccgtagctcgcttgcaggaagcttagaacagcagcagcagcagcgagggtcccgacagcacggcaggtcactatgtagcgctcatccgagagatagggtgggtgttggcctcacggacttgctccgtgcacgctgtggctgtttaaaagcacatacggctccgcgtgctgcacgacgacctcagtca

SEQ ID NO: 219953 - DNA, 562 bp, Homo sapiens
taaagacactcaaagaaaaagaaacaggttcctacactggaagcagcttagataaccagacagcacaatagctaatcagttaagtaaaaaatatcaaacaaaaacaaagacaaaagaacaaattcagcattttgttttgttttgaggagaaaggttttcaaatttcctttcagtcctccgcaagaactgcagcccccttccccttcctgctttagctatttcaacagccccctttacgaagatttcctgcaagaaaaggcaggttgataaatctgtgaataggaagctctcatccctcctttcttctcctcctcctccattcctccccccacctcgcatggcgactgcactgatcgacaataatggaatctgtaactgactgccaacagcaacattaaggatattacaagtccacttcataagaattcgagctggtggtcggaacttgggggcaattctgggcttctagtcaatagctgtctttctttgcgaggaaagaaaggaagtgtgtgtgtgtgtgtgtgtgtgtgtgtgtgtgtatgtgtgtgtgtgtgtgtgtaga

SEQ ID NO: 219954 - DNA, 325 bp, Homo sapiens
gagaggtaaggtcactcaatcattatacccactcctttgccaccattagactctctttcctaagagttgaacagaaactagcacttttgaaagacttgctccactgctgatttcaaccaaccacctcattctgcagcagagctcccttccccttttatggtctcaacgcaactgaccagcatttcttcctggaaagaaaccatggactgtggactgcttctagctggtccatggagactgtgcatagggtgcctctgcatttaaacgttgtgtctccacctcaaagtgcacatgggatgtatgtaacatgcatgtttgcttacta

SEQ ID NO: 219955 - DNA, 480 bp, Homo sapiens
cagtagtgctgagattgtgccactgcactccagcctaagcaatagagcaagactccatcacaaaacaaaacaaaacaaaacaaaacaaaacaaaaacaatgttttggccaggcacagtggcgcatgcctgtaatcccagctactcgggaggctgaggcaggagaatcgcttgaacccgggaggcggaggttgcagtgagccaagatcaagccattgcactccagcctgggcaacagagcaagactccatttcaaaaacaaaacaaaacaaaagaatcaagttcaggggtcaagggcaacaacagcttttaggtgtttgttctgtgcccttagcagtagtcatctattctaactataacattgatgatataacatttcatggaatataattttgattctttcctttatcatgcaagggctgaacaccaggctccgtgctgtgtctgcccatagccctccttcactgactcaatgagtgttc

SEQ ID NO: 219956 - DNA, 532 bp, Homo sapiens
tgagtgatgctagaaagcgtgttgtatcatggtgaggggctgagtagataaatgcagatggcctgattgtggactgaagggagacgtggaacttgaaacattggtaagttccaaagtaaagatgcatgggggagtagagggaagagagaagcaaagttgacatgggaaagaagaatttacccccctagaatggggcatggagatgtgaaagcagaggtggtttctgggaatggggaatagtttcacttaaatgtgggacacatgaaaggtaataatggtagatgacaggttgggaaggcagattggtgcaaggctgtggaacaccttgaatttcaagcttaggcattgggattttactctttgagaatttactaaagttctctgaaagaagttgatacttgtcatttggaagaagagagaagtgctttcagttttttagctaggaaactcatgtcttaagaggctaaataagtttctgaatgaatgacaacctctggcatcctgtagctgttctggggcttgtctgatgctc

SEQ ID NO: 219957 - DNA, 366 bp, Homo sapiens
cacattcatgcaacaaatatttattgagcatctgctatattccaggtgccattcaggaagctaaagacttcttacctcacaagctgcatgttctcattctgctttcctagatccaccacttccccctgagtttttaacactggattctcaaaagctccaaccttagattctttgtatatctacactcattccactggtgatcttaaccagtttatatgcaatctacatgtttgtaactcccagagtttcagctataccctggattcgccccataaattcagattcatctggccaactgcctgctgtatctctccagttgaatatttaagaggctttcaaattaacaagtccaaaaaccatgtccct

SEQ ID NO: 219958 - DNA, 501 bp, Homo sapiens
tactgctggtaatgaaataagacatgaaacacttgagagtctgttcataaaattgtatttatcagtagaagggaaaattgccttatttgtgttttagggaaagatgctaccgtacctgttaaaaacaacagattctgttatattattctaataatttaaagcatacattaagcataggctgtttgttttaaatggctaaatatcatgaaagggtactttacagctcaaaattaagttctatagttttataacgaacaaaatggtgtagatccataaatacataatttggtattatgcgtctatttaactgttaatcgagagagagagagagaagagagaatggctttgaaatattctgagtacctctatttgactcgttgtagaaaaattggaaaaattgataaataataaaaaggaaatttaagtcacccataatcccacttcagagttcacagctgtgaaaggcatacctagttgttgattcagaaagtacttacctaa

SEQ ID NO: 219959 - DNA, 377 bp, Homo sapiens
gtttcatgttgccctttttggtttttttcctataaattttaagaatttcaaaatgaaaaattaaaattataaaaatacactaaccctctgtatgggcaagggtggttacttgtgatatgtttattattgagtgaaaaatgcaattgcagaaccatatgcaaatatgattccatttgtttaaaagatgcatgcacatcatatacgtgcacgtgtatatgattgtatatttgcaaaggccagaagaggatatggaagtttgaaagaaaaagactatattgacaatagttacccctttagagtgaaatttgaaggcaagagttttaactttgtattctatacacatgcatatagtttgaattttcaacatttttttcatt

SEQ ID NO: 219960 - DNA, 200 bp, Homo sapiens
aaagtaagggagctcctgggaagacagctccgagcaatctctacgcacagaacgaaggctcctttctgatcctacgccctttaaaaacgaatggcacaaatacagtattgtaatcccaaaaatggcctggacagaaaccagccatgtcaaaaaggtgattatttccctctattgtttgcttttagctctagatggcattc

SEQ ID NO: 219961 - DNA, 472 bp, Homo sapiens
ctaccctgcctataggataaagaccagattccttggctggacattcatcctctccatcatctagccatattaacccctccatttctgcccaagacctagtaagtaggcagaacactgggttcagcccaaccatatttaatgagcacttactatagcctcagcatttcacaccatgtccttctccacctgctgatgttcatgccctgctccttgcctgccataccttctttctagagaggcagcgctgcatggtaattgatggtgttagatgtggatccagccttcctgggttcaaattcttgctttgccacttactagctgtataacctgggaagtcaattcaggtttctgagctttcgtttcttcactcgtaaactggagatccaacctcatgggattgttgtaaggatacagtgtgtcagaggcagtgctttgtccacagcagtgctaaaatgctaggtgttatattaat

SEQ ID NO: 219962 - DNA, 432 bp, Homo sapiens
atattagtattattttagaaagtatataattataactttttgttgtaaaatatagtgatacaggaacataaatatataatacaatgaataattataaattaaatatttagcatacatctttgtaaccttagagtattactggcatcccagaaactcttgatatgctttcttttctttagaggtaaccagtatcatgactttaatggtaattatttatacaatttttaatataactttgtcactttacgtgtattcctaagcagtatgtttacttttttcgcctcattttaatctttatgaatcgtgtattctttcttcctttgctcagcattatgttttgaagagttatccatgtagttatgtgtagttttatttcattcatttttgttattatgtattatccctttgaattaaatgtgccagaatttattc

SEQ ID NO: 219963 - DNA, 401 bp, Homo sapiens
gaaatattctggtttctgattccacttagtaaggtaacatattctgtagaatttgacagatttaacattgtgagaggactcagttcatgaaacaaacactaccatcttttttgttgttgttgtaattaaatgaccctaagaaataaaagtggaatgcacagtctcactgtaatgtgatttactaggatatgagctccctgagggcaggggcttgatctgttttgtttcctgatgttcttttcagtaggtggttatatttgttgtatgaatggatgatgaatgccacagagtaagcacaatgttttgttatttgaaattttgttaaaataactactaagatgtctggaaaacacattcacagcctaggatgaaaagcatccattgactgtaatgaataagtg

SEQ ID NO: 219964 - DNA, 510 bp, Homo sapiens
gctccctcctcctttacccttcacaggagtttcctccccataaatttcttgtgtatctagtcctgtcttggcatcagcttcttggaggacttgaactgatatgcactcaacagccagtaaatcctgctaattcacaaaatccttgattatcagtactaaagaaagacactgggggtgaagatgtcatcttctaaaagacttactggggataatctaccaccaaatgtaggtggcaaatgccatctttgatcacataatggaatcaatgaaggaggttattgatctggttcagaggtgactttagaatgtcccaaaccctttaaatatgtgtgtattgagtatgtgtgcaattctccttgaagaacatttatacctttcatctcattaatctacaaaattatcagcagtggcagctaattgtcagttaactaggtagttgacaagtcacattaacatgaaatctgtgtttcatgtaaataaaaaaaataaaatgacttattttatgcaata

SEQ ID NO: 219965 - DNA, 210 bp, Homo sapiens
tgagctttcctcacaaccttttaaagcactgcatatatattcatgttttcatagtgggcatgtaccttttactgtggtccttttgcacatattataaatagaattcttggtgagttaagagttctctgtttttgttttttcaggacagagtgcacagtttcctctcctgtgggaaggagagttgactcttgaggacccccaccctcctgc

SEQ ID NO: 219966 - DNA, 557 bp, Homo sapiens
gtagtgagccgagatcacaccactgcactccagcctgggcgatagagtgagactccgtctcaaaaaaaaaaaaaaagaatgtcaactgctcctggctctgcagaggtatggcccaggtgacagggctattgagaggccaaagggaccctgatcagccagtggtgtctttggaataggtgctgcaagctctgggaggtgctactgcgcaccagaaggttggtgagttggccaagggtgtggagctggctccagaggggaaggaacaaagggaagggaccctctgggagctggagagacttgggagcctggaggcaggaattccctgccattgcctgaggcctggtttggaaagtacaatgcagttttggcatggtggttgctggcctggaatgtggtggggtgaagagcgtggtggaaggacacactgagttcctgaccatccagcaacaaaggagcaaaaagaccttggaatccatgagaaggtaggagaagtttctgccggggtgggacgggagctctgaactggggctggacagtcagatgggtttctgggtgag

SEQ ID NO: 219967 - DNA, 647 bp, Homo sapiens
tgagccgagattgcgccactgcagtccgcagtccggcctgggcgacagagcgaaatccgtctccaaataagaaaactgcaggcttagaattctaaaccagccaaaatgttcttaaaagattaaggcaaaacaaatatgtgttcaaacaaacaaaaacagagacaatttggcaccagtaggcctgcactgaaaaagtaaaggaagtttatcaggaaaataatccaagatagaaatatggacttggaagaaagaatgaagaacactgggaaacatatgtaaatgaatagtaactgtacaaaataataatggtacaccctgaggagtttcaattttatgtactgtatatctaaaattcatggtagcaataacttaaatgatgagagggaagcaaatagagtttaaaagtcctaaggcttaattggtatcagccaagtagtaaaagtaataatttgcattggccttaataagtaaaaaagcatgttttaaactctaggctaacaactaaaaattatttttaaatgtaacttaatagaaggaaaatggaatcatgtagaacatttgattaatccaaaggaagtcaagggaagataaaggtacataaaagtagagcacaaatagtacaatggcgaatatagacccaagcacat

SEQ ID NO: 219968 - DNA, 373 bp, Homo sapiens
tggagtatttgcttcctgaggggttattaaatagatagaaagggggtatgtaattttgggaaagaagaacattaaaacctggcttcagatatagaatacctcacataactaaaaatattttgacaattttaatatgttgatacattcttaaagctacacactaccctctcagactcctagaaaggttcagcttccaagaatatggtttacaaaagtatttaaatagaataggaaatatattacagccccctacctcacatatctcattttcttcatgatgtctactgtgatgttggcaaatacttggcttccaaaataatacccaatcccaccatcaccctttagatgagaggctcccagctgagaaggaagc

SEQ ID NO: 219969 - DNA, 412 bp, Homo sapiens
atactttgtttatgtaaaagggagtaggttatatgctcagctaattattatataaacttttttcacctaccaaatatctaggacatctgatagttgtgcaggacttaggacaatttgtagtacacgactaccccaggcaccaggtacagtggctcatgcctgtaatcccatcattttgggaggccgaagcgtgaggaccacttgaagtcaggagttcaagaccaacttgggcaacagagtaaaaccccatctctacaaaaaatacacaaattagcccctggtgtggttgtgcacatgcctgtagtcccaagtttcctgggaggctgaggtggtagcaatatgcctgagccctggaaagttgaggctgcatgtgagctgtgatcacgcaactgcactatcagcttgggttgac

SEQ ID NO: 219970 - DNA, 118 bp, Homo sapiens
aaatgccagtctcactctaaacattcccttccttttagattggcacacatttgcccacctggtgctcagagacagttcccccaggtgtggacagtggctcttctcctgaggtcttgaa

SEQ ID NO: 219971 - DNA, 370 bp, Homo sapiens
ctctccacccacctcatccccaccacgccctgatgtcactccctgctgtacccaccccggaaacccttagccacttcccacaggtccactcccagggaagttctttaattggtggatgtgggaaagaggaagaggaaaaatatcatttctaccttcccaattccctgtatcccatgagcctccagtctgaaaatgattacccatctgacctggagctctcatcctaggtatcataatggctcttcttttacccataaggagaatgggtaatgaagaaatgcaaaatcccaactcatgaaaatgtggttgaaaaagggaagacccataaaagttctcatttgttgaccagagacaataaagtgattactta

SEQ ID NO: 219972 - DNA, 317 bp, Homo sapiens
cttagtaagaggggtgggttttgttagctactcggcgagagcatccaaaaccgcttgtgtctgctggcacccctgacagtaagtccattttgcctagatccaggatcgggctctgaaagaggctcatctcagaataaggattttcttgagtcccgtggcttttcagcctggttctgtaatgctctggtcagttcatgggcacacttaaggctaaaaggaaaatcaatcagccaaagtgctgctctggcagttgatgggaagtgaaacaaaatagctcaaaaattaggccgggcgcgatggctcacgcctgcagttcc

SEQ ID NO: 219973 - DNA, 302 bp, Homo sapiens
tgcagtgagctgaaatcatgccactgcactccagcctgggtgacagagcaaaactgccttaaaaaaaaaaattaagagacagcccgtgtcccagtccctcgtcttgcactgcagaatttacatctaagaagaaaatgtatttttgaaagggtgatggctggcctcatccctcactaattgacaacccatctgtcgatgccattttttcccttcctgttctcactccacagaaagaggagatacggttcttgtttggtaattgctaaaatctctttgaggaaagaaataaagatgtcaactcc

SEQ ID NO: 219974 - DNA, 885 bp, Homo sapiens
tattgagcacctactgtatgccaggcactcaactagatacttttcctagattatttctgagtcttccaaaaattggataaagtggttgtcattccctctgttttatacacaaataaatgaagacttaaagaagttagataagttctcaaagttctacaagtagtgagaataaggacctatatatgataatttccttgtccttgaagagttttaggaaacaccatctcccatctgttatccaagaatattctcttgcttctagtctcacatcaacattcattcagtcaataagtttttatatagcgcttagtatgtgtatctgcaaataccaccttgacaacagagagaaaatacacagaacaattattcactcaaagctgggaaatgtaatgaaaggtcagagacagaaatcagtgtgggctggagaagtagggaaaggttttatggaggagtgggactggggttgggtcttgcaggataaaagaattattcaaagagcattcctggccaggcgaacaggataggcaatggcactggggcatgaataagcatgacagggggaagtacattgggaggacacagaaatgtcataagtggaagaaagaaactattcagatgccctatggggattggacaagaggatggcattcatctaggaatttatttgggctattgcaaatgataatccaacgcttcaagtttcttattacctgaagatatggagtacataaaaatgatgaatgaaaacaaacaatattattttgcagtaacatttaaattactaactcttctataagagaagcagtctaccaagttaaggagtggttaggaagattaggaaagtgtttctgtccctcactgagaattaaactttgtttgtttgtt

SEQ ID NO: 219975 - DNA, 498 bp, Homo sapiens
cagtagagactctaattctgattccactgcagagtagaactttgtctgattcatcgcccccctatcccggcctccaccatcttccagggtcctgccctgggcttatactcaacctttgagtcaaaaaggatggaagctcttgataaacctgtcactttcccccaaatcatcctggctttcctgtttctgttaagagcagcccttggccagatgtggtggctcacgcctataatccccgcactttgggaggctggggcaggtgcatcacctgaagtcaggagttcaagaccagcctggccaacatagtgaaagcccttctctactaaaaatacaaaaattagccgggcatggtggcacatgcctgtagtctaagctactcgggtgtctgaggcaggagaatcgcttgaacccgggaggcggagactgcagtgaaccaagatcacaccattacactccagcctgggcaacacagcgagactctgtctcacgaaaacaaac

SEQ ID NO: 219976 - DNA, 691 bp, Homo sapiens
agagtgttctcactgctggcataggagggtcttcagcctccagtgatcaaagtaccaggctgacctgtgactgcttcggccaactgaatagggaagagtgatgctgtgctgtttccaggcctgttctttaaaagtacttggaagcttctgccttggcctctttgtgcctgagttgctgtataagaatctgactaccttgctggagagaccttgtggagaagacttgaccttatatgcagaggtagaggggccctggttagtccagccatctagccatcctgtcaaaatagcagatccatttcctgcccttcttttattctactctgtattacagccaaccacatttccaggctcccttgtcctctgctatctaggtgagttttgtcagtggaagacattggtggaaggttggatgcttcttcttctagcatctctggtggtggctgtgtttcctccctgactccagctcccactgggtgtcattcactttgtggttttggtgcttgcccaatggcctggcttctgagccctgcttctgcagcccagggagagtagcagcagtctgctgtttttagtgtctgggttgccactcttttcctgtttgacctctctgggcttccatgacccacataagtcattaaattccctctgtcaaaaagacttaggttcctgtttcatgactggatgctga

SEQ ID NO: 219977 - DNA, 545 bp, Homo sapiens
gcttgcaggccattcaagttcatattagtcacaaacagaaaaaagcatcaatggtggattaaagaaaactgcaaattctttgatatttttcccatttagaggcggggtctactttcccttttcttgaatctaggctgacctgtgactgcttcggccaactgaatagggaagagtgatgctgtgctgtttccaggcctgttctttaaaagtacttggaagcttctgccttggcctctttgtgcctgagttgctgtataagaatctgactaccttgctggagagaccttgtggagaagacttgaccttatatgcagaggtagaggggccctggttagtccagccatctagccatcctgtcaaaatagcaggtatgtgagaaaagctgtcttgattcctccagcccagcccagccaccaactgaataataccaagtatatgtacctcaaatggaggaaaagaactgctcagctaagtcctgcccaacgtcctgactcagaagataatgacagataatgaaatgattgttgttttaagccactgtgttt

SEQ ID NO: 219978 - DNA, 789 bp, Homo sapiens
agcggaaaggagaacacaaagtaaaagtgacactgcctatttcttcacgggtacaagggccacttaggctgggatgcttttcctgaaaatgcagaccatacagaacaaggccatgtgactaagaatccacaacagaaacaaacacaagacacatatgagttaggaaagttaaggaagcagtccttcctttcggccaaaactgccaccttccagtaatttgccacaatgatgaacacaaagggggaagaggagaggcaccggtatacattctctaggccttttagaaaacatggacttgttcctttggttacaaatatgcgaatctataagaaaggtgatatggtacacatcaacggaatggatactgttcaaaaaggaatgccccacaagtgttaccatggcaaaactgaaagtctacagtgttccccagcatgctgttggcattgttgtaaacaagggtaagattcttgccaagagaattaatgtgcatattgagcacattaagcactgtaagagccgagatagcttcctgaaatgtgtgaaggaaaatgatcagaaaaagaaagaagccaaagaggaaggtacctgggttcaagtgaagcaccagcctgctccacccagagaagcgcactttgtgaaagcttgtgggaaggagcctgagctgctggaacctattccctgtgaattcatggcatcataggtgttaataaaataaaataaaataaaataaaatacctctggctgtaaaacaaaacaaaacaaaaaaatcaaaaaacaacaaaaaagaaa

SEQ ID NO: 219979 - DNA, 459 bp, Homo sapiens
acatagcaaataggtgatggagggcaaattaaaacccagattgaccctggaatccccatgcttcaccgttgtcctccatggcctcttggcatatgggactgcccaggtgcactgagaagaaagcttttctttcactctgcttattcgaatcagaagcagacctagttcaaaaaaacagaaacaattgttattttatgaactaatgctatttatgatcaccagcagcacaatttttacccgcccccccgactacaaaaggaagcagcatggcaatcactatatccaaaaacatacctggtaaggggccattgtcagttccagagaaccaaaccacctggaacctcagcaaaagtgatgaaataccagcatctcagaaagttaaagtggatgatccttcacaggggttgcccaatggtgctgtaatctgaactattgcacaaataaaggccttttgacagc

SEQ ID NO: 219980 - DNA, 272 bp, Homo sapiens
tccagctgctcctggggtgctcatggtctaaggggatagagagatgtgtacacaagaaaagcagcagtcacactgttcaccaacatccagtccctctttttttctgggcacaagggaggctaatgcattccacactttcgatgttagttgtggtcaagtgtcttgtcttagtcaatgaaatatgaacaaaagttgtgtgtgtcatttctagaagaaacgtacaaaaactaacacacggttctttagctcctctcctctgctgcagtgactgg

SEQ ID NO: 219981 - DNA, 587 bp, Homo sapiens
cccctggtacgggagtggcggggtgggggggtaagaaaatacggttaaatcattgggaggcttaattgttttaaagactttacttgcaagactgaaaagacaaatgggctccattttagaaaattctaatagattcacttgaatcaatttttgctatttttatttaaaaaggcaaaggcaggagaaacgggttcaaataagtcaaatgaaacaaacgtggtgctttctgtggagacagtggctctgacacaccactttatgctagaaaggcgcaagggccgggtgggtgtggacagagggtccactaccaagtcagctctatgcctgaggccacgaaaagccaaattgcaccaagaataggttttgccaccagatatccacactaatattctactaaactgaattgaggctaatcagaaacttctcttaaggtgcaaagatgctctacagatgacttacctaggttcccactcctgaattaactaaactcaaaataactgaagtttttaacagcagaaatttgatgtatcaagagcaacctgtgtctgaaaaatatgccaaattagagccacaataaagaataactt

SEQ ID NO: 219982 - DNA, 488 bp, Homo sapiens
ggtgttacgtgggttaaatttagattatgtatttaagctggctggcagaattttaagtgttcaccatacctcatgtccttccccagtattttgttacagatatacttaccaagaatgaactatcatttataacaactgaaggacggggtttttaaaaattcacgttattatttctttgtaaatattattcagggtgggggggtaagaaaatacggttaaatcattgggaggcttaattgttttaaagactttacttgcaagactgaaaagacaaatgggctccattttagaaaattctaatagattcacttgaatcaatttttgctatttttatttaaaaaggcaaaggcaggagaaacgggttcaaataagtcaaatgaaacaaacgtggtgctttctgtggagacagtggctctgacacaccactttatgctagaaaggcgcaagggccgggtgggtgtggacagagggtccactaccaagtcagc

SEQ ID NO: 219983 - DNA, 528 bp, Homo sapiens
taggtagagggggcacggaatgtctctgtattatttcgtaaagcttcatgtgaatctacaattatctcaaaaatttaagttaaaaaaggaagaaaaataagaaaggaagtcccaacttggagtctgatttaaagggtctattttgtcaatggtttccatgcacctgaatttgggactaaaatacacagaaactcagaatacccaaacaatccctgcaggggaaaaggccatgttcctctagaaaaattagtatgtgaggatgcctaacccccactgtcccataaattattaatgatgaccttcatttgcttgagatagatgttctcctcctgtcaataaagactggccttctagcaaatgccacaactgtctgctgctcacagaactttatgcacgggataagcatgaaataatgggaatttaggcatgatggagttagaccctgtgcctacgtgtttttttgcaataatatctgcctgggagcagagaaccttcatcagttcttaataaaccactctgctaatgagt

SEQ ID NO: 219984 - DNA, 545 bp, Homo sapiens
agccagaatgaaagttctatgtctacccagtgccaagttcaccatctctgtaactatttgttggatgaatatgtgaatgagtagaaaataaatcaacatactttttcatcaagacagtaaagtgggcagtgttaaactcttagggtgacacagacgattgctttaaagaaaaaatcataaagagtgaaaaaatagaagacttggcttatggtgtggtggcatttgaccaactgttcttgttgaggtagtgatttttgaggcatctggtttacaaacacctcaagggtatagcccaaacttggcatcttctggtagtggcagaacacccagtattcagggcattgttaagtatgacaaagggagagtcaataaatctcaaatgcattcagagacctggctaagatgctaaagcagccaatctgtgccttcccagtggcttcaatcacaatccccacttgatcattgtttgactctcctttaacccactatgtccatggaattcctttggtcagtgacacccagagtgggcaaaatccaccttgaaa

SEQ ID NO: 219985 - DNA, 396 bp, Homo sapiens
gccttgctgtattattatttgccaagggatcaaggacctgctcagggccaccagtgtcagcaactagattctgaataaatatttgattaataaatgaattactacaagttattgatagaatataggcagaatgtttttttgttttttttctcttcagattttataggttcttaacaaaaaaccaaaatgaagacataatgtttttaatgtaatggtaaagaggaaacttctgtgttttgaatactctacttgaattgtcattgctgtaaagagaaataattttgattatttttgtttttactcaggtatgaagaatttattctcaaattaatactcatgcttatgagtgtataaatgctcatatattgatttaataaaggtttctgttacttgata

SEQ ID NO: 219986 - DNA, 431 bp, Homo sapiens
gcgtgagactccatcttaaaaaaaaaaaaagaaagaaattttaaataaagcaaaaattcaaaataggcaattaaataaattattactttagtatgcaagtaatgcatatagttacattatataaaatacatgattttgtcgtgtacacgtgacaatgcaatgtaaatatacatacgttatgatgtataattgaatatatatcataaaatcttacatttcatataatgtaatgaattatatataatgtataaattttacatggtaagtatatgcattatttatacatatgagcatagcacatgatataaacagtgcaactttgtttttctttcgatacagaggctccctctgtcacccagtctggagtgcagtgagccgagatcacgctagtgcgctccagcctgggcaacagcgtgagactccatcttaaa

SEQ ID NO: 219987 - DNA, 457 bp, Homo sapiens
ctaccattgtgctgtgtagtttgataaatgcggtttgtcctaatgggaacaggctagaagagttctccaagacccagtttctcttgtaaataagtgaccttcttatggtctatccaagatagttcccccttctctgatattttattgtgatataaaagaatgcttggccgggcacagtggctcatgtctgtaatcccaacactttgagaggctgaagcaggcggatcacacctgaggtcaggagttcgcgaacagcctggccaatatgacgaaacccccgtctcgactaaaaatacaaaaaaattagccaggcgtggtggggcacgcctgtagtcccaggtactcgggaggacgaggcacgagaatcgcttgatcctaggcggcagaggttggtactgagccgagatcacaccacttcactcagcctaggcgacagagggagactccgtctcaattt

SEQ ID NO: 219988 - DNA, 528 bp, Homo sapiens
aaataactaatttgcttttgattttacaggcccctaggcagaaggacttcccttgtctcagatgaaactttggacttggacttttgggttaatgctggaataaattatgactttggaggactgttgggaaggcatgatttgcttcaaaatgtgaaagatacatgagatttgacaggggccagggctggaatgacatggttagggtttgtgtttccacctaaatctcatcttgaattataatccccataatccccataatgcccacatgtcaaggcagagaccaggtgaagataattggatgatagggacagtttccctcatgctgttctcatgatagtgagtgaattctcacaagatctaatggttttataagtgtttggtagttcctcttgcattcattctccttcctgctgcctgtgagaaggtgccttgcttcccctttgccttccaccataatcgtaagtttcctgaggtctcccaagccatgtgcaactgtgagtcaattaaacctctttcctttataaacta

SEQ ID NO: 219989 - DNA, 349 bp, Homo sapiens
cgagaccctgtctcaaaaacaaaacaaaaacctaaaatcccctactgacctccctctgttatgttctgtcaagatatacctcaattcctgtgactagggacgttggaaaggcattgttttaaaatttattttgcagtctttgattccaaattgcttatatcttagaattctttcccttcatgacttttgtccgttgttcatttccccaagtcacatcttgatggcccgcgctgtgagtcagatggcttttctgtagccaaggttatgtgcctggggacggcccttcaccccatcctctagaaaggcaggctttcagccccagaggtacttacagattgttaattcattc

SEQ ID NO: 219990 - DNA, 471 bp, Homo sapiens
ctagagcatcttccactaagttgctggaactgatgcctttaaaagcatcaccctagtccctcatgttaataaacagaaacctggttaatccccacaaggcagattatactgatttaaagaagggaggaagggattcttgtacttatatcaaataacagtatgtctagaatgtttgggaattgataactcggcagagttctcagcagagaaataaaacgacacagtaaagttttgtgttctccactttgcctcctttgcttaactcattctctctttgcaaccccatgctaagcatttatttattaattcaacaaatgtgtattgaggactaacatgtgccaggtactgttctaggcactggaatgaaatagacaaaaattcctgcttgcattccccaccgctcggaacttctgaaccaagtcaaagaagagctgtcttttctccctcagatcttgctgatctgcactttca

SEQ ID NO: 219991 - DNA, 373 bp, Homo sapiens
agagtgcttatttttaaaggaaaggtgactgagataaccctctctcctgctctgaaaatgttgttcctcctattccacaatttccagtacgctcttgtttgaatctctccaaagatattcagagactccctattacgaaggtgatgtccaaactcctttgcctatcatccaaagatccacacctgggtctcagatgcctctccagcctcacgtgtcactcctcgcccctaaatctcagtgtctatcctggggctggctgttgcttagcaaggcttgtgggttggcagcttgaaccatgttctgtcctgatgctcaactgcaggaactgaggtgagaggaggccatgtgacaataaagatcattatgtactcac

SEQ ID NO: 219992 - DNA, 338 bp, Homo sapiens
tcccttggagccttctttgcttgttcccactcacaagaacctgtgccgacttcctagaactcactgcatcccccgcactacttggtaactgcctggtgacatctcttgaattgttatttcactttgcaggcatgtcttccttatctgcccaactaggttgtaaactcccaactgagtggagtcggagaatctctaaatctcagtgtctatcctggggctggctgttgcttagcaaggcttgtgggttggcagcttgaaccatgttctgtcctgatgctcaactgcaggaactgaggtgagaggaggccatgtgacaataaagatcattatgtactcac

SEQ ID NO: 219993 - DNA, 138 bp, Homo sapiens
ctagtattctttctttgagaatttttaacttcaaataatcttagctagcattcaatatcttgcagaaggcaagagagaatcaaaccttaagaaaagctttcttgccaggcgcggtggctcacgcctgtaatcccagca

SEQ ID NO: 219994 - DNA, 385 bp, Homo sapiens
ccatgtatatggactatgagaaatacataaaactattttataatttgcaatgctaattgtaaacgaaccctctgtttttctgttaaattcattttcaactcttcagctaaagtttctaataaccagaagtgagattacttgggaggtacatattgccatcactgtgtggccattactgatatcaggagcaatctcaaagtgtttaacagagcaatgtgtatctcagtgtaagctgatctttgtgattacactacagaaatgggcatagagattagatgttgatttggatagagatgacatttagaattttattttctttcagtcagcatttttgtttttttaagaaacagctaaaaatcacattgagagttgtaaattatgaaca

SEQ ID NO: 219995 - DNA, 109 bp, Homo sapiens
gtaagaaaggggtagaggaagaatatgttggaagatccagaggaaggagatcttgtagaacacccagagacaggaaagaaggtctggcaagggctggagaggtggggtc

SEQ ID NO: 219996 - DNA, 1188 bp, Homo sapiens
aaatactcccagctctctcgccctcttttaatgacagtggacacttggtctcttgaaaatcaagctattcatccataactatttgaacctcatcaaaatgtctactccacatacttttctttctattactttttctggtggaagcatttttcaaatctgaggtatagaagagtgcataaaacatatttgtatcgtttagattattttacaaaagcagacacctgtgtaaccaggaccaaggtcaagcaatagaccactgccagccttccagaatacagccgctgtactcctcccaatcacaacccacactctcctatatgaatatagtcattgccctgactttgtaataatcatttcactgctttcctttatagctttatcacttttgtacgcatccgtaaacaatagagttgatacgaagttgtataaatggaatcatacggcaagtttccttttataacttgtttctttcactctgtattatacttgagactcatccatgttgttcataatagttataagtaagtagatcctttgtctccatcgactgtcgttccagcatatgcttatagcaaagtgattatggtatgattataccactccattctacagcagatgaacattaggattgcttctatttttcagcgattattatgaacattcttgcacatttctcatgggacacatgtgtaaaaatctctctagggtatatatccaagaatagaatccagggccatagggtatggatatcctgagctttactagatgatgccaaattgttctctgtagtgattgggcaagctgtcaatcccaccagcagcacagagagcccctactgctccacatcttcacccacaccaagtattgccagaatttaaattttgccagtctactggtgggcaatacccaaattactagtaagctttagcacattttcgtgtttatgagccttttggagtgtctactccgaagaaggcctattcaaatttacctcttttaacccatgtttctattctattgttcatctagtacttactgacttaatgagcctgttaaatattttaaatactagtccatacctgtggccaaaatattcccttgttctgtttgtatttcccattgctttgtgctgtgttttgtgaacagaagatcttaattataatatagtcaaattcatcattcttttcc

SEQ ID NO: 219997 - DNA, 389 bp, Homo sapiens
taatgtctcagatccttagtttcctttttggtttttaagattaaactaggcaatatgcgtaaagcatttagcatcagaaatacttatatataaacacatagaaaatgatgacgagtaattaattttattaacattattatatatttgggggaaactgcaagtaaaaatagaacatagataaaactaaaagatgcaataggaacctcctaatcattttgatagctgtggcatagctgttttctccaagacagcataagcacttgttgaaaatctacttattttctaaggacttgtcagagctgattgattgaatccttataacaagcttgcatgctggatacttatttttattcctatttttggataagaaaactgaggcttaaaaaaat

SEQ ID NO: 219998 - DNA, 448 bp, Homo sapiens
tcccaaagagcatgagcctacttacctgtgattcctccctcacaggtttacaggaacctcacctctggagttgggagggaatgctttgtagatttttgtccataccctaacatcatgcttctgtctccagaatagacattctttctctaacgctttgattgctcgatctcttggtaaatacggcatcatctgcatggaggatttgattcatgagatctatactgttggaaaacgcttcaaagaggcaaataacttcctgtggcccttcaaattgtcttctcaacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaa

SEQ ID NO: 219999 - DNA, 425 bp, Homo sapiens
tttatcccttgagtatcagctttaagtcatttccttaaggaagcctttccttacctctaagattaggttgaatacttccattaccttatactttttatccttcatcacagttgctatgactacatatttgcatgatcattaatttctgtctgtcgcttcataagatcacactctccatgagggtaggggcaagatctgttttgtcatctttgctcaatcagtatttgatgaatgactgaactaatgaatgaataactcagcatgtggcagtgatagagaaaagcattgtgaaccacttttgatccaataagatctgaagcttctgttttatattttacacccccgttaccttgaaatggaatatatgtataatgtctttgtatgtatacatttttgagagagtctgactctgtcgcccaggtgga

SEQ ID NO: 220000 - DNA, 516 bp, Homo sapiens
tattaaaaataagattttgcaactgcgttggcataaggaaaagtatattaatattgcatattaaaacatgttcttcagcctaaagctttacttatttttttctgattttaaaacaaatcaaaacattttcatgggccccaaaagactatggtccctggcactgggcctgcggtgcttaatgcagaagtctaccctgcgtgtctgatatttcttctgggaaataaagagctagtgagaccctccatcttttgccacagtgcttctctctactctctctcgtggtcctacttattctggtcccccacggctgcctagtctttctggtccttgaagtctaggactgtcactcactgattgccaactctttcccaggcgcactcccaccccaaggacaccccttgtgattgctgtggaataggcatagccaccgcaaatatatcgttacttatatattctcctttcacctgctttggaagaagaaccgtaagcatttattaaaaatgtctgagaagctgg

SEQ ID NO: 220001 - DNA, 1383 bp, Homo sapiens
cagtccgtagagtattagctacagaaacctttccatgccatactgagaaagtgcagcaggcagtgtgcctacaggtctacaaagaaacttcagatcatcttcttgagggaaagaagctgaagtgctacataagatgctgtgtgcttcataactctcagaagctgcagattctgtataaatccttagaaaagagcatccctgaatccataaaggtatatggcgccattttcaacataaaagataaaaaccctttcaacatggaggtgctggtagatgcctggcagattaccagatcgtcattacccggctcagaaacaggagatgaaagatgaccaggatcattataccaacattaccacatcttcaccaaagctcctgacaaattagaggaagtcctgtcatactccaatgtaatcagtgggagcaaacttgtgcagatccaaggttgccaagagggcttggatgaagcaataagaaaggttgcaacttcaaaatcagtgcaggtagattacatgaaaaccatcctctttataccggaattaccaaagaaacacaagacctcaagtaatgacaagatggagttatttgaagtggatgatgataacaaggaaggaaacttttcaaacatgttcttagatgcttcacatgcaggtcttgtgaatgaacactgggcctttgggaaaaatgagaggagcttgaaatatattgaacgctgcctccaggattttctaggatttggtgtgctgggtccagagggccagcttgtctcttggattgtgatggaacagtcctgtgagttgagaatgggttatactgtccccaaatacagacaccaaggcaacatgttgcaaattggttatcatcttgaaaagtatctttctcagaaagaaatcccattttatttccatgtggcagataataatgagaaaagcctacaggcactgaacaatttggggtttaagatttgtccttgtggctggcatcagtggaaatgcacccccaagaaatattgttgattgattccactgtccatttcaaatctttcttatcagtaaaaaaacattaattcaaacacaagcattgtgatctacattagcacaaaatgcaactgattatctaggatctgtgtattacttaagctcacccttaacagttttaccttccttctcctctgtattcttacagaaaattagaagctcaattttatggtctcataatttcctttatgacagacatctcagaattaaaatcacccaaagccaatcattagtgccaagataaccctttaacggcaacactttcttaaatgaagactatttctttcatgaaaaaattcacttttatgactttcttgttaaaataaaaagtctgcttttaaaagtg

SEQ ID NO: 220002 - DNA, 1521 bp, Homo sapiens
cagtccgtagagtattagctacagaaacctttccatgccatactgagaaagtgcagcaggcagtgtgcctacaggtctacaaagaaacttcagagtctcacactgtcacccaggctggaatgcagtggtgcgatatcagatcactgcaacctcctcttccttggttcaagcaattctcctgcctcagcctcctgagtagctgggactactgacactcaccaccacacccagatcatcttcttgagggaaagaagctgaagtgctacataagatgctgtgtgcttcataactctcagaagctgcagattctgtataaatccttagaaaagagcatccctgaatccataaaggtatatggcgccattttcaacataaaagataaaaaccctttcaacatggaggtgctggtagatgcctggcagattaccagatcgtcattacccggctcagaaacaggagatgaaagatgaccaggatcattataccaacattaccacatcttcaccaaagctcctgacaaattagaggaagtcctgtcatactccaatgtaatcagtgggagcaaacttgtgcagatccaaggttgccaagagggcttggatgaagcaataagaaaggttgcaacttcaaaatcagtgcaggtagattacatgaaaaccatcctctttataccggaattaccaaagaaacacaagacctcaagtaatgacaagatggagttatttgaagtggatgatgataacaaggaaggaaacttttcaaacatgttcttagatgcttcacatgcaggtcttgtgaatgaacactgggcctttgggaaaaatgagaggagcttgaaatatattgaacgctgcctccaggattttctaggatttggtgtgctgggtccagagggccagcttgtctcttggattgtgatggaacagtcctgtgagttgagaatgggttatactgtccccaaatacagacaccaaggcaacatgttgcaaattggttatcatcttgaaaagtatctttctcagaaagaaatcccattttatttccatgtggcagataataatgagaaaagcctacaggcactgaacaatttggggtttaagatttgtccttgtggctggcatcagtggaaatgcacccccaagaaatattgttgattgattccactgtccatttcaaatctttcttatcagtaaaaaaacattaattcaaacacaagcattgtgatctacattagcacaaaatgcaactgattatctaggatctgtgtattacttaagctcacccttaacagttttaccttccttctcctctgtattcttacagaaaattagaagctcaattttatggtctcataatttcctttatgacagacatctcagaattaaaatcacccaaagccaatcattagtgccaagataaccctttaacggcaacactttcttaaatgaagactatttctttcatgaaaaaattcacttttatgactttcttgttaaaataaaaagtctgcttttaaaagtg

SEQ ID NO: 220003 - DNA, 426 bp, Homo sapiens
atttcttcataaataaattgaggagaaattaattttttaggatccaaaataaagtgaaacaatgttgggcactggtgccagtatatgccaacaattcctgccctaggaaaggtaacgaaaggcagaggggagccaggcacagtggctcacacctgtaattgcggtgacttgggaggctaagacaggagaatcccttcaggtcaggagttcaggaacaacctgggcaacacagcgtgacccccatctcttaaaaaaccacaagaaaaatttgctgggcatgttggtatgcacctgtcatcccaactacttggaggctgaggtgagaggatcactcgagcccagaagttcgaagctgcagtgaactatgatcgtgccactgtactccagcctgggtgacagaacaagaccctatctccttaaaaaaaa

SEQ ID NO: 220004 - DNA, 379 bp, Homo sapiens
atttgactttgcttaaaatatttttcattaaccgtactctatgtgatttaaacttctctatgtcatttaacttttttatgacttctagatttgaggtcacagttaggtaggtgtttctcattccaagttttaaaagaaattctctcatgttttcttttagtgtatttttggtatgtgtattagggaaggggaattgtttctttatatttaaatcttatatccaaatgaaatttaccctgatgtgggtgtggtataaacccaaatttaacttttccaaatagatatctaattgtctcaacaccaagtacagttcttttccattttcattgagatcctcctttaatcatatattaaaggcctgtatagtatttattgggtt

SEQ ID NO: 220005 - DNA, 196 bp, Homo sapiens
cagtgtttaatagctagcggagtgataggtacgataagtttatcaagatatccttgaacaaagagctatgacaaaagaaagtacttgcttatagtcatggaattttgctatgtctttcctgataatatctctaaccaaaatagttgtgaaatcatttattcatccagcatgtatttgagtacctcctatgtgcctg

SEQ ID NO: 220006 - DNA, 256 bp, Homo sapiens
acaaacccattgctaggctaagaagtattgattccatctagttaaacatgtcgagtgagaggaagtgatcaatggattacttcttcaaaacatttatcccccctagtggaatcctctgatttttataacattaaagagccaggtataggagttgggagaagaatttaaaatttgaaatgtcttcttttttcaactctgttcatgaaaactctagttaatgcatgtgatttcctgggtctccctctctacttccctc

SEQ ID NO: 220007 - DNA, 449 bp, Homo sapiens
ggaattttatttagccacaaaaaggaaagaaattttgacacatgctacaacatggatgaaacttaaagacattatgctaagtgaaataagccagtcacaaaaggacaaatgttacatgatatgcaacttatatgagtgtcctagagtaagcaaattcatagaaataaagtataatggtgactgccaggggctgggggcagatgaaaaagaagattcatttgtaatgagcacaaagtttcagttagggaagataaaaaagttccagagatgaatgatgatgatggttgcacaacaatgtgaaaatatttaatgccacaaaactgtacattaataattaaaatagtaaattatgtgttatgtgtattttaacaacaacaacaaaaataactgcacaaacaatactccttgactcagcaaagtaaaacacagaaattctgacatatatccat

SEQ ID NO: 220008 - DNA, 607 bp, Homo sapiens
cagaacagagataactggtgattcagatttccagtacattagaaggcacctgcgaaggtacttcccttcgcctcctgggagccatcagtgagctctccaggagagcagtatgatgcagagaaagaaacaaaggagatgcagatagtcatgtttctcctcattcacggggtgaacttgggcagcacctccctttctctgatcctcagttgctttgttgaaatagggttgatgtgaggggccagtgagataatgcaggtaaagtgctgcatggtggccagcactattagctcctgatgggggctgattctcccacgtgggtgcctgtgagactcaactaaggggaggagcagtcaggatggtcagaagctcccttgttgctttctaggcccttgctgtgacccatccctctgggactggctctgttgtaagggtaaagaagttctgtgacatccatgtgccatgtcactttccacctggtagcagaggcaggcacatcagctccttggctctgtgctggttctgctggaaggttttataagagcacactgtccagtagaaatgtagtgtgagctgcatgtgtaagtttaagttttctggtaattacgtt

SEQ ID NO: 220009 - DNA, 232 bp, Homo sapiens
ttagcgtggtcgcggccgaggtaccttctgaggttggccatctcatcaggaagaatttctgtgggttcctttgatacagaacaatccttgatgtcattgactaaacaggatatttagacattttataacacctgaactgtggaagacatgtttcagggttttttttttttttttttttggactgggtctagattagactttctaacctgtataaaccattgggacttgctca

SEQ ID NO: 220010 - DNA, 602 bp, Homo sapiens
ttggtttaattttcaagactttattatttaaagttatagatacacttcggggcttttgaaagaacactaaacatactgtaaaaatatttcatttaagctactttgactcaccttccatttacaaactattttatatgttacctaaaatacaaacagcaagataattattttttggaacaatgctatctaaatcctgagggaaacagtaacaataacagatttaaaatattggatgcttatagatacttataaaatacatcacaaatattttctctaatgatcggcaatattttgtgctttttgaatccagaaattgaaaggttaatcagcttatccaagatcacatatgttttagtctcagttcttcagagaaaacagatccaataggggtgtgtgtgtgtgtgtatgtgatatttatcttagtataataaaaatatttattttgaggaattcgctcatataattatggagactgagaagtcccaagatctgcatttggcaagctggaggcccaggagagccaatggtaacagttctagtctgactctcaggccttcagactcagactagaactgttaccattctgatgttggagcggccgc

SEQ ID NO: 220011 - DNA, 687 bp, Homo sapiens
tgtctcccagacccacatttggaaagtttgcattgcattactgctcatctttagatgagcaattgagagttggctagattgtgtaaaatattttaaaatgaatgaacaaattacaatgatgatgccttttgaaattaccatatctagttcattctgtgaataaactcattttctagtaatgtttgtgaaccttagtcaagggatattcattcaactttataaatttacccctcagcaccagctatctagcactgtttaggaatttttcccttcatgatattctgtgtcacatcctatgtctatgaataacctatacactatagttgtatgcctataagcactcctatactcttgtattttaattgcaatagtatacctccactctctctctctctctcatacacacacacacacacactcttacacacacactaacacactagactgtttgccctaatgaattttcctctgtacttcgagagctattttagttgtcttgtcacttgaaatttgcgggcttcaaagaattatcgcatttgacttggaatggtccagtagtccatttacttctttcaccctgcctgttccatcttctatttctgatattttttctttcttccagttatttcaggggcaggtgattccaaagctggtttaaaaataaataacttctcttatgttgtcagt

SEQ ID NO: 220012 - DNA, 475 bp, Homo sapiens
cagagatcaggcttgtgtgtctagttatggtctcactggtttacaatgttggccctagctacccctgttccaggttgtgattcacaggtgagggattggctttgtctataagatggacatggtagatatgcagagggtaataacaggtgccaggataggttttcctacttcagtgcaggttcagtttggatgcctgaaaaaattcagaggtgaagtggtcaacttgtaaatcttacagctaggctgatcatggccatgccaaaccttgtagcattatatgcagaagatttgggaacctgtgtttggataatcattttttggtagctgaaacacagtcactggactgaagttgaggattcttttccagaaggactgactataatcaagtcaaatagcaatgacagaggtccatataattactcctaaacagggaccaggttgggaggtaattaaactaattgagggacttgaatca

SEQ ID NO: 220013 - DNA, 648 bp, Homo sapiens
atgcacgggttgcttctcccgaatcagccctcagcgggttttatattatgctttgcaatctgcaacaaccataaataagtgtaggtttttcttagggcaggcagctctcctgtccaaatcttagagctttttcctaaaagaggtctattgaaaactggacttctttgacacacctctaactgagatttaaatgtcttagtctcatacctcagactcaaaagccccccacctccagagtttggtcaaggaggccccaaggtatgacagacaccctggggttaaaaacagaggctggagaccgggagcagtggctcatacctgtaatcccaggactttgggaggccgagggaagaggatcactttaggtcaggagttcgaggccagcctgcccaacttggtgacccatctctaaacaattttttaaagccctcaatgaacatttttatgtgcattcaactcatctttgcgtactttaatgacctatttttaggataaattattacaaatattattgggtcattgcgtctgacttttttttgctaagcatttgagccagattgccttctgaaggatcaatttttacttctacttaccagtatcagccattttttggccggctgcagtgctttatgcctgacaacttgctgc

SEQ ID NO: 220014 - DNA, 475 bp, Homo sapiens
caggagatgctgtctatttgtaaccacatatagaaattcattcccaaactacagatgatagagttttacagagaggtgcaaaaatatatttttgcatcaagcattgtctgtagcttgaatacaaaattatgttgcccatataccactggtttttgtaagtaaagcagttgtgttacaaagcatacaagtttttatcagctaatagccttttctcaattagcagatactaagtagtacttttattatgtggcaattctccagtttttggaatgttattgagaaatacacagggttaaaacaaattagaaagcacctctcccaaaatactgcagtaagatgtaggaaaaactgctctaacatattctaaactataggttgctcttatgtaaatatttcaactataatatctagtctgatgtgcccactggccagagttttgtaaaagctaaaagtaaaggaaataaaaaaaagaaag

SEQ ID NO: 220015 - DNA, 1576 bp, Homo sapiens
ccggaatgtcagactctgctagcaacacaaggtccctgtcctcaaaatcctattcttaatcagcatttctaatttctgccctttgctcattttaatacagagcctgaggataggagagcagcgtggtgaaagaagcaatagttaccacatttgcaaaggcacataccccaaagagaagtttttaatatgtcacacccatattttatagatggggcaatggaagtccagatgggagaagttatttcaggtgaattatagaaactggatttcaagtttctgataagtattgaatttgggaaggctgtgaacattcttgagcccccctcccaagttcaccttcaacatcctaaagcaggttgaagaggaagatggttccaggtcacttacaagaacaggaacagcccctccctccaaatttgagcccagaaaggagaacctttgttactctagaaaacagtgtgtgtgctattgttttctccataggtcacaaacatccacaagatattggtgattttacatattattagagccactgaaatttatgatgcaggatattaacgtcaaagaggccaagatgcatcattcagaacactggcaggtcaagcagaaaccaccgtagtaaaattgaaagctggagtcagcaaagtatagcccacagccaaatctggcccatcccctgttcttataaagttttattggaacgcagccatgctcatcggtttatgtattatctatggctgtttccaactacagtggcagagctgagtagttgcaaaggaccatagggctatcaaagccccaaatagtcattgtctgacccttcatagaaaaattttgctgaactgtagtctagctccaaggattgttgtatcacctgtgatcgtgcctattaagcaattaacgtcatgtctagtacttagtaatgactcagcatgtatcaattacgatgataaatattatcatggcatccaaaccaaaatactcatgccaacatctctctgtacagaaacatggaaaaagagcgatgctattaaggaggaaaatggagccaggagcaaaacctaaggctatttctgaactaaagaggcctgaataaggtagtgaaaggaccagggaaagccttcccacggggatggagagccacctcctccccggctttctggttcagatgtcttgtctcaacagacggcagattcgcagggaagcaggccgagcctgatcttttctccgctagaactgctcaacaggtgaagaatctttttccagcactcctgagcccttcgggtcgcggaacagtgcgaagattattccaatgcctcattcggagaggtgataatctggtctgtggtttctttttcggtggggcatggggtgggggtgagtgtcatgctttctaaggcacagggctgactaaagggtgtcctatttataagtcagtaaaacacagcggcttcatactctgtgcttattacccagaagccccggctcttagagtttctattaagatgtacctcataaatatatacgcctcctatgtacccacaaaaattaaaaataaaaaaattgaaatcactca

SEQ ID NO: 220016 - DNA, 356 bp, Homo sapiens
gtggggggtagtgggggaatctatctctagctttttcttattgttgtaaaaataatttcccaaaaataaaaataggctgggcgcgatggttcaaatcttgacccttctgagctgtgtgactttgtccaaattcctaaaggtctcagaagctcaatttatctcctttcagggaccgacttgaggttgagataaaatggattacacaagtgtctgatggtgtaaaggtggcactaaataaatgtacgctgctacagttattatttccttagtgacttcatagctgtctgccctgcaatgtacaagttcccagactggaaggaattatggggaaaagctaataggggagggtggaaagg

SEQ ID NO: 220017 - DNA, 411 bp, Homo sapiens
ttgtttctctccttggccagtgtactttcactgctttgcaccctgcctggcatagactaggcatttagaaaattgttcctgagagaattaaagaataaatttcataaaaaatgtcttcagtttacaacatgtagttttatgcaacacttggcaaagtgggttctggtgggagctggtaatatcctttaaatcatgggactgagcaaatgattctagttgaatctgtgttatttaatctgtgtttttaaatctgtgaggctcttgccccagactctacttgaagtctgctgtgcttgcctgtaagctcataatcccaatgacagatggtttttaatctttgctatttggcttctagaatgggtatgtattactaactcatgtattttctctaacatgtagaatctgattctg

SEQ ID NO: 220018 - DNA, 427 bp, Homo sapiens
tctctgtcagcttctttgtttggttctcataacattatacataaagcaattatgcaggctttcttacccatacataagtgcctaattcacacagcactgtctgtagtccattcccatgaggtttgcccagtgacaggtcttttttcctcctcccattattatacactgaaagaagtactaagtggaaaatacctctatatgcaatgtgttaaaggcatttcgcaattacacctacggcactttaagctcctcaaaatctatgcatagtgttcttcagtcaatcaataacactggttggaagacaaggcaaaattgtcatatataatttttttaatggtctaggtttgagtaaccctcatttatggctatttaagaaaatatttttaataaaaggaagttttgagagagatggccatcttttaaactt

SEQ ID NO: 220019 - DNA, 754 bp, Homo sapiens
ggggggaagggtgggagggtgcagagcaggccagctacccaaatctctagacgccttgcaacaattcgcaacggaactgttctgagccctgtttcatctcactcactctacacgttttcactttcattgcatttttgcaactcctttggaccaatccagagatacagccacaggagagagagaggcaccctgggagcaaacggtggtgttggggtgacagagagagagaaatccccacagcaattccaaataaaagtcgtccccacttagtaacgcatcggaagaagggcctggagggaagacaggagaggagagggtgcagcaagccaaggccctcagttgagagcaaaggcggtgcgaggtcccccacactccttacccagggagccgccggggtgcccctgatgctgatatgtccacaagctgccaacccagagggcccagagcacataccagctggaggatgagtggaaagaaggaggagaaaagtccatatttatctgtttttataacctcggcctggtcttattttttctattaagtacaataaaatgggtgagcttgcagtgaacaccacacaaagcaatgttcagtgaggtctagaagcgttcggccgaggaaaactgacaagacaggctaatgaaccgtacagacagggagaaaatagccagcatttgctagatttcaaactctcgctgtctttcttagaccacctatcttggatttattcctaataaaataagaaataagcaga

SEQ ID NO: 220020 - DNA, 386 bp, Homo sapiens
gacttatacatgcatttgagacagaaaattttaataacaaaaactaagtttccccagggttgataccctgatggagcttaccagctaccttagatacaatccttcagcaactatgctctttaaatcagtgagcttctttcattatttttattttgaattttgtttttttttttcacttctttatcttccttcaagttatcctaccactccagtaaaggaaacaattacacacactccttttttgggggggagagtaacatctgaaaacagaagttttttgtttgtttgttttgttttttgttgttgttttgttttgtttttgagacaaagcctcgctctgttgcccaggttggagtgcggtggcacggtctctgctcaatgcaacc

SEQ ID NO: 220021 - DNA, 492 bp, Homo sapiens
cacttaattaattttatgagctttggtttcctcatccataaaacacctaccagacagtgttggtctcagaactggagatgatggaatgagcccagcactatgactggcctcaagaaaattgttggctaaacagaggtgcagcccttagagcaggcaacttcagtttttttctcccttccctgtgggcgtggcttcccaatcacccacccaccgagaggcctcctccccagcacgctgcaagggccactttaaggggatcagaaatatacaaaaaccacggggaaacatttggtcaggacctcagcttggaaaaaaatgaaacaatcatgaaaataagtattttctcttcttttttatatgtatgtatttttttatttttatttatttatttatttatttttgagacagagtcatgctctgtcgcccagaggttgcagtgagctgaggtcgctccattgtactccacctgggtgacaagagcgaaactccatc

SEQ ID NO: 220022 - DNA, 194 bp, Homo sapiens
gtttcaccgtgttagccaggatggtcttgatctcctgaccttgtggtccgcccgcctcggcctcccaaagtgctgggattacaggcatgagccacagcgcccagctctagtattgtttctctaaagctcatccacattgttgaatgtagtttatatttttcacttttgtgtaatatttcattgtgcaagctata

SEQ ID NO: 220023 - DNA, 399 bp, Homo sapiens
ttgacttcagtgagtgttgtcatttgggagtggcattccaggcaaaacctttcaccttactcctatcaaggggtcctgcaagaagtctaaagggacactgaatatttgctgtcatagcatgagtgcattaaataaaggcacatctacttcttaaatctttagagattgtctttagctttaagaatttctctaaatatatgttctacttaaaaagtagtcataaagcacaaatgaagctaataaatgctcaacagacattcctttaaggaaaaaaatttgtgaacaccattggatgccaagcagatgtttggctttgaaaagacttttacaaactgttaatgaatgtcaaccctatatttgcttccaagaaaatatgaataaatgttggaaatgttgaga

SEQ ID NO: 220024 - DNA, 588 bp, Homo sapiens
gggtcttgctctgtctctcacactggagtgcagcgatgcgatcacagctcactgcagcctcaacgtcctgggctcaggcgatcctcctgcctcagcctcccgagtagctgagagggcaggcacgagccaccacgcccaggtaatttttaacttttttatagagacaggtctcaccctgttgcccaggctggtcttgaactcctgggcccaagcaatcctcctgccccggccttccaaagtgctgggattacaggcatgagccaccgtgtgcagcctaattactttaaggaccatggtcagtggtgttctggtaaacatgtaacaatcagttctccaaaaaagggatgaggagcattgatttgtaagcctttcccaatttcactggtataaatacttccacggtgcctggtttcaagccaacaacctgagttggaaggagaggcgcaggagcacagtgctacatagtatttccaccttacagataagatagacaaaaataacctgaggagcacacctgatagtaaaatgtagtaaagaaattagggccgggtgcgatggctcacacctggccttgggagccaaggcggg

SEQ ID NO: 220025 - DNA, 382 bp, Homo sapiens
tttttttttttgagacgtagtcttgctctgtctcccaggctggagtgcaatggtgcgatctcagctcactgcagcctctgcctccctggttcaagtgattctcctgcttcagcctccctagtagctgggattacaggtgtgtgccaccacacccagctaatttttgtatttttagtacagacagggtttcgccatgttggctaggctggtcttgaattcctgacctcaagtgatccacctgcctcggcctcccaaagtgctgggattacaggcatgagccaccacgcccggccccaaatgttaatagatcaacttatttgctttatcattcatattctctccctctgcctgcataaacactaacacgtcattcacgttctct

SEQ ID NO: 220026 - DNA, 392 bp, Homo sapiens
tttctcatttatttcacctctgcttggtgttccattgtacgactatgttgcaatttagcctttctattgtttattgacaaacagattgcttacaattgttgactgttacaatggctccttgaacattttaatatatgatgtctatacatatgtttaataattttttcaggttatgtcactaagagtagaattcctctatatatttgacaactttaaaattcagaaagctcttaaagcagaagtacattaagatagcatctaatgtttaagtaatagtgtaactgatttcatcatgtcttttctgagtcagggtttaattgtgtaaacattattaaatgtatcagagacctggttgcctcagggacgtggaaggaagagctacagaatgaaga

SEQ ID NO: 220027 - DNA, 473 bp, Homo sapiens
aaaaaaacaagaaaacaaaaacaaacactatgggaaaatggaaagataggtcacagaatggaagaagacatttgtaacacatatagctgtcaaagtgctcatgtccagaatatataagtaacttttacaaattactaagttaatccaatagaaaaatgggcaaaagacacagaagcacttcaaaaatgacatacaaaagtccaataaacaaaggaaaagttgcttcattagtgatcatcagggaaataaataatattaaaacgacaataatagctctatacattggcaaaaaggatgtggcaaagtgggaggtttcatgcattgctgtgggaggagtataaatgggtacaaccactttggagaatagttttgcattttctcctaaagttgaagataacattccctaccaaagtcaccactctgtacacctccagaagcttcattcatgttgttatctatagaaatgctactgc

SEQ ID NO: 220028 - DNA, 355 bp, Homo sapiens
agtgtatcacaatgtagcagtttaagtataacgcaatcaacaatatccaaagagccaaaaacataatatgagcgaatactctatctcactactaaccagcaaaattaaaaaagatgagatggcatatttgttacccaagttcacgcaaaatttttaagttcaataacatccaggactggtgatggcgataaacagcatgtacagctggtaggaatataaattagtacagctatcttgagaacaaactggcatcttttaaaatttaaaacacccatgtccctatgactgagtaaaattctatttcctgggatcagccctatcttctttaagcaggattcaaaaagatatccattac

SEQ ID NO: 220029 - DNA, 323 bp, Homo sapiens
gggactgcctctctacaaaaaaaaaaaaaaaaaaaaaaaaaaacatataaaaattagtcaggtatggtggtgtgcacctgtagtcccagctactttggaggctgaagtcagaggattgcttgagcccaggaggtcaaggctacagtgagctgttatgccactgcattgtatttagcctgggtgacagagcaagtccccaacttaaaaaaaaaagaattaccagatacaagttatagaatagctatatataaagtatatatacatatatatacctaaagctatcagtataaacatgtaaaatgaacattttaacaaacattttt

SEQ ID NO: 220030 - DNA, 554 bp, Homo sapiens
tgcggtagctcatgcctgtaatcccagcactttgggaggctgaggcaggaggatcacgaggtcaagagatcgagaccatccaggccaacctggagaaaccctgtctctactaaaaatacaaaaattagctgggcgtcgtggtgggcgcctgtagtcccagctacttgggacgctgaggcaggagaattgcttgaacccgggaggcagaggttgcagtgagccgagatcatgcccccgcactccagcctggcaacagagcgagactgcgtctcaaaaaaaaaaaaaaaaagtagactaaagggtaagagatgaggaggaaggaggcagaaataatgcaaggagaaggatacaggcaaaatacagatggcaataacagtgtcagccaatcaattgcagttcaaaaataggccactacacatacatcacacccactgaaacctcacacccagcccttgaggtgcatatgcatccttacttacagaacaggaaccagagatgaagtaagttgccacatgtcatgccatttgtaagcgacagaaacaagatttgaaccc

SEQ ID NO: 220031 - DNA, 441 bp, Homo sapiens
cgtggtggctcatgcctgtaatcccagcactttgggaggctgaggcgggtgggtcacgaggtaaggagatcaagaccatcctggccaacatggtgaaaccccgtctctactaaaaatacaaaaattagctgggtgtgctggcacgcacctataatcccagctacttgggaggctgaggcagaatagcttgaacctgggaggcagagattgtagtgagccaaggtagcatcactgcactccagcctggagacagaatgagactccgtcgcaaaaaaaaaattacaaataaaataaataaataaataaaaataaaaagtcctttggaaatgaaaatgggatttcctaatttaggtgtttcttctttctttctttcttttttttttttaggtgtttcataagtaattctgcttattgtattttcttaaaaatggaaacacacct

SEQ ID NO: 220032 - DNA, 811 bp, Homo sapiens
aaggatttttgtgcagaaatgggtcttttgttgccatgttagtcctccttggaaggcagctcagaaggcccgtgaaatgtcgggggacaggacccccagggagggaaccccaggctacgcactttagggttcgttctccagggagagcgacctcgtcccccgatcctgaccgcccttccggcccacgctctcctgtttggcttccacaggcctggacttctctggcttctctgcccacacactccctgcccccagtgtccctgcccctgccccagcacaggtgacttcatttctgtcctctcagctcagtggactcgctcaacttttgtataagtctccacttggtggtagcagcttgctgatgacttgttttaaaactttcatcctaaataaccttttgatacttgaatatttgtaagttttatacatagtttctaattttttccccaacagatccagatacctaataagatgctggaatgtaatccctgggcaatccgtgtcctggcagcatttggtcttcctctaagcgcctggctccgctgttctcaggagtgggttctgaagtctctggagaacaggatacgtggagggttaggaaggggccaggcctagagacgggagactccctcccggagcaggtggaggcacaggaccattcgctaccccatctgccggcacctgcgggggagcccaggcattctttgtaagccctcctgactacctggctcaaagaaaacagaagcatggaggccgccaagtattttcaagaaataaccccatgaacatggcatcacttttttagaaagag

SEQ ID NO: 220033 - DNA, 492 bp, Homo sapiens
aaggaataatatagggattttatcatatgcataggtttgtgtattgcatcacctccaggatccttgtgttctcgtgcccccgctgtcttcatgttgcccttttataactacacccacagccccaagccctggaaaccactaacctgttctccatttctatcatttcatcatttcaggaatgttatataaatgaaactgtatcgtgtgcaaccttttgggattagcttttttccactcagcataatgccttggagattcatccaagctgttgtatgattccattccacttcattgctaggtaacattctatggtatggatataccatggtttgtttgacattcacccattgaaggaatttgggttgtttccagtttggggctgttaacacacacagtgctgtaaacatttggatacatttttttttgtttgaacctgagcttccatttctctgggataaatgcccaagagtgcagttgttgggttatatggta

SEQ ID NO: 220034 - DNA, 6793 bp, Homo sapiens
tctgaatgaacagctttgcccaagtgactgaaaaatacagcttcttcctgaatctaccggcgtagttgctgaagagcgctctagacaggacatggctctgaagactcactctttggaatgtcctcttgctcccggcttataaacaactgtcccgaggaaagaaaggttttacatagccaaatacagcctgacaaatggcacttcggaactgtgctttctgatgacaacgcgttcgatttctgacaaagcctctcgcacgctgcccctggagggaagtcctaagtaaaactcagaccctccttaaagtgaggagcgagggcttggacggtgaacacggcagcatggcatccgcggggcacattatcaccttgctcctgtggggttacttactggagctttggacaggaggtcatacagctgatactacccacccccggttacgcctgtcacataaagagctcttgaatctgaacagaacatcaatatttcatagcccttttggatttcttgatctccatacaatgctgctggatgaatatcaagagaggctcttcgtgggaggcagggaccttgtatattccctcagcttggagagaatcagtgacggctataaagagatacactggccgagtacagctctaaaaatggaagaatgcataatgaagggaaaagatgcgggtgaatgtgcaaattatgttcgggttttgcatcactataacaggacacaccttctgacctgtggtactggagcttttgatccagtttgtgccttcatcagagttggatatcatttggaggatcctctgtttcacctggaatcacccagatctgagagaggaaggggcagatgtccttttgaccccagctcctccttcatctccactttaattggtagtgaattgtttgctggactctacagtgactactggagcagagacgctgcgatcttccgcagcatggggcgactggcccatatccgcactgagcatgacgatgagcgtctgttgaaagaaccaaaatttgtaggttcatacatgattcctgacaatgaagacagagatgacaacaaagtatatttcttttttactgagaaggcactggaggcagaaaacaatgctcacgcaatttacaccagggtcgggcgactctgtgtgaatgatgtaggagggcagagaatactggtgaataagtggagcactttcctaaaagcgagactcgtttgctcagtaccaggaatgaatggaattgacacatattttgatgaattagaggacgtttttttgctacctaccagagatcataagaatccagtgatatttggactctttaacactaccagtaatatttttcgagggcatgctatatgtgtctatcacatgtctagcattcgggcagccttcaacggaccatatgcacataaggaaggacctgaataccactggtcagtctatgaaggaaaagtcccttatccaaggcctggttcttgtgccagcaaagtaaatggagggagatacggaaccaccaaggactatcctgatgatgccatccgatttgcaagaagtcatccactaatgtaccaggccataaaacctgcccataaaaaaccaatattggtaaaaacagatggaaaatataacctgaaacaaatagcagtagatcgagtggaagctgaggatggccaatatgacgtcttgtttattgggacagataatggaattgtgctgaaagtaatcacaatttacaaccaagaaatggaatcaatggaagaagtaattctagaagaacttcagatattcaaggatccagttcctattatttctatggagatttcttcaaaacggcaacagctgtatattggatctgcttctgctgtggctcaagtcagattccatcactgtgacatgtatggaagtgcttgtgctgactgctgcctggctcgagacccttactgtgcctgggatggcatatcctgctcccggtattacccaacaggcacacatgcaaaaaggcgtttccggagacaagatgttcgacatggaaatgcagctcagcagtgctttggacaacagtttgttggggatgctttggataagactgaagaacatctggcttatggcatagagaacaacagtactttgctggaatgtaccccacgatctttacaagcgaaagttatctggtttgtacagaaaggacgtgagacaagaaaagaggaggtgaagacagatgacagagtggttaagatggaccttggtttactcttcctaaggttacacaaatcagatgctgggacctatttttgccagacagtagagcatagctttgtccatacggtccgtaaaatcaccttggaggtagtggaagaggagaaagtcgaggatatgtttaacaaggacgatgaggaggacaggcatcacaggatgccttgtcctgctcagagtagcatctcgcagggagcaaaaccatggtacaaggaattcttgcagctgatcggttatagcaacttccagagagtggaagaatactgcgagaaagtatggtgcacagatagaaagaggaaaaagcttaaaatgtcaccctccaagtggaagtatgccaaccctcaggaaaagaagctccgttccaaacctgagcattaccgcctgcccaggcacacgctggactcctgatggggtgagactatctactgtcttttgaagaatttatatttggaaagtaaaaaagtaaaaaaataaatcatccaacttctttgcattacttaaaagagatttctgtaatacaggaatgactatgaaggtgttataataaattattctacatactcatttgactggataaactttacataaaattaactaattttttaaataaatgcattgcttaatggtttctcattatgtttatcaaaaaacaactgtagctgttattttcagtacttggctgcttttctgtgaaaattattattttacttttggaagacaagattattagaatattgaagaaaaattggagacttataatcatggtaaatataaaactaaatatgttttaatatttctgaatttttcttttccatcacaatgtaagatatgcagaatacaagatactttggcattctcatgtgaactttctgtactctttaaggattattttattagtgttgtttaagccatgagtgttaagtagcaggtgtgttgtgagtgctgtaacccatgaaaggaaaaatgtcattctgaggcttgtgcccttcgtaaaatattcattaaagtacattcacactatttttgctttataacacagtctttaattttcactcactgtggaaataaaaactaaggtaacttctcagaaagatatcaaatctcagaaagaatgtcaaatcagatgaagttatagttaggattctaactactgtaaaagatttttgcttccctcttgtggtaaaaaaaattatattctcacacatttcttttttctctacagacggatatctgtttaggaaagatttgaaagcagattatcagtaggtacatggatacatcaagttcatttgcagaaacaaataactgaaataaaaaacatgttaatccttgtatcatactttaatatgaaagtattgtttatagataatttatctcacaagtcaaaaatgaagattttgcagcactgaaaatctattaaagctccaaattttaagtttctaaataatcttcgctgaaatctaaaatatactataacaaccgtgttttatttgtgaaaaaaatattaaagtgatttgctctcaaatatcaaattttcttctctcttttatattaagagacagaaaattgtttcatgagttcacttaactactgagatattcagagcatttttacctctctcttaaatgttataaaaaacaattgtatttttaagaatgtttatttatcaaagtctttccttcttctattaaatatttagcaattacctttctaaaatatgaaattttgtaagatgttttcacctaaataaaaattgaaagcaagtggattacacaggagaaccattatgaacatttatttagatattaatcttaaacagtgtttatttcagttttcaaagttagcttataggttatacatttaagttaaagtgctcataatcacttgcaatttcattgtaaaatgaacaaatacataaatattttaagaaaaatttaagtttattcagataagtcaccatgcttcaaaagatctaagaaatgcaaatatactgaaaattgacatcctctgaaaattccacttgctatttacccaagaatccactggaggtcattactgccattaaataataactgaaaagactatgtagtgaaatgtatttttaaaaactatattcagtaaaagcctgctcaatttggagaaatagaaccacaaacacagatcacaggggccttacaaagtttatgtctgaacaaataagtcaattaagtacactttattgaaaattgccttccattaacacacaagaaagaaagcaggattttctcctgtatctgaattttaaaattaaaaaggcagataagacataaatagttatcattttaattgcaataacacagacaagtagttaatgatgataacaatggtgtaacttgtaaactaaatatttggtaactgaagcaataggcagaggaaaatagcttttctatgacacaagtcataagaagtccatatactgaagagcgtttgattaaaataaagtgactattaaccagaaaagaaacattttacataaaatgctaaaatttattataggaaaataaatcaaacccaaagaaagtttattcaatgctaatttgaaagaaaattgataagaaaactttgagggcccaagtccacaatttggtgagaccactaaattttacatataattatacacacacatatgtacatatatatgtatataatcttgcttcccgcctgtttatggcagtactgaagagaaatgggaaagaagagggagggagagagaaagacgaagggagagagaaagcagtttccaaggatatgtttcatgtcccaccattttctcagtttctccctctctctcccaacacacacacacacacacccctcacatactataaaataaatcttcactgccctatcaaaatacaaataaatcaatctatgctgttctgtccttcttgagaatctaaaacataccacaaaaatacatccccagtcttttgttctgtctgaggttagaattaattcaaattcagaatctgttgtgagaaatgcccaggctttaaaaattaaaaatggatggatcttctctgaactcagggagggcacatacttagatacctacaagacttggaggaattaagagttcacccttcatctcaccaaattttccccatttttctctttcttgtagaaggagagaaaccatgctctctagcaacattgagcaaaaatcataaccactcatctaatttctaagaggcacctccatcgagggccggtctcctgcttctttagacctcttctatctttgttacaggagaggacctgtggatagacttagttttgacataaaacaatgcccattcacctcctccttcagcacaacgtcacccattgggcaagagatccagatttgttaacaaaaaagattttacttcgtgattccacgtctataattctatattgctaattttttcttttgtgtgaattactgaatatttcagagcaaagctatcaacttggagaaacagggattaaaaataaggataaacactaataagagctctagaaaaaagggaacagaaagtctgcctgtttagtaagtggcaattccatacatattttagagttttttctatctaaaattagttaaatacttagaatgtttgtaatgagtgttcgatatttgctataggttttagggttttgtaaatcttcatagtaattataaacatttgtaaaatttgtaaaatactataagtcattttgagtgttggtgttaagcatgaaacaaacagcagctgttgtccttaaaaatgaattgacctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctacttgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaattggtttggctggggaaccggtggccaataactttttaaaaagtcttgttgggtcacgaattttggggcttccccgagaaaaaggggtgctgtttgtattacataaaggaagggccgcaaaacttttattataaaaggaaaggcggtctacagatgggtccattttaaaaagggagcctattttcgcggggcaacgacgtgggcggtggagaaccagattttaactatatgatttgccaaaaagcaagcgttgtttggtacgccggttcactaagcgggcgtggtgtacactttatctgggaaggaagcttaattgtgggctataatacaagtgggtccggcgggtataaaagggctaactatagggcacaaccataggggggggggtgctatggtaggatgctgatgggagaggag

SEQ ID NO: 220035 - DNA, 548 bp, Homo sapiens
ccgtgtgcacggtgcacgaggacccggcaggcagggtgccggcgcagcaggttacagatgaaaggcaggaccatgagcagggcctcagggggagccgtcagggccaggcgggccagccgcttggcgaaggcggccaccaggtaggcggggaggtgggaggaggacaggaagaggtcagccaggtggaagaagcgggcgcggtacttgacgtgaaagacagaggggtccaagaggcccgtagagcttccggtagaagtcagggtactccaggttgtgtttgtgaatcaagatgaacagcccgttcaaggccaagaggctgagggccccccaggaagcgccaggagccggagacctggctcgcctttccgggcgctgcgtccgtcttcgaccgccagggcccgcgtcctctccccggccacggcccaccagagggaccccgcggcgggtcctggctcgggcgcgtccttctgcgtccgagttcccaggttcccggccgagctgcggagacggacgcggagccctcggggaagacgaggcggcggcggccg

SEQ ID NO: 220036 - DNA, 491 bp, Homo sapiens
taccccgcgttcggcggctccccgaatcccgcagaaagacacgtttgcagcgaaaggctcttacacaccagccgggattttattcgttccctaccgagagtgcgctctgggagcgcgggaaacaaggaaaacgcacgtacctggcggcgctccgagggcggcctcgcgggccctccgctggcgaaggcccccagaagccactccccgcccggctgctcgccccacggccagtccctccctccccggcgacgcaccccgccgagccagctcacaggaagcgccaggagccggagacctggctcgcctttccgggcgctgcgtccgtcttcgaccgccagggcccgcgtcctctccccggccacggcccaccagagggaccccgcggcgggtcctggctcgggcgcgtccttctgcgtccgagttcccaggttcccggccgagctgcggagacggacgcggagccctcggggaagacgaggcggcggcggccg
